United States Patent 6,812,339 (POLYMORPHISMS IN KNOWN GENES ASSOCIATED WITH HUMAN DISEASE, METHODS OF DETECTION AND USES THEREOF) - sequence listing, part 26

SEQ ID NO: 12893 - DNA, 131724 bp, Human
gcactccagcctgggtgacagtgcgagactccatttcaaaaaaaaaaaaaaatttggcgtggtagcacatgcttctagtcccagctacttggaaggctgaggcaggaggatccctttagcccagaaactggaggctacagtgagctatgactgtgccactgcactctagcccaggcaacagagcaagactctatctctaaaaattaaataaataaaatataaatctggaaaaagaacataaatattggataacagcaattgacatgcgtgttttaatggaagattgttttaatggaagatttaagtggttatcatttataagtttccagaatggaatagattgttgcatcctagctcctgtcaggagtagagcttcactggtttcacaggtagggtatgaggtgctgtgtaaagctagaagcttcttttggaagtaattttcagacagagaatactaatggagaaatttcagactgagggaaagggcctgtgagagaggcctcagaattagagctccaaaggcagattcgaggatttcagaactcagtgctgaaaacaccaaactgctgaaagaggtggccacagtacaaccattttgatgagaagttgaacagggtgaccatgcctctttggagaaataatcccctaggtctggaggcggcccaggatcctgaaggtgagtaccagtgctggtggaaaataaggagcattcaaagtgcattaagacccactccggggtctttaacttgttaacatggaaaacaatagcaaagtactgctggggccccctgctgtgtgtatagaatataccggaagactaagacatggagatagcagctgggagctaccgcagagattcagacttgaggtgaagggctggccttaggggggcacgtgggtgtgtaggaagaactgctcagcaggccttagggatacatttgttgtgcaggtgcagagaggacacaggcatggctggggcgggagttcaggatgagaaccctgggacaggctgtaagatgatcgagccaggtgtgtgtgtgtgtgtgtgtgtgtgtgtgtgtgtgtgtgtgtgtgtgtgtagaggtataatgacatactgtaaaatgcaagatatgaagtgtagaatgagttttgatacatttctacatctgtgtaaccaccccccacaacctcagtttttttaatacatatgtttctttttaagtttgagtttcccgtgcctgcagagtctaagtttaaacagcctcacagacaagaagctatatgcacctgaagtgaacaggaacacgggctgcaacagtagatcgtaaagttatttggagcgaaggaggtagaagtgttgtgagcaaatgaagacaggtgcaggaagggataaacggagaacagaaagttccaacctttgagatttttgaagtgcttgtgccccacacactgaggatcttctttgccgtatatagggcaaatctgatttaccctataaatttctcaggccttccacctcatatttaattctcttaagcgagaaaaaaaatttttttctgacttggctgctgccaaggtcggctctatcaaatctggtgcgtctctctgggggaaagggagctagaagaccccatagggtggtttgcacctcctctaagcatgcaagcacggctctggtcttgacctggggagcccagcttcctcggtgcaccgtgctttggcaaccgggtcttggcgcctccgagagcggggggaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcagtgtagtggcgcgatcttggctcactgcaacctccgcttcccgggttcaagcaattctcctgcctcagcctcccaagtagctgggactacaggcgcacaccaccatgcccggctaatttttgtatttttagtagagacgggggtttcaccatattggtcaggccggtctcgagctcctgacctcaggtgatccacccgcctcggcctcccaaagtgctgggattacaggcgtgggccaccgctcccggcggggcccgagtttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagaactctggaaattttattagcattttaaaatttgcattctcgaccgaagattaaagtgcaaattactttgaagctgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaattctctaaacatttagtcgttggcttatttagtgtggagaacatgcttgggggatttctcaaaatgtagtaaaaatattctagtagaggaattaattttgaataacctttattagtagaggaggctgcttacaccgttaaaaacaaaagcaactcaaggtcacttagaatgggaaacttcagtattttctacaccagaaggtgtgtactgtgccagatgaatccttaaaaatccataaaacaactacttctagtcatttttaaatagtttgaaattgatcttacgtatgattctaaaataattgtatagttgcatttttaatcaattgttatcccctttcctttttatataatattttctaagaaaccttgagagaaggtccttagcatatggagtagatacctgtgcattttggatgtgcttcagaggtttgcaggggtttaaaacttgtttctggtcagattcattgatgttctctttctaagcctcttggttagtaataggaaatccaagatttaagcttaattatttaattttaagtaattaattatttaagatgaatttttctaagtcgaagacttttttttggctatgaggaaaattacttcccaattaatcagcttcctgtgtttggactgtggttttcctaaaacaacatataaattgtagttgtttttctttctttcttttttttttttttttttttttgagacaggagtctcgctctgtcccccaggctgtagtgcagtggcatgatctcagctcactgcaacctccgcctcctgggttcaagcgattcttctgcctcggcctcccgagtagctgggactacaggcacacgccaccacacccggttaatttttgtatttttagttagagacgggatttcaccatattggccaggctggtctcaaactcctgacctcaggtgatccacccgcctcggcttcccagagtgctgggattacaggcgtgagccactgcgcccggcctgtagttgtgttttttaattgaacgttttgatttcacctttggcttatatttgggcagctctgcggtgtgggtgcttcactgtcatttcataagcaccataccttagtttcaacagaaagtctttgttacatgtagaaagcaaaaatacaattaattttctttaaacctgttttttcaatcttattatttatttatttatttttttgagacggagtcttgctccattgcccaggctggagtgcagtggctcgatttcggctcactgcaacctccacctcctggcttcaagtaattctcctctcggcctcctgagtacctgggattacaggcgcacaccaccatgcctggctagtttttgtatttttagtagagatggggtttcaccatattggtcaggctggtctcgagctcctgacctcaggtgttacacctgcctcagcatcgcaaagtgatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccttgcctttcctgcccaccctgttccatattattccgatatgtactgccccttcatccttgcctgtcccagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgcagttgcatgtttgcctcctgtttttgcctttttttttttttttttggagacatagtcttgttttgtcgcccaggctggagtgcagtgtcgcgatctcggctcactgcaacctctgcctcctgggttcaaggaattcccctgcctcagcctcccgagtagctgggactacaggtgggctaacatgcctggctaatttttgtattttttttagtggagatggggtttcaccatgttggccaggccgatctcgaactcctgacctccggtgatcggcccacctctgcctcccaaagtgctgggattacaggtgcgaaccaccactcctggccctgtttcatttgttaaacagtaagtaatgtaggatacaatctactcttactggtacctgtttttagtacagtggccttttacaagtttatggaatgaaggagtgagtgatcccattttccttcctaatctgttagtgcttctgacccactctactcttcagattgtactcctccccttggctgactatagttttttcctgatcctccctagccaatcttattctacacagtcatttgtttaacaagcttttttatttgtttgttaagagacagggtcttgctctgtctcccaggctggagtgcagtggtgcgattatagcccaccgtagcctcaaactcctgggcttaagtgagtctcctgcctcaagctcttgagtagctgggattccaggtatctgcgaccatgtctggcaacaagcattttttgagcacctactgtctggctcaaaactgtttctcagctttgcacatcatagttacctgggtgggtttaagaagaaatgggagattttcagacctcacctccagagctagtgaatcatggtgtctgggatgggtggggcttctgtgttttggcaaagctgattctggagtgctggaggatgactcattgtcgtgtgcttccaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcaggtaatctggaggggctggggttcacatggaggctgggcatgagggaggccgaagggttgcagccacagaagcagggctcccctgagctacatacagtgtttagagcttagaggattctgtagaggattctccctgtgaagggctgtttttgcctgcatcacaaaggagggggccgtgaattctagaaatgcaggttcaactctttcctgttggttattagtcaagactgagtctggacagagaatgatgttagagagaggtgagattgttcagatttcatctcagtccaccccttcattttccagtcatccttgtgggaactaaatatccttgtttcctagaactagaagtccacttctccactgcatccatttggggaaagtgtctagaaaggccaaatcctggtgtcaaatttgaatgagcgggaagtaacaccggaaggaaggccacgttggcttgaattctctcccctgggtgctaaggaggaatgtgttcttttttacacatgtgaaacctgagacatagacagttacgggattggccaagtttactgaattagaaagtatctgaatgagtttatctgtctccaaagctcaatactcaatgtgcttactgcactaggtctctaaattacacaggtctggagctgtactgtccgatatcgaagcccctagccacatgtggctttttaaatttaaattcattacaatgaaataaatgaaaacattcggtttcttcattacactagccacatttcatgtgcttaatagccatatacagctaagggctatcatactggataatgcattgctgtctcttagaaagtctaattcgatggcactggtctagaatgtgggagctatgagacatccaccaaataaagacctgtggaatcttgttatttctggcaattagatacacatactgtaattcacagaatatctttaaatgtctttaaagtgttctaagctccatgaaatacagcctagcagtgtgatatcaccttgactaagctttcatgaattactccatttgctgggcttaagcactgtgtactaaagtcacacaactatatattattaactagctgtgcaactttggagaagttacttaagctccctgggcctttttttcctcttgtcaaaaatgagggaaagggttcctgagggtcttaaagatcttatgaatcttggccattattaaaaaggaagttaagcagaaaagaagttaaaaaagaagttaagcaccaaagaaagcaggaaggtgtgtctgtctgtgtctgtctttgtgtattttactgaagttactgactatgtaattaacagaggtcaagatactcttttttctttgcttggattggctgctcatagtatgtccttataatagtttccaaacttttgtttcctttcttttttttttttttttttgagatggagtctcactctgttgcccaggctggagtgcagtggtgtgatcttggctcactgcaacctccacctcctgggttcaaatgattctcctgtcttagcctcctgagtagttaggactacaggcgcccgccaccacacccgactaatttttgtattttttagtaaagatggagtttcaccatgttggccaggctggccttgaacttctgacctcaagtgatccacccccctcagcttcccaaagtgctgggattacaggcgtgagctgccgtgccaggccaaaactttgcttttcataggaaggaaggagtgtatcagaaatacgatctttgtgcttttttttttttttaattttttttttttttttttgagacggagtctcgctctgtcgcccaggccggactgcggactgcagtggcgcaatctcggctcactgcaagctccgcttcccgggttcacgccattctcctgcctcagcctcccccagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacgatctttgtgctttaagattttaagatgtgtcaaaggtttagtgactaaataatacagggtcatggctaatctggtggattcagctgtggggctgagatgagaaatgggatgtgtcacatgagtaaagagggcaagtcgcagtgccaggttttccataggggagtaactcatttgattttcacaaacgtctcaggaggtaggaattattatcctcatttacagataggaaaaccaaggcttagtaaatggtaaggagactgccacagaaaagagctggctgagctaggatttattccaggcctgtctggttccaaaacctatggatttcccattctacttaactgggaccagttgccatgtttccttggaaaatggacacttaacgattgtttagaggctgtggtctaatcctcagagtaatttagggctgatggacagttagcaacaatgttaggtgaaaaagtccctgccattctatcttggcagagaagacagcagccatgggtcttcacaggaagaaatacagggaaaggccagtgacggatcagtgtcaatgctggatgtggcataacatcaaggtttgattataaaccctaagatagtggagctttagagaaggactttaggctatgcagagttcagaacgactctcacaagggtgtttcagagtggtgatagggaaagttacaaaaggaagcagtaggggggcaagatagagggttcagggtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaaattcagatgccagcagaattaaactacgtaaatatagagacagaaagatggagtgtgggagagtgggggagagccaaaaaaacaaacacactgtggagagtcctgaagcttgtatgcagcaaagggagcttcttagatagcttcctactaacaaatatatagcttatattcatttttcagaggttggatttacttaaaataatttcatggaggtgaatggtaaacatgtatagtggagtacaaaaatatattccatgaaagatcattgttcttctaaccccaacctgcaggtctgtttgtcattccaggatgatttactgcatgtacaggtgtatgtgtctgtttatccttttcatatgtaatataaaatatttgcataattaatatagtggaagtatgttgttcctacttgtgtctaattagcttttttcatttactacagctgagaatttttagtgacctagaattccactgtatagatgtgaggccagccaggcgcagtggctcatgcctgtaatcccagcactttgggaggccaaggcaggtggatcacctgaggtcaggagttctagaccagcctggccaacatggcgaaaccccatctctactgaaaatataaaaattagctgggcatggtggcacacgcctgtaatcccagctactcgagaggctgaggcaggggaatctcttgaatctgggaggtggaggttgcagtgagctgagattgtgccattgcactccggcctgggcgacagggtgagactctatctcaaaaaaaaaaaaaaaaagaaagaaaaatagacgtggaaggctacgatttgaagttatgcagtgagaggtgaaagttgtaggagttgtcatggaatagtaaaacctaccaacctggcacaccttggggcaagttgctaactttctactttctaatacctgatgtctagtgtttactaggtcagtagcttagtgaaatttagtcaacttttatttatttatttattttttgagacacagtctcgctctatcgcccaggctggagtgcagtggtgcaatcttggctcactgcaacctccacctcccgggctcagacgattctctcacctcagcctcttgagtagctgagattacaggcgtgcgcggcgatgcccagctaatttttgtacttttagtagagacagagtttcaccatgttggtcaggctggtctcaaactcctgacctcaaatgattgcccgcctcggcctcccaaagtgctgggattacaggcgtgagccactgcatctggccttagtagaatttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacatatattagaagaaaatctctaaaatctttagccaaagattggctaagactgaccagattaactggatagtctttgaataacgagtgtaaaatatttttgttgttattttcttacatgattgtggatattactgtggaaagaaatagtcttttgaagaaattctgtttattgctgttgcttgtaccagcaggatcagttgttagcaggtacactttttttttgttttttttttttgagacagtctcactctgtcgcttaggctggagtgctgtggcgcgatcccagctcactgcaacctctgcctcctgggttcaagagattctggtgcctgagcctcttgagtagctgggattacaggcgctcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggccgcaggtacactattgataagcaaatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcctcagcctcccatgctcctatagaatgctgtttgacacagtacttaatgcaaaggtctgcatagttctcttcctctccttttctgtgcagaagctgtcagatgaagggttgcattgtagataattcagttctgcatgtgtgtcctttgtaaggacctgaatgttatctgtcttggggccctcccttttggagcaccggggacttccatccacactcacattcaccctcccccagatcaaaccacctcgggcccccctgggcagctccagcctcttctgtggctcgtggcccagtttcagtcacctttcccctgttagaaggatcagtcaggtctgtgtctaatattgaaggggcctttccttcacttttcttcagcagttactccacttggagagcacacagtgagagagcacacgccagttgggaaacacattgtgtcgtatgtttaagtgcttaaaagttcataaaacatgaaatgtgttcgtttgaaaatggaatagtatcccatgcagtttttacaagtaagagatatggctggtgaattcacaacggaagatagttgtttaaattaaaaaaaacaattttttagagcagttttaggttcacagcaaaattgagaggaaggtacggagattttttttatatactccctgccccaacacatgcagagcctctcccacattaccagcatccccatcagagtggtgcatttgctagcatcgatgaacttacactgatgcatcattgtcatccagagtccgtagtttgcataggggtttgctcttgttgatgtactttttaatgggtttggacaaatgtgtaatagcttgtgtccattatagtattcacagcattgccactgtcctaaaaattctctgtgggattatttaaatttaagataacattttaaacattttagagttttttgcaaatttttattttattttaaatttttgtttatttaattaattttttttttttttgagacgaagtcttgatcttgtctcccaggctggggtgtagtggtgtgatctcggctcactgcaatctccgcctcccaggttcaagcgattttcctgtctcagcctcctgaatagctgggattacaggcatgcaccaccaaacctggctaatttttgtattttaaattagccactcccactaatttttatatttttggtagagacagggtttcaccatgttggccaggttggtcttgaactcctgacctcaggtgctccgcctgcctcggcctcccaaaatgctgggattacaggcatgagccaccaggactggccatttatttagaggcagggtctcattctgtctcccaggctggagtgtagtggctccatcatggctcactgcatcctccaactcctaggctcaaacaattctcccacctcagcctcccgagcagttaggactacaggtgcacgctatcatgcctggctaatttttaaaatttttctttctgtggagacagggtctctttttgttgcccacgctggtcttgaactcctggcttccagcagtcaggagttgaactcctgcttcagctcccaaagtgctgggattacaggtgtgagcctacacactaagcccattttttttttttaatttttcaagagacagaggttcgttctgttgcccaggttggaatgcagtggcacaatcatagctcaccgtagcctcaaactcctggactcaagtaatcctcctgcctcagcctcccaggtagctgggactacaggtgcgctacatgcccagctaattttattaatttatttatttttgggaaacagagtctcactcttgcccaggttggagtgcagtggcgtgatcttgactcactgcaacctccactttccagatcaagtgattctcgtgcctcagcctcctgagtagctgggactacaggcgcatgcaaccatgcctggctaatttttgtatttttagtagagacagggttttgccacgttggccaggctggtcttatctttggagttttctaatgttgtaaagaaggaaatactttattcaaataagcaataaaagcgttttatacaaattggattgagactttatttttgaaagagtctggccacttaagtgaaatgagatccgtttgattttagacagctttcaattaaagctagaataggaaatgatattagattaagaaaaacttttcagataaaaacattcccaaattttactttcaaattaaacaaattttcagagtttctagcaaaacaaaactcctttttttttttgaaacagagtctcactctgtcacccaggctggagtgcagtggcataacctcggctcactgcaagctccgcctcctgggttcacgccattctcctgcctcagcctcccgagtagctgggactacaggcgcccgccgccacgccaggctaattttttttgtatttttagtagagacggggtttcaccatgttagccaggatggtctcaatctcctgacctcgtgatccgcccgcctcagcctcccaaagtgctgcgattacaggggtgagccaccatgcccggccagggactgatggctttgatagcctattttagatagtgtctcaattttgtttatctcagggatagtctttgcttatatgtcaagtatagcagtttaattggtcagatagaaactttctgtggatagtattttaataaagcaattatgaaaacaaagtacgtaggaagtaacctacttgtctacctttgactagaaaggaaatttagaaaacatctagagccaggaaacgtaaatacaggggttaaagttacaaataaattttataacagcatattaaaaaacaaaaacatttgattggtttacatctgtgtctcccttgtgaaaatctaatctttaaggacaaacactgcattttatccatttctgtatagtacagtacctggctttatagttaatggtcaataaaccattgctgaatgaataaatgatggttaaatttgaagctctattttaaaatactaggtaagtgatctgaacccacctgtagacaccagagaataaaactattgatgttcagtgtacatttttgttctgtgatattttaaacatatatctgaattttttttctttttgagacaacgtctcgctttttagcccaggctagaatgcagtggtgccatcttggctcactgctgccttgacctcctgggctcagcaattcttccacttcagtccccaagtaccttggactacaggcacgtgccaccactcctggctcattttaaatatttttatagagatggggatctcgctgtgttgcctaggctggtctcaaactcctgggctcaagtgatcttctcaccttggcctcccaaagtgctgggattacaggcatgaggcagcatgcctgacctctgaattttttttttgagatgaagtcttgctctgtcacccaggctggagtgcaatggcatgatctcggctcactgcaacctctgcctcccaggttcaagcgattctcctgcttcagccttctgagcagctgggattacaggcgcccgccaccatgcccagctaatttttgtatttttagtagagacgaggtttcaccatgttggccaggctggtctcgaattcctgacctcacgtgatccacccgcctcggcctcccaaagtgctgggattacaggtgtgagccaccgcgcccggtgacctctgaatttttaaggtgattaaaaattcaaatgtagtttaacgacttaagatgtaattcatataccaggtaattcatttgtctcaagtgtacaattcagtgttttttagtaaattcacagggttgtaccacagtcacaagaatctggttttggaacatttcagtcactccccatgtactcttcgctccagccctaggcagacactaatagattttctgtctctacagaggtgtctattctggaaattttatataactggaatgataagatgtgtaaccttttgtgtcttacttctcttacttagcctgatgtttctaagtttatccatgttgtagcatgtatttttaattattattgttcctttatattagtaatatttcatcatatggatatataccacattatttttctgtttatcagctgatgaacatctgggttacttatgggttttggctattatgagtaatgttgctgtgaacctgtgtgcaagagtttttgaatgaatgtatgtttcattctcttgggtatataccaagtagtggtgttactgagttttatgttaactctgtccttaacgttttgaggaactgccacacttttccaaagaggctgcactattttacattcctaccgacagtctatgagggttccagaaaattgaaactaagtttttttaagttacaagggaagatgcctttatcctagcaagctacaggtaattaaaaccctgcgagagtctctcatgacaagtttagattatgaaggattctttaggtttgcattttattatcaatagatacatgttaatattcaggctgggtgtggtggctcacacctgtaatcccagcactttgggaggccgaggtgggtggatcacctgaggtcaggagttcgaaaccagccatggtgaaaccccgtctctaccaaaaatacaaaaattagccaggcgtggtgacacatgcctgtaatcccagctactcgggaggcagaggtgggagaattttctgagcccaggacgtggaggttgcagggagctgagattgctccactgcactccagcctgggtgacagagcaagactctatctcaaaaaaaaaattatatatgtgtatatattgaatataatatgtatatatatattcagtctttgaaaacgttcctttcttacttgtcacagagtttatattgaaaggaacagtatttgtggaagtaaagcaattcataaagggacctggagagagtttttctttgctgtagctgtattattggttggtagaaatattggtatctatatgaagggctaaagtaacattttggactttgggtgacatgtgtttcctgaaaacgagggagcaagaattctgttgccctaaaacttggcaggaatagttttaatctgtgagtttctttttttttctattattatactttaagttttagggtacatgtgcacaacgtgcaggttagttacatatgtatacatgtgccatgttggtgtgctgcacccattaactcatcatttaacattaggtatatctcctaatgctatccctcccccctccccccaccccacaacaggccctggtgtgtgatgttccccttcctgtgtccatgtgttctcattgttcgattcccacctatgagtgagaacatgtggtggttggtgttttgtccttgcgatagtttgctgagaatgatggtttccagtttcatccatgtccctacaaaggacatgaactcatccttttttatggctgcatagtattccatggtgtatatgtgccacattttcttaatccagtctattattgttgtacatttgggttggtttcaagtctttgctattgtgaatagtgccgctataaacatacgtgtgcatgtgccttttaatctgtgagtttctaaaattggaaaaccactgtcactcttctggggagtgaaagagaaaacccgagagttggtgaaaatggacagctgtccttcatgtggccagtgggaagagggcagttcacaaagactttcagacctggttgtagcattggggaacttttacaggtggtgacactaggtattgtccttgtattgtgctgccttacgcttgctgccatagggaacttttggaaggtcacaaaggtcatctgtgtcatcagtgtcacttgcttactcagcagcatccccctggagttctttgactcacatattcctagttacttggtggtttgaggatcctgtcctgttgatcacccctcaggtacctacttacttttggagtcttgtgaatgcctttttgtcctctttttatattaattaacttatttttaaaaactctcttttattgtggtacaatatgcacaacttaaaatttatcattttaggctgggcgcagtggctcacgcctgtaatcccagcactttgggaggccgaggcgggcagatcatctgaggtcaggagttcgagaccagcctgaccaacatggcgaatccctgtctctactaaaaatacaaaaattagttagacatggtggtgggtgccagtaatcccaactacttgtgaggctaaggcaggagaatcgcttgaacctgggagtcggaggttgcagtgagctgagatcgcgccattgcactccagtctgtctcaaaaaaaaaaaaaaaaaatatatatatatatatatatatatttatcattgtaaccatttttaagcatagagttcagtggtattaggtacattcaccataatgtgcaactgtcaccaccatccatctccagaacttcccagacagaaactctgtacccattaaacgattatttcccatttacccctctcatgaactaacttatgactgaggccagtctcttatgcaagcccagctttcttgaaagttccctggcttctgaaatcacctgtagactcacatgagttacgatgattcctttgatctctgccagcatcctttcttggctctcttaactcccaaatgtttcctgtattgctgacttcttcctttgttttaagtgctgctctaacctgtgcctcttgggtaatagggggctccaaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttcagaacttataaaaattgccgttaactacccgttaactctagtcctgaggttttaggttttatttaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacacaaaatacaaattagttcagtgaagcagattggatttatcaaatggcaataaatgtttgctgaattgaattgatctctgctggagagtttgctgtctgagcaagatttcctccctcactcttcttactctgttttttcattttacttctttattcgttcaacaaatgttcattctatggctgcattgagccagatcctattctaggtgcaggatatatagcagtgcatatatctctcacatggaccttatatctcttgggggctgccagggaagacagttgataaacaagtacatcaataaataagatatttgcagtaagtggtaagtgctgtaaagaaaaacaaagtgatatgatggatgtgaccaaggggacacgggctgttttaaatagggtggtcaaagaagggaggcctctctaaggaagttaagtcagagctagtcccaaatgacagtgagccattctcatcaagatctggggaaagagcatttgaggaggaaggagcagcaaggtgagactgtgctgaggcaggcagctgtgagcctgagtgctttgagcacagggtgacaccagtggggttgtgtcatgggctcatagcagaagggcgcacagctgcctgtgtataccacggaaagggttgggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttccgcagtgtttgtgtccctgggtacttgagattagggattggtgatgactcttaaggagtatgctgccttcaagtatctgtttaacaaagcacagtttgcaccgcccttaatccatttaacccttagtggacacagcacatgtttcagagagcacggggttgggggtaaggttatagattaacagcatcccaaggcagaagaatttttcctagtacagaacaaaatggagtctcctatgtctgcttctttctacacagacacagtaacaatctgatctttcttttccacacatttcccccttttctattcgacaaaaccgccattgtcatcatggcctgttctcaatgagctgttgggtacacctcccagacggggtggcggccgggcagaggggctcctcacttcccagaaggggcagcggccgggcagaggggctcctcacttcccagacggggaagccgggcagaggggccccccacctcccagacggggcggctggccgggcaggggctgccccccacctcctggacggggcggctgctgggcggagatgctccccacttcccagacggggcggctgccgggcgggggggggctccttcagacggggcggccggtcagagacgctcctcacctcccagacggggtcgcggccgggcagaggcactcttcacatcccagatggggcggcggggcagaggcgctcccaacatcccagatgatgggcgggcgggcagagacgctcctcacttcctagacgggatgacggccgggaagaggtgctcctcacttcccagactgggcggccgggcggaggggctcctcacatcccagacgatgggcggccaggcagagacgctcctcacttcctatagggggtggcggccgggcagagctgcaatctcagcactttgggaggccaaggcaggcggctgggaggtggaggttgtagcgagccgagatcacgccactgcactccagcctgggcaccattgagcactgagtgagcgagactccgtctgcactcccggcacctcgggaggctgaggctggcagaccactcgcggttaggagctggagaccagccccgccaacacggcgaaaccccgtctccaccgaaaaataggaaaaccagtcaggtgtggcggcgcgcgcctgcaatcccaggcactcggcaggctgaggcgggagaatcaggcagggaggctgcagtgagccgagatggcggcagcacagtccagcctcggcatcagagggagaccgtgcaaaggggagacgaggaccgtgcaatggggagggggagggggagggggagggagattgagatttactttcttaaaatatctctgctcttgtgtggtggtgtttgaagggaactgggtgagagattgatgggaaggttgtgctgttgtccaggtgaaagggagagctgcttaggctggggtggtggcagtagagatggaaagaaaggctgggacgggaagtctatactgggggtacgttgaagtgtagttttggtgggtgttgtcaatggtattcccttctgagagtggctgctacagcgcagccagcactaggtggtcggggttttcctagttaggtgaggttatgtacatcagcgtggtcaggtgaataacggcctcccaaaagatgcctgtgccctaatccctggaacctgtgaacttggtaccttacatggcagaagggactttgcaaatgtgattgagtcaagagtcttgagatgagtgagatgatcctggattttccggatgggcacaatctaatggcatgaatccttaaaagtggagagctccctgggtgtggtagctcatgcctctcatcccagcattctgggaggctgaggctgaaggattgcttaagctcaggagtttgggaccagcctgggcaacagcgagatcaggtctctacaaaaaaaaaaaaaaaaaaaaattagccaggtgtgggggtggctgcttttagtcccagctgcttgcgaggctgaggtgggaggattgcctgaccccaggatttcaaggctgcagtgaacagtgatcatgccactgcatttcagcctgggtgacagagtgaggccacgtctcttaaaaaaaaaaaaaaaaaagggcaggggaagtgtggacagaacctttcctggctgcaactagagatgccatgacagaagacacaggagagtttccaggcttgacagagacttgacctgctattgctggctttgaaggtggaggaagggaacccctcagccaaagaatatgggaggcctctacaggctagcaacagccctcagctgacagccagcaaggaatgggacctagtcctactaacacacagggagctgaattctgccaactaactgattgagcaaagaaacagtccctgctagaggctccagaaagaaatgtagccccacagacaccttgacagagactggcgtcagatttcggacccacagaactctaagatagtcaatttgtgtcatttacgccactaaatttctggtgatttgttaacacagtgaaagatgactaatgcaactggtatagtttataatctagatttcccttgttagtggggttgaacatcgttccgtatgtttaaaggccatttgtattttattctctgaaccatctatgtcctttgcccatttctctattgatcccggccaacatcaagaatttccttatttattgtggagattggccctttttgatatgaggtgcaagtttcccccgactatttggtattttaaaccaggaaactatatgagactggcgggggacagactgcggggtgataagagtcccaggactgagtcctcgtcactgcactctttggaggacaagcagaggagcagagaagcctgtaacttttccacttcctgttggtaggccattcttcagtccaaatgaaaatggccatagaatggctaaaccaatgtgttatttgtattcttttaacttcttcttcttcttttttttctttttttttttttgagacagtcttgctttgtcaccaggctggagtgcagtggtgtgatctcggctcactgcagcctctgcctctcaggttcaagcgattctccacttcagcctgccgagtagctgggattaaaggtgtctgccaccacgtttggctaattttcatatttttagtttcaccatgatgaccaggctggtcttgaactcctgacctcaggtgatctgcccgccttgtcctcccaaagtgctgagattacaggcgtgagccaccatgcccagccagtactctttttttttttttttttttgagacggagtcttgctctgtcgcccaggctggagtgcagtggtgcgatctcggctcactgcaagctctgtgtcccaggctcatgccattctccttcctcagcctcctgagcagctgggactacaggcgcccgccaccatgcctggctaattttttttgtatttttagtagagacagggtttcaccgtgttagccaggatggtctccatctcctaaccttgcgatccgcccaccttggcctcccaaagtgctgggattacaggcgtgagccaccgcgcccgccagccagtattcttttaacttctattcctcagttcaattttagctatgagtaggtctcaagttttaagccaaaagcttcaatgactaaaccatttcatagttatggtttggaagttttacagttccattcattatataataaactgtggtatggccgtgatgcaggaatggggagatatactgtccagtcacatattctggtttctagaggctaatcttattcttaccagtgtggtcagtgagcatggaattagaatgcacgttaccttcagctatctcagagtcattttactgtttgcgttgatgtggaatgagcattgtcattattcctgcatgacgtttccaggttttccctgagagaatggtatatggcttgatcaaagttctcgaatattgaagacacctgggaaaagagatttgttgttatcttgataactttatacctggaaaggactctcagtgaaagaacctaagatctggagtcaaaagacctggctcagtttctcaccacctctctgattttcagcagttcatttaactttgtctgtttgttcatttgtgaaatgaataaaataataatatctatctaggatatcttgtagaattgttagagtgctcatttttttcttaagatatgtatggtacttaatttttcataaatatatatgatatatatgaaatataaggtatttatgaaaaatacctttgtacactgtgatgaagtacatgaacaagtcatagagctcacatttcagatattaataggaggagcagatgaatgagcccggatatgatttatcctgtagcaataaacaagtttttgcaaaaatgaagctacctgaacagatacaacaagaattacatctttgggtgaggattacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccaaggtgggcggatcacctaaggtcaggagttcgagaccagcctggccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgttttataaccacacaaatactcaggactctgagattgggacgttacctttagcagaacaggtaaagcaccatcaatgcacatttagaaatcgtcaggacattgcatatcagatgaagaagcaggaggcatcagcactggcctgcgggtgggacaagggaatgtcataatatttcagaccccttgacgtcaccacctttaagaagcaatatggggaagctgaactaggtgtgtcacactgtgatccattgtaaaagggactcatttacctcatggtggggatagtattttaaagtgtttagtttcagaagttttccttcttgaaaacactcaaaacttgtgtttacttgaaaataaacagtgtcagatttttcattaggggcaaaacagaaagcaacgagagagtctcaaggacgctattgggctgatacactgataccaaatgcagtggatgggcaaggaagtaacaagcggaagcaatgtatgtacacggtgcataattcctctttagtgagtttgagatgtgtgtgagactgtcccatggcttcccaccccaggagctgctaccttgtagagtccagtcatccacttgatgagggtggtgttcattttccttatcaccctctccctcaatttttatctgagagatggaattatgagttacaggaggaaggagtaagaggcacatcaaagcctttttgtgtggctttgaataagcggccttattggtttggggttgttagctttgggtgtgctattttcatcatgaagcacctggggtttgtttttttctaaaagatgtagataaactagagagaatccaggggaagggcaacaaaaatgatgtatgacttggagagaaggagaataacagtctataaatatttgaaaggtaatataaaagagggagagagattatttacagcagtggagaggagtttgacagggaacaaaagcatgcatctaggagcagggggaaattgggtaggactgaaaaaaaacaaagcataataagggtgattaagcaaagaaatgtaattctcacattagtttgtgtttccaggatgcaggatggtaggaggaagaagtgacgtttgtcaaactgaagatccacacacgactatgaatcacgttttcctaattcctctctgggaagccaggagagcgggcagtgctttattctgtgcctcctaagcatgcagtcggtttaattctcaactctttggcattatgttttcataggtggtagtaataattataacccgagtagctctcatttaccgagtgtctgccttgtggcaggtgttgtcttagctgctttgttatttatattttcatttattctttacggcaactctgtaaataggaagtatgtttttccaattatagggaaattgaggtttagtaacttccacaagatggcatgtgtattaagtggtggaggtggaactcaaacccgggtctgtgacccacagcccatgctcatgccctacatcgggctccattactctgtcattgtggtcatgagagtagtaactgggacccagtaggtggccaggtggtttgtatcttggtacaagggtaagtaaaatagttgatgtccaaggctccctttgctttctttttctcttattttcctttcttgagatatattttctctgtaagtgctgtgttattaacatactacattttatcattctgtaaattaagttatactatatgcttttagtcatctttgtggttatatagtgatatgtacaatctcacttaggaaatcaacaattgttgttttttattttgagacagggtctctatcgcccaggctggagtgcagtcgtgtgatcacagctcactgcagccttgacttcctgggctcaagcagtcctcccacctcagcctcctgattagctgggactacaggcgcaagccaccatgcccggctaagttttgtatttttttgtagagatggggttttaccatgttgcccagggtggtctcaaactcctaagctcaagcgatctgcctgtttctgcctcccagagtgctgggattacaggcgtgaccactgcacctggcctgaaagaaagtattttacaaggcaagcattatcctggatcttacaggggatctcttagctgtattctatatttgcctcagctttctgtctctgatatttgataatatccggtgtattgatgattgctttaaaaaaacaaaattcacagaattcttcactacttagaataaaagtgaagagctgtgtgtctgggtttttcatgtcattgcaagaagttaccaaacctggaatcaaaaggcctgggtttcaatcgcagttccagctatgtttctttgtgtgctgggcacctttctaagcacagctagctcctctgtcttgggccattgtacctcctggtcttcaaccttacaaggttatcgtaggtagcgtttgaaagaatatacataaaatgttgtttatgaattgcagagtatacttaaatgaaaaatgttaagtttaaaagttagcatcggctgggcacgttggctcatgcctataatcccagcactttggaaggccaaggcaggtagatggcttgagcccaggagtttgagatcagcctgggcaacatggtgaagccccattcctacaaaaaataaaaaaattagctgggtatggtggcacacacctgtggtctcagctacttgggagatgcaggtgggaggatcacctgagcctggggaggttgaggctggagtgaaccatgatcgtgccacctcactccagcctgggtgacagagtgagacactatctgaaaaaataataataataaaaataaaagttagcatcctttatattagcagcttttttcttagtgcagcttctcttggtaaaactctgatatagtttagggatggttgaggcttctgaggaagttgacatccaaaggaccttgttagatttttatccgggggcggaacagaaagtactaagtgaatttcaaggatattctactaaggccacagcttttgcctcttcctcccctttccctatggtgacatgcaatggagaccatgccagatcttaaaggtggatggcatagaaatcaaaatgtggctcaaggcattggcatgttcatctacacttgcattgtgaatacaaaggtgtactcatctgcacctttccatttgccagttctcctagctgttctccgtaggaattaccttccctttggaattgtgtaccttttaaaattcagaactttttgaatttccgtctccgggtcattgctcctagttgttgtctctagtgaattcttctctaaagtatccctagattacttttactgtaaactgtaatgatttgactctggccatatttctcccaaggtctcctatctcggttacttgtaaggctactcctcccctctcttgttctctttgatcttttataattggcttaaagctctctatatttaatctgcagtgactttgtttctcctccctattttggctttttcaatccctgagaatttaataatctgtttctcattattttctattttttcttaaggtgtcgcattctctgtcgcacagttaatagtcttttctcctcttctccccatttggtttatattagctattaatgcaagtctgcattgtgtctctattttggcttgtaataaagtcctgtgtattctgtggagttggtgggcgtcctagttacagacttggctgaacctgaagacccctgcacgtgtatatggtaatgttgtaaaaatacggccctggagataaacagttgagcacccagtttgtattgaacgaataaatttcttaagtttttgagagctttctcttagaagttgaccttttgggggcaaattactgtgactattcaacatgtaagaaagaatagcttgccgggcgcggtggctcacgcctgtaatcgcaatactttgggaggctgaggcaggtggatcacctgaggtcaggagtttgggaccagcctggctaacacggtgaaaccccgtttctactaaaaatacaaaaaattagctgggcgtggtgacgtgcacctgtaatcccagctactcgggaggctgaggcaagagaatcgcttgaacctgggaggcggaggttgcagtgagccgagatcatgccgctgcactccagcttggacaacaagaatgaaactctgtctcaaaaaacaacaacaataacaacaacaacatagctctggtcgccatcctgtggcctgtggttgaccttttgatgagtccttcccgtgacagcatccgtcataattttttcactaagcttagctcttcagctgtgaaatccttttagccacagcattgtagtctcttctcagaaggttaagctttctgatacttttttagtctgtcacttttctggtctctgttgggtccaagaaagaacccctggtgagtctaaaggctttgcttattttgttctttaagcttaggttcccatatttctcattttcttgacttttttttttttttttttttgagacagggtcttactccattgcccacgctggagtgcagtggtgtgatcatggctcactgcaccctctagtcctggggctcaggtgattctccaacctcagcctcccgagtagctggaactacaggtgcacaccgccaagtgtggctaattttttttgtgtgtatgtagaaacagggtttctccatgttgcccaggctggttttaaactcctgggctcagctgatcctcctgacacccaaagtgcggggattacagttgtgagccattgtgcccatacattcaagccttttaaaactgtattattgggtttcagggggtctttgaacccaaggtctggctctgttgcccaggctggagtgcaatggggcaatcatgggcacattgcaaccttcgccttctgggctcaagccatcatcctacctcagcctgagtagctgggactacaggcgtgtgcaccaccatgcccggctaattttttgtagagacggggttttgccacgttgcccaggctagtcttgaattattgagctcgagcaattctccaccttggcctcccaaagtgctgggattacaggcatgaaccggtagcccggctggtctttgaactcttttttttttttgagactgagtcttgccctgtcacccaggctggagtgcagtggcacaatctcggctcactgcaagctccgcgtcccgggttcacgccattctcctgcctcagcctccagagtagctgggactacaggcatgcgccaccacgcccggctaattttttttttttttttttttggtagagacggggtttcaccgtgttagccaggatggtctcgatctcctgacctcgtgatccgcccgcctctgcctcccaaagtgctgggattacagacgcgagccaccgcgcccggctaactttttgtatttttagtagagacggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgtgacctaaaaagtattaagaaccactgctttgagtttaaaacgatggcccttttccaacaactaccatttcttgttatattttcttcatctctctatatacctatttacatttttctattgatttctgagtaaataggaagcagactttatattatttgagacccttctaaaaataacttactgaggtataatttacatgccataaaactcaccatctttttttttgtgatggcatctcactctgtcacccaggctggagtgcagtggcttgatttcggctcactgcaacctctgcctcccaggttcaagggattctcctgcctgagcctcccgagtagctgggattacaggcgcccgccaccatgccaggctaattttttgtatttttagtagagatggggtttcaccatgttggccaggctggtctcgaactcctgaccttgtgatccacccgccttggcctcccaaagtgctgggattacaggcgtgagccagtgcgcccggccaaaactcactatcttaaggtgatgtttaatatattcacagagttgggtaaacatcaccactatcaaattttaaaacattctcataccatctccaaaaaactcatacccattactggttactgggtttcttcccccagcctctggtaaccactagcctactttctatctgtataggtttgcctattccagacatttcatgtaaatggaatcatacactgtgggattatttgtgtctgacttcttccacttagcatgtttttgaggttcatccgtgttgtagcatgtttcaggacatcaggacttctttttattacttatcagtattttattgtatgaatatacaacatttcgtttactcatcagttaatggaaaacattttatgttcaaatttttgtgtaaatatatgtattctcttgtgtatttacttcaaagcggacttggtggttcatgtggtgggtctgtgtttaacattttgggggactgctaaggtttttcaaaagcgggtgcaccgttttacatttccagcagtgtgacatacatttacacaaaaatttgttcatctgggccagctgattggacgatgtccccccacattaaaggcagatcttctctactctgttcatggattcacatgccagtgtctttcggaaacactcacagacacaccccagaaataatccttgagcagtttgctaggtaacctttaacccagtcaaggtgacatctaaaattaaccatcacaccatcctagtgagcacgaagtggtattatttgtggttctgatttgcagtttgctgacggctaatgacgttgtgcatcttctcatgcactttgtgccatttttgtctgtcttctttagagaaaatggttattcaagtcctttgcccatttgtaagttttttttgtttgtttttttaagtttgaattgtaaaacacatttctataagcattttttttttttgagatggagttttgcgcttgttgcccaggctggagtgcagtggcgcaatcttggctcaccataacctccacctcccgggttcaagtgattctcctgcctcagactcctgagtagctgggattacgggtgcctgccaccacgcccagctaattttttgtattttcttttttttttttagtagagatggggtttcatcttgttggccaggctggtctcgaactcccgacctcaggtgatccacccgccttggcctcccaaaatgttgggattacaggcgtgatccaccgcgcccagcctctatagacatttaatgttcttaggttatcgctaggtcttgtgaatgagtgaaataaaggaagggaaaccctttagcttggcagtggcaaaggtgaggtgaaaggcagtggaaaggtgttttaataactgggggaatggccttctaataccttttaagtattgtattgtccatttggagagactaaggctaaagatgacctgcagggagagaacagacaatgcatagatttggaagtgagaaaaagaaaagaagagaaaaagttcaccttctagtactccccccaaaattcaattagtaggggaaaagaaatataggaagtgggcatatttaacttggaagtggaaagtacctaaaagctctcaaggaaataaattattcctacagagtatggtgaccatgtattttgtatttctcttaagattaaacgaggaaacaaatttaaaatgtagtccttttggtaagtgagattttagcattggcatggtgctctctcagctttgaataggggatagaatctcttttctcctcatgtgtatgattctctttgaaggtaatgaatgagtcaacaatacctcttgaaattttttcccagtcttgagattctattaaatcattttgttttgttttttgagatggtgtaagttttgattcatggatcagaacatcaggatcatttgaatagttctcagaaaaatcatagcgccttcatctaatatttatacagttgagatatagattgggtccctttttatatctagatctagttcttgctttgtttccccttcattgtcattttcagccctttatttgtttctgaacttgtatataagtttattttacacaatcttaatatatacagcaaatgtgtatgaggcacacacaagccttaaatacatgtctgtgcatgctatgttagatattcttgttaatgatggcaactgccataaactccctgctcctagttagaaaaagggccatgatgcctgaaaggaatttggaacaaagcagtacccctttcttcaaatcttgatgccttaatttcttgagtgaaatttaggtatgcatcctctctgtggacacaaaaggaacttccttcttggctgtcttggccttccttcctctcttcttgggacttgtcataaccctgtattaaaaacaataacaacaacaacaagttaatcttttttttttttttttttttttttgagatggagtctcgctctgtcaccccagctggagtgcagtggcgctatctcacttcactgcaagctccacctcccgggttcatgccattctcttgcctcagcctcttgagtagctgggactacgggtgcccgccaccacgcccggcaaattttttgtattttttttagtagagacggggtttcaccatgttagccaggatggtctgaatctcttgaccttgtgatccacccacctcagcctcccaaagtgctgggattacaggcgtgagccaccgcgcccggccaacacttaatcttaaaacctgtatatttgtaggagtatgtgcttgtcgttctgatagtggcccttccctcattgtaaattttaaaaaacatgtctttattctcttactcttaaaaccagtattgtttccgtggtggaataaaccttgagaattgtgggtgaggctagtggttgacgcagttacagatgataccaggtgctgcccacagactttgcaaactcactttccacagatagggctcccagacctgggcctgacagctttagagtctttgtccttctctgacacaggctggaccctccccacagagattttcctaggttctgcatctattttgattactgtcacatagtttttgatacttgagaggtatcaagaccttgtgaggtaaaatttcagaaagcatgttaggtttctggtgatccagatgtacaaattctgtacaatgaagatcaccaaatgaggaaaatgaaaatatatggatgatggtgtgactatagttgtgggccagttagatagcttctgtcatgctgtttgtgtcttggttgccatagagacattttagctaacaagcccagcatggctctttgtagtcatttctttcagttcagatttgattttcttttcaggtaagattttgagacacgtgcatgtgtgtgtatgtatgtatgtatgtgtacgtatgtgtgtgtgcatatatagtgtatgtacacacacatatatatttacgctcatatcccaagttaccagagccttcagggcttttgaactgctggaaaatagctgcgtccggtgtttaaaagccagaagcccctgtctctggccaaaaagaggtgccacatgtgattggcagagctgtgtcacctgcctggctgggaactcgagttcccgcccctacactggggatgctggagttgacacagtatggcatgctttgctgcacccttttatccctgtggttagtggtagatttggtggagcagttagccctagggacacaattgagagctgggtgacaggtcttcttacctggttccgagtagcttgtgtatatcctttgagaacagcacaacatagttaggttagcagcagctggcagtgaggctgcagtttccaagtacagagctgaacaagaagccagaatttagagggagctgcttccaggataaggtagaagagccacaagtcaggggctttgtgccagtgggaagtgacctggggccaaatcatgactctcagccactgccttacctgacattccctgctgaaaaggggaaaaggcctagaccatcacagtctgtctttggagcttaagaacttgacctctttgcttgacacactcccatgtgagtgcttaaagttagtagtcatttatattcttttccaggaaactgctaggttgactcctcgtcaataggcttttttttttttaatctattgagacagagtcttgccctatcatccagtctggagtgcagtggtgaaatcatagctgactacaacccccacctcctgagctcaagtgatccttccccactcagcctcctgagtagctgggtctataggctcgtgccactatgcccagctattttaaaatgttttgtagagatggggtctcgccatgttgctcaggttggtctggaacttctgacctcaagcagtcctcccgccttggcctcttgaagtgctgagattacaggcatgaccgctgtgcccaggtaacaggtgtctgagaatgtctatcagccagactccacggctcccttttccccttctgacacggcatggtagacaagtgtgaggtctcagaagaggctgcctcagccatggtcccacttccagttacatgtgtgtcctcagacttgctcagaagaggctgcctcagccatggtcccacttccagttacatgtgtgtcctcagacttgccacttgaacctctctgggtgtagaaacaagggatgaaattacctccaaggacttctctgtggtcacattctgtgaaaggctattggatttaattctctgtggttcaccttccctgactttggtaaaaatgatggttgaaagaatggatgaatttttatttgtagaatcaccttcttttaatgtcaaagaagctttattccaaaggaataaaaaaattgagtggtctcgttcccaggatatacatacactctgctgaacaggttttgaaccgtgtaataccttagaggtatgtctcacccccctggagggtgcagtaagggttctgaaggaggcgatggtagaggagacaaagaaatgccagcaagtggctaagcatttggtgggcacatgtatggccagcaaccctgtttgcaccttttctttccctgctatttatgttgaaaagcaagctaaatgtaaagctgcactttttgatgtagcactagatgtcaattctagcattaatattttgaatccatagggaatctgcacatctcatttcagtcactaatttgaacagaactcctcctcccattccaaaaaaagaagctaaatatggaattgtatatattgaatttaagatgtaaagtttctctgtgtctctgttcactttcccagtagcagtctttaaaaagcacgatacaattaaacagcagaatcaaaggaaagggagtataaagggctccagataattcccagtttgggttatcagctcccacacaatggagagttgattatttttcctttattttagggaaggtaaaagtccatggaggtgagaaaagtacacctggaagagatctgaaatattcctgattctggataagtgtgcctgtacaatgacccatggttggctttggaatataccattaaagtactggaggtcagaaaagcttccttcacaaatttggttaggtggagcaggttgctaaaacatccagcaaccctggaggtcatagaccacgctaggagaaataattatgcatggtaatgggcaattacagataatggccttccgggggtggcagaaaatacacagccccacagccttgcctggaatgaacattgaatagcacattaactttatagcaagctaaaagttcagccctggaactgcagctgctgcccccccccccacccaataaaaatgtctgcctgtcttaaggtaatcacaggagtggctgcacttctcaaaagcagagtcgaataaaggaggagatgggactgtgggagacagactttggaaaagggaaggaatggtgcactctactccactgggttgcatttgcctcactaagtagaggtggtggcttgcaggaggtgcacagtaagcagttgttgctttcctggcgccaggtttgtgtttgacgtttaaaatagccctgtcatgattgccttgtgggagaaacacattgttcccgcatttcctgattatgactttagggagtaatatcacaccaaacgcactcaaggctactgtctgacctcagagaaggccaggagtggaagattccaagttcagctgagcttgggaagcctggccaggtgcagcccagccctcctgcagtaccctaatgatgaggatttggagcaaggataactttgtgcggagttatttggtggctctcttgcttgatggcagaaaacgttatggccgtgttgtgattgtgataacaataatagctaacatttattgagcactcaacacgtggcagagcctttctaagtacatgtcttctctcatataattctcaagtagtagtagtatttctttgctacgtgcaaaggctgggacatgcaaaacgtatataacttgccccatgattgcatggcattagatttcagatccgatcaattacttttgcttgggaccagtgctctcaacctgaagttgtgctgcctggccatattgtgtcattcttaatgcctgtttcatggaaagaaatatttcagacataaggataaagccagagctgcctggttaggactttattgctgtctactaataacacaaccctgagagccagctcagaataagatgccaggctctaattctctcaaatcagtccccctaaaaagacaggggctgttaagatggaagttctcaaactttttacttgcagaatctctctacaaccttaaaaagtattgaggacctcaagagcttttatttatgtgggttatatctatcgataccatactggaaactaaaattgagaaatgaaaaaaaaattatgcttttaaaataataaactcattacctcttagcatacgtaacatacttcaataaaaattactacattttgcaaattaaaaaaaaacaagagagtggcattgtttcacatttttgcaaatctcttttacgtttggcttaataggatgtaggtgggtttgcatagctgctgcttcaggtaggctgttgttctaatggaaatacaggaagaaaattcagcttcacgtagatagttagaagaggggtagaagtattttaatagccttttacatcattgtcactattctttgatactagaccaaaacttgacaagtggtaattgcttaaagattagttgtgatgtggaaaccaaaaccatgctaacgaacattttgtactctgtttcattaaaatctattcatctgtctcagacttggcttccaagatcagactagatctgctggtgcgttcaaggtggtatggccatagactctcttatactttggatggctctttcatccgtgtatgactttataacattatgcattggtcatttgggaaatactacttcagtaagttatgtacaacttccaaatgttgacacattttattacaaaataccagaaaatcacattcattaatactactgctgatcttgttagaataatcttcaagtttggaagctgtcatccacatagtggggggccataaattttctaaaattctaatttttacttgaaaactcaaatttcggcaataaatactgtcagttgttttccttgaagtgacaggctcacttagttcattttcaagagaatgccgccaaatatctgagtttcagtaattgtagtttgtcatcagtcactcttccaggatatggtgttcctttaagaaaaagcagtgagtgtagctcttcaacagttgcacaaatgtcctttttcctttggtgtgcagaaaggctgtgtgagtccttcccattgagtcacacagtttttaaaaagacgtgtactctgaggtacagatttgatcaagttactctttctttctgcttcatcaagggtgtctttagcaaaatcaacataacatttttttaaagttttaacattttccttcatagcgatgaggaatatgcgagcattagtatacttgggtagcttgggctgggcgtggtggcttacacctgtaatcccagcactttgggaggctgaggtgggcggatcacctgaggtcaggagttcgagaccagcctggccaatatggtgaatccctgtctctactaaaaatacaaaattgcctgggcatggtggcgcatgcctgtaatcccagccattcaggaggctgaggcaggagaattgcttgaacctgggaggcagaggttgcagtgagctgagattgtgtcattgcactccaacctgggcaaccagcaaaactcagtctcaaaaaaaaaaaaaaaaaaagaaaagaaaaggaaaaaaagtatacttgggtagcttgccatgtgctaaggaccagcggtcttccccacccttgccgctgcatcatcagtgcccgtcaccacagcaaaaaaggcaaattacatctttatgttattgcaaaaatacttctgacctcttgggccctcagaaggaagttgtaggcgaggacctccaaccacattttgacagctgctgcgataagatgtaagggtgtgatttcttgacatcaaagcaccaagcttgaatgggtttaaagcagttctcaacttgctctgcctgggtcccattgcgggaggctgtcacgcaaagtggtctggggtgtggcctgatcatggggaattctatagaccccccccacctcctcctcctgtgcagccaggtttgaaaacttctggtttagaggcaggttctaaaacattcttggtagggagggggctctccagtcctgtacaattggataagtcactgttcatgacagccaggaaaatttacaagacaaatgcctgattgaaaattggcgataataaattgaactaggtataatcttgagttgaacggaagctatgtgaaacaatatggtgaggtataattcggtttcttaattgtatacatttatgtagaggtccacttactccttcacatcactttctggggcctgcagggacaaagacaaaacatctatgatcttactagtaaaagaaagtcataaaagcaggatctgaatcctatatctacatggagctgaccatgagcaaacttaaacatgtatctttgctaccttctgtccagctccctacatgctctagagagaaagaccctgataaattaggcttctccattttaagttgtttgattacagttgagagcagatcttttctgtggagacctaaatacatgtacacagtcagtcaaacaagttcctaatttaaaacatcctcagtgtacgaaatatttaaaaggttcaagaagggattctctgtaagacggcttttagaatgtagccttgatggataggaactgtgttgggaatcatccctttcttcttctccacccccaaactcaagctttcccattggcctgtttgtggcacaacctgctcctccaatccgctgggaggtgttgatagagtcccaaactgtctctggtatcttgccaatggtaggacattctgaattggcctaaagagagaaatctctgtcttggccgtgagacaggctttcatggccatgagacattgccttggagggtcagagaaatggcatttcctccaaatctgactctcattgtaggattaacagttttcctcggtgacttgggggaattctgaggcacaggcagaggtgtggaagaaggaggaagctgcagagagcaggaatcagggcagggagaggcagaaacccctgcaggtggaagtgggatcctcctaactttagcatgccactgtgcgttacatgccagccttttcaggcccaattaagtttctctgggggtgtgaagggggatcccaaattgcataccactgtgccaggagcacccccattctcctcctgcagtggaccctgtgctctacctgctctgcaggctcttctcttaaccttacttgtgcctcgaagctcttgttgtgtgtctcctctctttccttgacttggaagtcctttcttatcctttatacatccagaatgttctcttgcttaaaggtgtcttctgggaaaccttttccagtcctttacattctcctttgcactgttaatcacctgagctcctccaggccagggttttgcattcttctcagccaacactttgggagttgctgcacacaatggatgggctttgacactctgggcttttcagtagccccagggcagcctgtttcaaatcaagacctgctcaccttgaaggcctgtgtttgctcagcctcatgtttgtattttcccgtcatcttcctgcttgatttctttgatctggttgtgctcagtggcgcccccgtctcccctgaatctttttttttttttttttttgtctgtctgagacagtctcactcactctgttgcccaggctggagtacagtggcatgatctcggctcactgccacctctgcctctcaggttcaagtgattcttctgcctcagcctccccagtagctgggattacaggtgcctgccaccatgcccggctaatttttgtatttttagtagagacggggtttcaccatgttggccaggctggtttcgaactcctggcctccagtgatcctcccgcctcggcctctcaaagtgctgggattacaggcatgagccaccaagcctgcccaccccacccttttcactctttcactctttccagattccatacgcatagcctgccatctgtcccacattgacgctgcactcccctttgaaccaagcccgctcctatctttaaaagccaacttcaggttcactttgctatgaaaagagttcacaccaagaaaaaaaaaaggagctgacattccttcacaaccaaattacgttaaaaagataagacaaaaatctcttcctgggagaaaggagaaataggctctaccacattccgtgtcttgtgctacaggagcgacactagtgagccaacatcaggggaacctgtactttgaaggttgagatgaatcctctcccctcagtgaggagcatcccagtgccatgaaatcagtcatcatcgaatgacacagccttttaaaaaaatgcattaactcccccgacccccaaaaggagagcccgggtgcagcgactcacacctgtaattccagcactttgggaggctgaggtgggaggatcactggagaccagaatttgagaccagcctgggcaacatagcctgaccctgtctctacaaaaaaaaaaaaaaaattgccgtgtatggtggcgtgcccctgtagtcccagatacttgggaggcagagacaggaggatcacttgagcctagcagttggaggctgccgtgagccatgatcacaccactgcacttcagcctgggcggagcaagacctgtttcttaaaaaaaaaaaaaaaaatggggaaaacaacttacgcttttgctataccctcgtagcgctcaacacaaagtattagttggtgatggatagttttcagacttactggtgaataattttgcctgactggtatgtaactcttaaaactcagaagctaagtaggacaaacaccatgcaagatatggggttacaaagagaaaatctggagtatataaattaatcgtttacatgacctcatgtgaatcacaagtagtttactgtttgtaaatggtaaatttggttttgtgacctttttttacttcatgctggaaactgtgatgtttggttttttcatggaggtgagtgtggatccagatttgaacacaaaggactcaaagtgcaacaactttgggaatcatgacaccagcaaagaggggggcaagccttcacccaccttaaaatgaattactggttaactactattaatatgtcatgggcccagagaccagcatataacactccacgatcagtaagggtatttatcatgtgcaggtattgatccctcatgaaggagtgaatcatatttcacactgcatgttagtgcaaaaaaaaaaaaaaagtagcagagggattgtgaagccctatcaaagaactggatgtgcagaaggtaaacgggtgtagccatgaacatgagtattagaataagaggtgactgagctcataagcaacatctctgcagatgcatctgaggggagacagtgagctctgttatggtctgtgggacaaatgctattggtaatttttccagatgtgtatttcttgagttcctgttgcttttctgagtggttggatccagtccttctgatcttttgttcttattgcacaaattaggagtatataccaatggtaacacttaaaacatctggccaggtgcggtggctcacgcctgtaatcccagcactttgggaggccgaggcaggcagatatttgaggtcaggagttcgagaccagcctggccaacatggtgaaaccccgtctctactaaaaatagaaaaattagccaggcacggtggtgcgcacctgtaatctcagctactcgggaggctgaggcaggagaatcacttgaacccaagaagtggaggttgcagtcagccaagatcacaccactacactccagcctgggcaacagagtgagtgagactcggtctcaaacaaaaacaaaaacatctaacttcatatttccatttgcatcataacagcagatctgaaatgggaaaggtcctcttgtccccgttttagagcgtgtgaaggaggcatggcttgcttcttcagtgccccactgctcaagcctctaggggagcatacagatgggcaggccgtggggctccgaccccatggcagtgtctaggggtgaatgtttacagctgaagccccagtgggtgtgtgttacagggtgccttttagtttagctgtctgtaggtggcttgcgttagtcggctcaattagatcctctgccttattgcaaggatagagggctttctgtatcccctggttcttgccttggtgtaccaaaagaatgagatcacatgtgggcttggagaatgagtgtaaggttttactgagtggaagtagctctcagcagataggggagtcagaaaggagatggttttcccctggagtcaggctgtcgagcggcccgactcttctcctacttccccaaccaaacgcagcgttgttctgctggtcaaatggcctaggcccatcaatgacctgccagtgcctatcagtctgctctcgacgttgagctgcttgccttcttccaccaatctactcgtctcaatgcccagccgcttgtgtgtctgctcgctagggtttcaggggttttgtagacacaggatggaggcatggtggtccagggtggtcttgggaaatgcaacatttaggtgggaaggcagaagtgcctgtcttcagctagtccatgggcacaggcttctgcagtggagccttcgcaagggaccacgcccacctctacccagcacttccctgcccacttctgtatcagatctacaggttgataattctgtaatggactgtaagggactactggttaagaaagccagcacattctcttggaaagagtgctgctagctttctgttattattcattataacaacacagcacattctcttgaaaacaatgctgctagctttctgttattattcattaagcaattttggccaattatcattctagaaaaatagagagtgagatctagcttaagaattttcagcagactcattaaaatgtttcccttcaatatacttctgtggttgctgtacttagttgtattggccatgcagttttaaaagtccgtgttacagtgcacacaagccatggagactggcaggagtaattcatactcagatcaagggacttgataaacattggtgcattcagctcaggttcatggagccaactgtgtttttttgtttgtttgttttttatttttgagcggagtctcgctctgtcacccaggctgcagtgcaatggtgcgatctcggctcactgcaacctccgcctcctgggttcaagcgattctcctgcctcagccttctgagtagctgggactacaggcacgggccagatacacgcccggctagtttttctgttttttgagatggggttttgccatgttggccaggttggtcccaaactcctgacctcaagtgatccacccgccgcagcctcccaaagtgttgggattacacgcgtgagccaccgtgtacggccaaactgtcacttcttactgtgacttttttttttcctgtggctcagagtgggaatggatatggttgggggagcttattaattgtatgtggaaaaccactttttgaaaactttatgtatatataaatatatacatattttaaattttgtatgataaatttgtgtgttttgtggcgtatcagttggaaatattacttttaggtttatcatcaattaatagggacacttaggctggcctgccatctttgctgacaccccagtgttgaagcaaatattgctggcttctctctggggagtttgctgtagcatgggctggacagatggtaggtatactctgcttatgcttatcctctgtcagtctgggcaaggaatcggatattccttctgaagctgcttattctatgatcactcagcagttgaacaagcatcaaaagggaatctggattgctttcctggtctctggatggcagatattaacaatgtaatttattagctgggcgtggtggcgggagcctataatctcagctactccagaggctgaggcaggagaatcacttgaacctgggaggcggaggttgcagtgagccgagatcaggagatcacgccactgcactccagcctgggaaacaatgtgagactgtctctcaaacaaacaaacaatgtaacttagttgtttggagggaattcatagaaaaggagatctgccagtgattttcatgaagttccttcctttactacggcctccttgtgcaagcttaaagtgacttcttgcctggagtatttaaagcacctagtctattcccccatctccttattctcttaggtctgttttttgtgctttgaccagattcccaaatatatttctgctactcccttgctctgaaaaccttcattggttccctagaggagaacttgttggcctggcattcacattcagggtcttcagcaattaactccagcataaccttccattctcatttgcagttgtcacttgtgaactctgcagtccagccaggctcatctggtcactgtggctggagcgcgtcttgtcctttctctcctttgggcctctgttgacctccctcatgactctattggtattattctcctttttttgagtgtttacccactgtctctaaatcacctccactctggctcatcactcaccgtggccttttctgacacctctctatatagaaccatttggtgacattatctatactgtcactgcggcacttggattattgctttgtagatttcccagtttgcacctaatttccccaaatagatggcaaattcttaagaaaaaatgtaatgtttaaagtatgtttttgtgcctttgacaacatttaaagaaagctttgaacatagttgttatatgataactagtgaatgaatcaaatctaaatataaaaatacaacttaaggtcaagaataaatgatttttgtaacacctgctcctctggattacccagaagtcttctgaagaatattaaattttgactctgcaatgttttgtatctaactgaatgcctgacaaatagtaggtgcttaataaatatttgtcaactggaataagcatttgaatagatgaattaagttactgtggttagaataaatgaagaaagtctggatgtaagccatgaaactcacaaccatttggcagcgatacacacacagtacatacagcttgggatctaagctctgagtgatttaggtagaagcctagcttttcaatacaatggaattctttttttttttttttccttttgagacagagtcttgcccctttgcccaggctggagtgcagtggtgcgatctcggctcactgcaccctctgcctcccaggctaaagtgattctccttcctcagcctcccttagtggctgggactacaggcatgcaccaccatgcccagccaatttttatatgttttgtagaggggttttgtttgcccaggttggtctcgaactcctgggctcaagtgaaccttgtacctcggcctcccaaagtgctgggattatagccaggagccactgtgcctgacctcatttgttgtatacttttatttaatagtcaggactgtcacagcgatgcagtcaggggcatgaaggtatctcatatttttaggaatagcgtgtggagcagttgttaatagtcaggactgtcacagcgatgcagtcaggggcatgaaggtatctcatatttttaggaatagcgtgtggagcagttgctttgaattttgagagtacagccgtgtgtctcaacagttttagcacatcagaatctcctgggctggatgcagtggctcacacctataatcccagcactttgggagggtaaggcaggaggatatcttgagcccaggagtttgagaccagcctaggcaacatggtgagaccccatctgtattaaaaaaaaaaaaaaagaatttctggagagcttagtaaaattcagattgctgggcgccattctcggggtgtatgattttgtcagtctgtggtggggcccaagaatttgcatttctttacgttcccaggtaatgctgatgctactgattcagggaccacactgtgcgaaccattggattagacacatgtagcttgacagatattaatttcaacctttccatgtactagcagtgttcatataaatgccaggagttatgaagctgtttttaacactgactgagaattttaattgggaattttaacatatagaattcggtggtttatacacatagtactttgtcaaatctaacttttttaaagtggttaaacattttaacagcgtaaaggcagacatctgctcttccaaagttcaaatggttttattatttaaatattggtatggaacaacttttccaatacatatctcctatttattcttaaagcttggtataacttgaaagaggaaataaaatacgggtaagtggaaaagtgatggtgttgttaactaattacagtcagctgtaacaaaacaaattattgctttgacctgacgtagcattttagttgaggtttactatgcagtttattgaagccattctcttgttaccttcagagttattactgccattattttgttgcttgataaactgaggcctgataaaaggttcagattaaggtcatgctgcagaaattcaagaacttgtgctgtgccctgattctggaatgctggaatccttgggtttctatttattcgtctgctactgtattttgttttcttttttaagaagcttgcttttgaaaggcaggccttaagtgggaggtattcagtgtttttaatgcagggacaggcctaagtgtctaaaatgccttcctaaatgtctgtgagattgtataggaatgaaccattaatgtttatgactgcatggtaggataggtcatttattctttttctgacttagatgctcatataatttattaaatttgagaagctcataaggcttttgtaatcagataaacaatagagacatgaccttgaaaacaaaagaatgatatagaaaaccaccacttaacgccaccaaacgtgttttttttttttttttttttttgagccggagtcttgctctgtcacccaggctggagtgcagtggcgtgatcttggctcaggccgactgagctgagatctcaggccgcccgcctcagcctcccaaagtgctgggattacaggcgtgagccaccgcacccggcccaaactgatgtttaaaataagagaaaggcccagtggggaagttgaggaggagcgaatggacatgtgccctctccagacttgggggtgtggaataatggcattggaatgtctcatctcattagctgggaagaggagagaagaaaggaaaggaatagaataaaacagtggtttgggagtgcatttacaggagcctagcataggtggatttggtttcctttcagagaaaagtgacaccaatgctgactttaaaatgaggcttcaaaaataaattttgttgtagatctcagccagaccttccagagcttgcactttagttttgccctctcccttgcatgtttttgttttcccacacactcagccagtggatggtttctgggcaccttctttgggccatgcattgtgctggaaatttctctcatgagccaattctgtctgcttaaggacacttaaacctctatttatttctttatttttatttttttatttgagacagagtctcattctgtcacccaggctggagtgcagtgacgcgatctctgctcactgcaacctcggcctcccaggttcaagcaattctcctgcctcatcctctgcagtagctgggtctacaggtacgcaccaccatgccgatgtccggctaatttttttttgtattttttttttagtggagacggggtttcaccatgttggtcaggctggtctcgaactcctgacctcaaatgatcagacctacctcagcctcccaaagtactgggattacaggcgtgagccaccgcgctcagccttaaacctttttagaaaagtgaaacaaggccaggtgtagtggctcatgcctgtaatcgtagcactttgggaggacaaggtggtttgattgctggagctcaggagtttgagaccagcctgggcaacatagtgagaccccatctctatacaaaaaaattaaaaaaaaaaaaagctaagagcttattaaaattcagattgcttgagctcaggagttcgagatcagcctggccaacatggtgaaaccccgtctctacttaaaaaaaatacaaaaatcagccaggcatggtggcttgcgcctgtattcccaattacttgggctgctgaggtgggaggatcgcttgagcccagaaggaggaagttgcagtgagccgagatcgtaccactgcactccagcctgggcgacagagtgagaccctgtctcaaataagtaaataaacaaaataaaagtgaaacgacaagatcttatgactccctggaggttttacttttttttttttttctcccagacggagtcttgctctgtcgcccaggctggagtgcagtggcccaatatcgtctcactccaacctctgtctcccaggttcaagcgattctcctgcctcagcctcccaagtagctgggactgcaagcatacgccaccacgcctggctaatttttttttttttttggtatttttagtagagacagggtttcaccgtgttagccaggatagtcttgatctcctgacctcgtgaatcacctgcctcggcctcccaaagtgctgggattacaggcgtgggccaccgtgcctggctggagcttttacttttaactcacattatttttgatgccaagctacttgaaaaatgattattcctcagtcccttcagcaaatattgacccactgtgtctggcagtgtgctaagcacggaggacacagtggtgtgcccggaggctgggtgccttcttgctggatctcacgtcctggtagtcctggtaggagagaggccattcactggagtcatctctttggatttcttgttgcttgttgctccttgctctcttgcaggcctgcatctgctcctttcatcatggttaaaaccgcaaggccctgaagacctagttgtctgttggtcttttctagaactgtttgcttgatgtcccagcagcagttgacaccacagcctgcttgctctgtgattcaagtcagctttaacctctgtgacgttgtattctctgtttttcacgctccaggtcttggctctcctttattctgtaacagctcctcccttccttgcccagatggagctagcacctccagtggtgactcttggatctggcttccagtctcagcctctcccaaaagcacgcgtttcatgttcctcaccctcacccagccctccacctgcacacctgcccaccctctgctctacacacccaggctcctgctctctgcctcccctgcatcttaattcctggcagcccctcagccctccagttctgttgcgtttcatcccccacatgtccctggaacaggctcctctcttacatttgcaggccttagagttctggtctgtccttgaactcactttggtggttccctagcaggtctttctgcctctgatctctctctccttcacttgccctaagcagttgcccttagataaatctcctccaagcacagctctgaccgtgtaacctccttgctcagaactcagtggttcccattacatcccagagtcaggagagctggactgaggcccgcctcaccttaccctagcccatctttcatactacatgtctccttcccttttctcatccagttcctcagcctcacttccctgcccatcattccaaactctacccccactttcctgcttccactcctttgtccttgctgctcctttctccttcctctccttttctcatttttcacctgtgtcctgcatctttttttaagtgcaactcaggtgcagttttgtccatgaatttctaactaggctacaagccatctctgtttcctctgacttcccatggaagtttatgggtcttcctgtatgatggtaggtggtaggtggtattcccttcccatcttctatcctagaccgtagactccctgtgggcacggcagctggcagacgtttcaggcacccggactggctcttagaacattgtttaataaatgtccattggatggatgacttaggaattcatttattggaattgacaataaacactttaatgtctgtgccagaggttgggaaactagtctttgggttagatcagcccactgcctgtttttataaataaagttttattgcaacacaagcatgctgcagcagtgattgaatagttgacaaaacctgaaatagttactgacctcttacactagaagtttgcccctggtccgcacctttggccagatttctgaagatacgtgatcacctgtggaaggaagttaaggaaacaggtgttcacctaaattcacctaaactcttggccactcgttttgactttctaacctatctatgtggctacaattaattttgttttaagaatgcacaatcaggtcaactagatttgctcttcagtttcttgacattaggataggaatttctggatagaagttgtgctgttgggctttatgtaattaaaatcacctctaaaatggttttgatactctcagtaaaaacaatcagctgagtctttcggttgtgccaccagagtgaagcgaaccttagaaactctcccttattttggctataggagaagcaacagatggttttgtcttctgcatattcagctaccttgctccgcaggtcttgggtaggaaggtttagaagtaaagtttcgtggactaacattaataccatgttgtatttttcttttttcttccaatttagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcaggtatgatattaattacccagagagtgaactggttgtgtgaaagccacatgcatgtgcacacacatgcacatacacacagaggcacacacgcacttgtgcgcccagaggcacacacaggtgacacacacaggtacacacacatatgtgtgtgtgccattttgcacacatgtaggcacaatatgcaaaatgtgtaaggaattttttactctgtcaataatgccctttagcctcaaaggttggctgcaaggaattggaaagaaataatgtacaaacttgttttctttttcaaattttacttttctcattttttgaatgttgcataaataaccagttgggcacaggcagatcacaagtactgaatgaggtaccacctcctccagctttgtccccactttcgttgggcaccttagaaaatgctgggtaaagccttctgggtggcagtaatctgcgtgatgaatttgcaccttgggaaggaaacaggtcataatctgtatggaagaaaggtaagaaaaggaattcggtcactgttgagctggacccaacctgggtgcatttttcgctaggaatagaggtcagtctttcattctccaagtttgtttttttttttgtttgtttgtttgttttggtttggtttttgagacagagtctcgctctgttgcccaggctggagtgcagtggtaggatctcagctcactgcaacttctgcctcctgggttcaagtgcttcttttcacctcagcctgtgaagtagctgggattacaggcgcctaccaccccacccggctaatttttgtatttttagtagagatggggtttcaccatgttgaccaggctggtcttgaactcctgacctcaggtgatccgcccgcctcggcctcccaaagtgctgggataacaggcatgagccaccgtgtccggccccaagtatgtatttttaaaatagcatgcaatcaagggcatttgatatttggagtaaaacaaagcattttactttattagagaagggagcgtttatctagggctgttctgcttcctcagttgcaaccattttcatcatgcccgtttgttagcagcagattgaaggcatcaaaagcattcagaggctagattaccttgtacagaggtatgttgtgggaatatgtaggtgaaaagttagactcaacacctccaagccctcttccaagtgaaagacattaggattctgcaagaactgttctcattctggatgcatttgccatgctcaggcttcctcagtggggatttgattcaacgcaatgccacatatatatttgggagttcagtgcaagtgtttgaccctctttttcactttcccagctttattgacgtatcatgggtaaaaaaagttgtatatatttaagatgtacaatgtgatgatttgatatatgtgtaccttgcacaatgattgccacaattaagctaattaacaaacacattaatcacctcacatagttaccatttttatgtgtgtggttgataacacttaagatctactctattagcatttttcaggtgtacagtatattattaagtacagtcaccatgctgtatgttagattcccagaatttactcatcttataactgaaacttttttttttttttttttttttgagagggagtcttgctctgtcacccagctggagtacagtggcgcgatctcggctcactgcaacctctgcctcccgggttcaagccattctcctgcctcagcctcccgagtagctgggactacaggcacgcgccaccaagcccagctaatttttgtatttttagtagagacggggtttcaccatggtggccacgatggtctgtatctcttgcccttgtgattggcccacctcagcctcccaaagtgctgggattacaggcatgagccaccactcccagccgtaattgaaactttttaccctttgcccaacatctttttttttttccagctcaatgaattttatttcccttgttgtatataaatgctttgattgaccagtagatatttgtcaaccattagtatcttggttctgttgaaggagtaagaacattttaaactgagattttttttttcttgtcttttcttttttttttttttttttcctgagacagagtctcactctgtcgcccaggctggtgcgatcttggctcactgcaacctccacctcctgggttcaagtgattctcctgcctcagcctcctgagtagctgggattataggcacgcaccaccactcctcgctaatccaacatccctttatttcctccacctcgagctcccggcaaccactgttctctgattctgtgaggttgactttttaagcattatttaggccaggtgcggtggctcatgcctgtattcctagcactttgggaggccgaggcgggtggatcacgaggtcaggagttcaagacctgcgtggccatcatggtgaaaccctgtctctactaaaaatacaaaaattaactgggcatggtggcgcacgcctgtaattccagctactcagaaggctgaggcagaagaatcgtctgaacccgggaggtggaggttgcagtgagcagagatcgcgccattgtactccagcctgggcgacagagtgagactctgtctcaaaagaaaaaaagaattgacttttctaagcccacttcaagaaaatgtgaattgaaattttcctctgacccattctgttccattttgcgtctgcctttttcaggtattaaaatgttgttaaaattgaagtcattaggttgataaaattgaagtcattccacttttgggatcttttgctaccctcagggatctgacttcttgggcatattaaaatgtcaattttaatcccctgagctacaaattttcttaagttcttcatacgttttatttttggaatcatattattattattattattattattattattattatttttgagacagattctcgctctgtcgcccaggctggggtgcagtggcgccatctcggctcactgcaacctctgcctcctgggttcaagtgattctcctgcctcagcctactgagtagctgggactacaggcacgtgccatcacgcgtggctatttttttttctgtatttttagcagagatggtgtttcaccatgttagccaggatggtctcaatctcctgacctcgtgatccaccagcctcgggctcccaaagtgctgggattacaggcgtgagggaatcatactatttttgaagggagcttttaaagcacattgatattggaattgagaggtaatatacgtataaaggaaatgcaatgatctgtggaactgagactgagatgggagcccgggagttggaggctgcagtgagctatgattacactactggactccagcctgggtaacagagcaagacactgtctccaaaaaaaaaaaacaaaattaagtagattttgcattctactatcttctccctattatgtcgttgttggttttttccaatttaagaatgttttaaaatcatgtttgttcatgataactgtctcctgagagccaccgcgcccggcctaaaaaatctattgagttcttgactgtttgttcatatgtattttcgttagctacctcagatcccctttgtagcaagatagggtataaaaatacatatgttaactattatcaaaagactgacatgcgaatatggaccaagtatgaatgtgtatggattgatttctgtatctttggggaagaatttgatgcccttaggaaatagaaaacataaagcataggtaaaaatgataatggtgcaaaatgcgttaagacatagatgttataaagaagtattaaaattaaatagtaaaaatctacaaataatacctttagctaatgttgaagggagagaaactggatggctcactttttaaccagagtcgtttttcttttttcttttgttattgttgtttttctttttttgagacagggcctcactctgtcattcaggctggcgtgcagtggcgtgatcttggctcactgcaacctccacctcccaggttcaagtgattcctgtgcctcagcctcccaagtagctgggattacaggcatgtgccaccacgcccggctaatttttgtatttttagtggacatggggtttcaccatgttgtccaggctgttctcaaactcctggcctcaagtgatccgcccactcggcctcccaaagtgctgggattacaggcatgagtcaccgtgcctggcccagagaggtagcagaagtgtcaggaacagagatctggatggcagtcttttcctcacttcgctttttctgctgttcctggaaggctctctcactctgctctttggacaatgccttgcccctcttggtggcagcttcctaggagagggcagagtcgggggctcttctttggttgctgccctgcttttctgtcttctttgtagaaggtgccccaccgctgcacttggagagcacctgtgctgttctctcctgactgattttcttggtgtgaaaatggctcaaccttgaggccagaatgtgaggttgggtcttcaactactttcttgactgtgttgctaaggccggactctcctcctaacttaaccagatggagtcatctttttattagctatcctgcctagtaggatgtaaactctctttttctttttagattgtgatacaaatttgggtagtgtggacattttagccatattaattcttacagcccatgaacatggaatatcttttcatttatctgtcttcggtttctctcatcagtgttttatagttttcagtaaagaaatctttcacctctttgattacatgtatttttttaactattgtaaatgggattgttttcttgatttctttttcagatggttcactagtcatgtatagaaatgctaactaatttttgtatgttgatttttgtatcctgtaggataactcctttctgatttatatcagaatcaagaaagattcaaatctttcttcaaaaaaaatcaatattttaaaaaagaaacaagaaaacaatttgtattaaaaccaacaactcctttttgattcctagaaaaaaaaaactgactctagtggagatcgtcataactttttaaagctagaaggaattcttagagatgagtagaaagggtttcgaatttttattgtacagttgagacttcctgcaagcctccctataaaaacaagcaagccacgaataattactgagcacctactaagtgccaaacctccttaaaaaatagagcagtctcctagctcggcattccagaatcttaaggctcttttgtgtaaatgccctgcctgctgagagctgcttttaattgcttctggtctgcctcagcctgtgtaggagatttgtggcccaatcatagattcctgtcctgttgtgaaacaggaataacatttgtgacactggaacaaactcacaatgaatggctggttccgctgaccagcagctcaatttcacttctgcatttaattgcctgcaaaagctgtttattgccttgtgcactcctccaccgcaacattatctcttaaataaacatgttgtaccaggttgacaagggagaggtgcgtatcgagtgagcagaaataaatatgggaggactctgagctatgcctcggatctcctttcaggccctatggcaggcgccctcttgactgcttttccaaagcttgtgcccccagatgtgtagacttacattccagccacgtttagggtgtggccaaatggcagcactggcagttatttcgttctttctggtggttatgtggtctcctctgaagtgttttatggttgtccattgacgataaggcacctcgcaggaatgcattcatgtcttaacatgcttccagagcccaccatgtgctggggatctaccactgaacaaaacacaaaaattgggaaaagtgagtcttgggagaaggctgctatttcttgatccctgtagttggggattgcctaaacctttctacaggtaggaaggaaaccgcgttctggcatctgaggcttgaagcacagaaaaaagtgcccccttgtgagtgttcctggcccggtgctccagcaccttctgcctgctgagggtggaagggttgggaagggcactcagaaaagccagtaccttttcactgcttgtccgccgtaaggagcagccagacaggctctcgttttcccactgccccccctttttttgttgttttttaagtgtagctcagcatcagaacaacctgtttgttagcttgaaagaatggtcaaaacaagtcactttccaaagtatctgctgtgtgggggtggccagagcactctctgcagctgtgccatatttgtgctgtaggaaggcgcagtgagggtggagccatgggaagacaaggcggaaacctggctctcaggagacagttatgatgaacaaatatgattttaaaatactcttaaattgaaaaaaaaacaacaaagacataatagggagaagacagcagaatgcaaaatctacttaatttttttttttttttggagacagcgtcttgctctgttacccagactggagtgcagtagtgcgatcgtagctcactgcagcctccaactcctgggttcgagtgatcctcccatctcagtctcacgagtagctgggactacaggtgtgtgccaccatgccacacctggctaattaaaaaactttttttgtagagatgggggtctcagtgtggtgccgaggctggtcttaaacttttggctcaagtgagcctcctgcctcagcctctagaagcgctgggattacaggcttgagctgctgtgcctagctctacttcaggttttatttttaattattattattttttaattgagaaggatcttgctctctcacccaggccagagtgcagcagcataatctcagttcactgtagcctccacctcctggacttaagcgatcctcctacctcagccccctcagtagctgaggctacaggcatgtaccaccacacccagctaatttctgtactttttgtagagatggggtttcaccatgttgcctgggctggtctcagactcctggacattcaagtgatctgcctgccctggcctcccacagtgctgggattgcaggcatgagccaccacgcctgaccaattttttgtgtgtttgttttttattgtgagacagagcctcactctgttgcccaggctagagtgcagtggcgcgatctcggctcactgcaacctctgcctcccgggttcaagcgattctcctgcctcagccttccaagtagctgggattacaggcccctgccaccatgcctggctaatttttgtatttttagtagaaacggggtttcaccatgttggccaggctggtcttgagctcctgacctcaggtgatccgcctgccttggcctcccaaagtgctgggattataggcgggagccaccgcgcccggctgcctgaccaatttttaagacatagtaggagacttcacatgagtttttttttttgccactgagctccacggtcaggtttcccaggatgatgtgctctggtcactggaaactcctgggaagttctggatggagaaagcgggagtgacttgccttacgaacctgccctgggccctctcacccttggccgggagcccttcacagtcttgttatccacaagataacaccctcactccaaggctgccctctcacccccatggcccacaccatcagcaagtgaaactagccctttttttttttttttttttgagacagagtctcgctctgttgcccaggctagagtgcagtgatgcgatctcagcccactgcaacctcctccctagttcaagcggttctcctgcctcagcgtcctgagtagctgggattacaggcgtgcaccaccacgcccagctaatttttgtatttttagtcgagatggggttttgccatgttggccaggctggtctcaaactcctgacctcaggtgatccgcccccctcagcctcccaaagtgctgggattacaggcgtgagccaccgcgccagccacttttcaactttttaaaacataaagtgatgtattagatggtgggatgttttttgttaatgctcttattcagcaatgtaaaaagttgatacccgttgtctctcgcctccttcctacaccccctcctcctccaccttttttttttaagactgctgcagtactcagtgtgtccttgtgacaacagtgaagttctttaggggcttcagtgtgctccctttagcaattatgtggacttacatttgtgcttacctcttgacttgcagggtgcttcccctcccaccacattttttttttttttagatggagtcttgctgtcttgcccaggctggagtacaccaatgcagtttctcggctcactgcaacctctgcctcccaggttcaagcgattctcctgcctcagcctcctgagtagctgggactacaggcacacgccaccatacccagctaatttttatatttttagtagagacagggtttcgccgtgttggccaggttggtctcgaactcctcacctcgagtgatccgcccacctcagcttcccaaagtgctgggattacaggtgtgagccaccatgcccagctttcccctcctttttatgacagccatgggaacaccctcatgctggtctagcattttgaggaattcattcacaggaaccccaagtaggttctgctgtcaggcacatggtgaggatgtaatgattgggcctactaggtcagtaggcaagttttggagactcttctgtttaaggaaatgcaactccaaagtcatgatagaccctagaaagtttaaagccagtggaattaaagctgtcatgttccctgagtttgggggtcacattactattagtataaactttgccttaaatggcttgtcaagtcttagccatgcctatgatgttttcttctgcaacataattcctcattaggttcctctcttttaaagagaaatagtggacccaattctcttgggtctttacaacatagtcttactcctgcagggagcaaagctttctttctctagctggccctgtaaggagcagtgagagtccttgcccacccccacccacattactcctctgaagcattaagcctgggtgaatgcagtcccggctttctgtttctaggtgatcacctcacctaccagcactttcaccaaggagttcctattttgtctcattttagctgatgacaagtgatgatcgtgacagtcatcatctggtttttattacacctttccttgaaggaattgctattttgtttcacagatgatgaaagcttaatgacttgcatgcttttgatcctgcagcaagggtagttgtttgtaagaactggtgcctgcgatgacaattttcccagtggctctttgtctggagccaaagctcagggagggtgatggtgggaagtttagccgctgagcccagacagatggtgagaggttgggtttaggaatatcccgtagctacagtatagtgcacaggagagacatttttggagtgtgttttggttaaaaatatgtagattccagaagaaactagaattggcctctggatacctggggccctggagaatagacagctctgactcagagaatatctagaaggagtgcagacctgggcatcctaagggattgttttttcagtctggttgaagtggtccagtagcatcccaggaagccagatagagtgaaacattaggtttttcagcaaccttcggaagacttgtgtaagtcctgggctgtcctacagattcatttccattgttagatgacttcagtgtgatctgggctgagtaagaaatcccctgtaaagtgctgatgtactccagggactacttcacaattgaatcggaggcagaagcatattattagttttgcgaggttgttacattacctattatctgacacagtagcattaggttagtaaataatatagtcatttggggattctgtaattggcttgaaatttagataattagatcacagtttttgaaagctttcagatttgatttggtttggctggtggccaaaatcttatccatttatgtttgcccttttagcttactttttttcctgttaagtagacatgaatatgatatgaaattagttgcttttcagaacgtttaattacatgtataagtgattctcagatttcttaggagtctatatttctgtggtctcttaagtgttcctcatcatttgaataaagatgaaaatcaagggaatgcataacaggtttgccctgttttttcaataccataatagaaataggatagaaaaaaagactagagttgccaaaaaatatccactgtattacagagtatgcgttagagactcctttatgcatttgttgattgtttttattgagtggctgctccgtgcctggcactgtgctagagactctcaagtactggctcatggtggaatggatgagaaagaaaactcaaaagacccatgtggccgggtgctatggctcacgcctgtaatcccagcactttgggaggccgaggcaggtggatcacctgaggtcaggagtttgagaccaatctcagcaacatggagaaaccctgtctctactaaaaatacaaaattagctgggcgtggaggcaggtgcctataatcccagctactcgaggctgaggcaggagaatcgcttggaccagggaggcgtaggttgcggtgagccgagattgcgccactgtactccagcctgggcaacaagaacgaaactccgtctcaaaaaaaaaaaaaaaaagacacatgtaattctcttattcctgtttcgatcagagcccggggagaactgtgatgccttgtggaaagatgagcccttgctgtggcatgccaagaggcagggtggggacaagtgtttgatcacaactattgtttagaatttccagtgcatggtgatagattgactttagtggattttatttttaaaaaattatcccacagtgagtgcacccccttactgcctccccccaggatgggttgccctcagcaccccctccttggtatagcattggccctgtgggcatcaccattgagatgcacagcctcctggaaggggtgttcatacatagactgaggaacagggaaaaaggtattatccccacattttatttatcacattccttctcacaacattctttctggcaagtcccagttctaggggaaggaaggcagacataattctatgtctggagtatttgtataaaaccaaaaaatgggaaggcctggaaatttcgctgtctcctcactcccttgcccgtgtgtgtgtgtgtctgtgtgtggtgtgtgtgtgtgtgtgtgtgtgtgtgtggcactgcaggacatgtcaaactaaagtttatgtacttaaaatcacctttaaagtgtataatggaaaggtgttttgtttgagtcatttgtttgcaagccccgaagaggagtctttcattgcggtgccccgttctcccgttgacagaagcaggtggacccgtgaggggaagaggagggtgcaagcagaacagccctggaacagtgtcacgctgctgggcacttcctgtctcctattccatttcatccataaacacagcctttccgggctgtgagcctccttttgtggatgaggaaactggggctcagggagatgaagtagctagctagtactgcacggctggaaacggggaagctggatttggagtttgcctgactgcagagaggcacctctgttcccgtggtgtctctgctttccttgcagggcagtgcacatttcttggttttccttttaaagccgtgaaattctggaaaatcactaggcatgctgtctctcaagatgcttctgtgacacacacacccacacacacacacacacacactcacacactcttccaaatccatgtactttagggaacagtggtaacgtgatgcttttggtcattcttgtgtcatttcaattagttggaggtggactcccttcatggtcttagagtgggcagggctttttcctgccacccacaagttgagtgtgtccatcagaggtcaccagcctgcgtcggatcttgaataccagtttggtaaaggatgtgagtgtgtgcgtgtgcttagttagaatgtggccccagacagcctcaccttgccctcccggcaggctctcatgttctgtgctcataagacacccttcacactgctgatttatgctaaaagtatcctaatgtttctgacagctcatgtgtgacatgaatataatccatatttcttacagcagctaatccaagtggcttattttcctatactgctgatagggctatatctcttgatgtcgcagccctggagattgtgatggtgacatattgtttctgggtcactagttttgtctaaaacagtaggttggaacagagtagcaaaggttaattaagtttgtccatcaaggtgggaacagatatggatgcctctgatgtttctggttctgaaatcaaagttcctaaatgtgcggttgtgggcatcatttctcattttcagacaatcaaaaaaaaagtttatttgctccagaagtagagacaatgcgaagagttgttaaaagctaaaggcagcaaagtaggtctttatactaagcagataccttcatttaaaattagaaagtttccttggtttagtagagagaaatctcagaagcgtctgaggtgatttactttgaatcttgctgtctgtacttaattccttgggaccagaaccaagttatttgatctctctgagcagtttcttcctatatcaatgattattaaattatgaagactcatgagataacaagtctctatattatttctcaatagatgctcattttcttcctctgaaatttggttaatcttatcgtcagtaaccagtattttctcaggaaaattaacattaagaatatcatcagtacaacccccatccgtacaaacacacaccccagtcttaagaagcattgtagatgccttcagagactggacatgtgagagagtggagcgtgctgatcattattaaccaaatttaaaaaatacaacctttttaatttcctttctctccagccattttactgaaactctgtttcttagttgcttttatgtaaatggtacttgcatttatgcctggtatacatgggttcagttgggaagtccgggtctgtattttagatttgtgaactagacaaatgtaggtttccaacccaggaactggaaaatcctgcatagatttctcaagatgaagaaggcgctgagctagtcccagccagacactggtccaaaccaaccaccccactctcttttgtgaaccccctgatatgcaccaagaccctttcaggttttaggaaaaggaaacattttttaaaatttggctttttcttactatttacctccttttagaggtacttgcatccctttacctgatttatacgttggtgtctttcaaacattttagattgagacccacagtaagaaactgtattccagtatatatttacacacacatacacaaaatgacaagttttgtagaacagttcttaccccttacccaaattgtatatgcaatgaattcttatatacagttctcttttattctgttctgttctattctattgcattctgttcaattccatacagttctctaaaatatatatgtgtgtgtgtgtgtgtgtgtgttatatgtatataacacacactgactgcatactgaattatttgagggccctataaaaggtaacacttctgccttttggaaaacatggtctcaagaagtacactgttgttccgtcagtaccactgatggcatatggtgaaaacagttgaacaacacaagttaaaaaaataatttggcctttgtaaaatgtcaaaatactcacatctgaattgcttctgggctaaagataagcaaaatggaccactaataaatacaagtgtaatcctgatatcctatggggtttctatccttaatgggtattcaggattgttgtgggctgggcatggtggctcatgcctgtaatcctagctcttggaggggggcccaaggtgagaggatcacttgaggccaggaattcaagaccagcctgggcaacatagtgggaccctgtttctacaaaaaatataaaaaatttagctggtcttggtgttgtgcgcctgtagttctagctactcaggagcctgaggtgagaggatcacttgagcccacgagattgaggctgcagtgagctgcgatcacaccactgtactccaggctgggcgacagagagaccctgtctctaaaaatgttttttttaaaaaagactgatgtgaatttctcttccatgccctctccacaatttatggaaattgcgggagggcttgctttatatccttgtgttcaattttggttctgtttttccatgtgacttgtttgtttttttatggttcatcttagggctgttgtttatttttatttttggagctactgtaatacaaactttcctttggttctttttttttgaaaactccacccacactttttcttttgtttttgcatgtgtagtgggaaatttgggatttgcaacttaaaacatcttaaatgaatcacttctgaaatggttggttctctctgccctgttgtgtgagcgtcctcctctccactcctcccccgttttcccctcccacctctcctgggcgcatttggagggagagctttcgtttggaaaaaggactcttgggttcttcagcatctgaatgcccagccccagccccacgcttagcacagcagcttcacccctcccctgtccacccctcaccccacacacgttgaaggatcctcttggcctttgcgggaatcccttacaaaggctgagtcctcacaagtgcctgtctctgcctgcctcggttctttcctccctctaggagggaagtggagggcattccatagcaggaccacctaagagaaagcaaggtgagcgcaggagaggaagggagcaaaggactcatcttcagagctctggacacaaaaggaaaggaagtcgggaggggcgggttttcgctgtgggaatctgcttgggtcacacacctcagcatttggcctggtgctttggtaatctctgaaatgtgtgcataatagcaatcattttagcctatatattaaaatttttttctcagctgtgaaatatggaatgctgaaaaatgaataaggtgtgtatttcagaaggtgaacggggctttttgggtgaagccctttgcgtaggtgaagtctgtaggctcagacagttcacggtgtgtgcttaggtgagcttgggaacaggcatcccatttagatggttcgaaaagaagcatctattaaaactaaagccatcatttaatgagggtaaaagtcaaccccagccttcacacccagcaccaccagaagacacagaattctacagcctgtgaagagtcctacctttataaaaaggtttctgttcagaaaaccaaaggtttaccccaaatacagcttttgccatttaaaagactgtaagccacatatcaataccaagggagtttttttgtttctgttttttttgaaacagggtcttaatctgtcacccaggttggagtcagcagggcaaacatagcttactgcagccttgacctgctgggcttaagcgatcctcccacatcagcctcctgagtagctgggaacacaggtgtgcaccaccatgcctgcctaattttttaaattttttgtagagatggagtctcaccatgttgcccagactgttctccaacccccgggctcaaataatccttcctcctcagcctcccacgtgctgagatttacaggtgtgagccattgtgcctggctgagtcattacactatttgtttaaatatcagtttgcaattaggaatgttatcctatagaataactcttctcattaagactgttcccctttctgcaaatgagcattacttagagcctccagtgaagctgaatgaagctctagagagatacgaacttaacgctgaagatttttttgtcttgaagcatgaagaatcaagatacctaaatactgatgatgaaaacttttaataaatgtgagcacaggcatttttaatgaaaaaggcatcatctgatataagttcaaaaacaaatgaaaaaacttagaaattaaaaaaaaaaaaagactgttcccctttgttacatcaactccagttttatgcagccatgcgatgtttagtaaacaactagatgacaatttggtcttcacaaatcccttttagtcattcacctggatagactgttcactttgatgcaagaccaggcactcatctaaattgttactagataaccagtgactggtatttgggatttttttttttaaaaaaagaagtgaactcaaacatttttatggtttttttttcagatattattgttactataaaatagggtggctaacacgtataaaaggaaattatggctcgggtttactgtaatgcatattcttaacaatttaatagaacacaactccaaggtcttgggttgcctgcaaagttaatactaacaccatgagcatcctccaccagccagctcttatccatgggtcgtactctggttcagagactttggatgggtaataacgtataaaacatgcctcttgcttgccagtgaccactgctaataataatagtagtcatcattcactggaatcctgggtttttagggtttacttggtttatttatttgcttagcttgaaggaataaaaaaaaaccttgagaggaaacaaggaggcatttcacaaaggagaaaaatatatatccctttaggaaaactgagtggctcctctgatttctttgccgctcttgtccctcagcagcacttagctgttttcttctagctggaggtgagggactgagcacaggggtggtgctcagttagtttaaagggagcttctcaccttggcgctgttcaggccttgggttggttaattctgtgtcctgtgggaattgtgggacactacactgtagtgacagtcagcagcatccctgaccttgaccactagatgccagcatcaactccctgcccccttgtcacaatcaaaagcgtctccagatgttgccagatgccctgtggaggatcagactgcccctagttcagaactactggtttaaagtaaagtgagtttcaaaggcttcgttaatttcccattttgtttaagccaaaagtagcagggttgtgattttctttttaaagttagaagagagcaggaagtaatttagtttgaaattgcattctgccatgcctttttctgggttaattgcatttttttttttttttttttttttagatggagtcgcactctgtcgcccaggctggagtgcagtggtgcaatttcagctcactgcaacctctgcctcctgggttcaagcgattctcctgcctcagcctcccaagtagctgggattacaggcgcctgccaccacacccagctaattgtttgtatttagtagagacggagattcaccatgttggtcaggctggtcttgaactcctgacctcaggtgatccactcaccacagccttccaaaatgttgggactgcaggcgtgagccaccgcgcccatccatgaattgcagttttaacatcctgtttatattgctacacatgcacttagaaacacatagaactgtccttttcttcttatgagcaagttgtcacgtggatgggttgtttgtggattctttgaggtggatgtagctgaagtgactgatgacctcagtaagttcatgtagtagtctgttctcacactgctgtaaagatactacccaagactgggtaatttataaataaaaaaagaggtctaattaactcacaggtccgcatggctggggaggcgtcaggaaacttgcagtcatgtcagaaggcgaagaagaagcaggcaccttctcttcttcacaaggcagcaggagagaggagaaagagaacaggggaaactgccaaacacttttaaagcatcagatctcaagagaactccctccatatcatgagaacagattggggcaaccgcccccatgatccaatcaccaccgcctaccacgttccttctttgacacgtggagattacggtgtgagatgagatttgagtgaggacacagagccaaaccatatcagttcacattctagtaacctcaaatggagtctgaccctttgtatctttttcttcttttactggaattcttttatagctcagtgatcttggggattcattaaggatagtgaatgtttgaatataaataactaaattcctatttcctaatagttctttttatttcatgcttttggaaaacatggaaaaggaattaagggaataaataagcacacgcatggatttgaaattgtgtttattttccagtaagcgttagttaaaaaaaagaattttactgttcatcttcatctttttgtcaaataatacatacattgggattggcagcgttagccagtctatttgtcagatttagcctgttttagttaatataggggattgttgggatctcgtacttccaaggtatatggacgatatgttggtaattgtagagcactggttctcaatctcggtgtcatattagaattaactgggatctttgaaaatatccagggcccaggccacatcccagagcagttaaaccagattttcttgagtggagtccaggcatcagtactgagttcccttctcaccttactccagtgagagtgaagtttgagaaggaaccagtgccactgtttacaaataaagttttattggaacacagccatgcccattcattttacaaattgctagagactgtatggcttgcctaaaatatatatactgtttgacatttacaataaaaagtttgctgacacctgctatagactcatgatcaacatttttcaaacattttgaaaggaaggtttgtgtaaactttcatagtaaaaaaaacatccagcattttgcagagcatttaggcccaaatcctatctgttttcttgtaccctggcaaaattgaaaagcattttccttgaagaactggcttgaagatattgtcaaacctgaagtagatgtgacaaactcagcccccagagcagggaggctccattatttatattacggcttatgtcggcaccttgcttctaattcagtgttcactactcagactgtgtaattgacttaaggaagtctatggagacacaaatggcttttcaattcaaagtgtgtttgagtttttactgctgcagcagttgtagatggcaacagacccctgaaaaaaatcttttagttctggggaattttgtgtataaaaataaaaaaagaatgaaaattaaaaattgctatttacatagtttcacttttccagttcagctggaaactggatggttgtaagcaactggtaatttttttttttttttaagctggggcagtggctgacacttgtaatctcagcactttgggatgccgaggcgggcggatcacttgaggccaggaatttgagaccagcctaggcaacatggagaaaacgtctctactaaaaatacaaaaattagccggacgtggtggggcatgtctgtagagtaggctactcaggaggctgacgcaggagaatcgcttgaagccaggaagcagaggttgcagtgagccgagattgtgccattgcactccagcctgggcaacagagtgagactcggtctcaaacaattttttttaaagggtttcctttggtcttgggttctgagaggtactaagtatgagaggaaggatcacgtattctagtccctgggcaccagcaatatcagcatctccagcccagtcttaccatcaggacctgcattttaacaggaccccctggccattcatatgcgcattgagagctgctgggaatcatcaaaagatgctgcagtgctctaattgataactgggtgtgtgtagtaaacagctaccatgattgtcccttttctcttaaatggtttagtggcttcttaatgggctcttctgctgtgtggtcttatttattaggggtagccagtttttcctttttggctgttttccgagtatagcttctttaaccttctatttagtaaagatttaatgtggccaggcgcggtggctcacgcctgtaatcccagcactttgggaggccgaggcgggcagatcacgaggtcatgagatcgagaccatcctggctaacacggtaaaaccctgtctcttctaaaaatgcaaaaaattagccaggcatggtggcgggcgcctgtagtcccagctactcgggaggctgaggcaggagaatgacgtgaacctgggaggcggagcttgcaatgagccaatatcatgccactgcactccagcctgggcgacagagtgggactctgtctcaaaaaaaaaaaaaaaaaaaaaaagatttaatgtaatggtagaaagtgaaaacggagtgattggcctagaagagacaccatttcatatacttcagaaaaacaaactagaaaggataaaggggacttacccaggtaaacttcacttgagaggaaataatcacctgtaatggtatctttgcttctccagaagaagtaatccactcatgagaacatagatttgagcttgagagcagtagagatcaaaaataaattccttgagctgctcaaagcatcaggcagaaatcagggacttagctctttctaccaaacagcaccataatacccaaagtacacttaagccagtgttagttggtgaattgtccagaatgtagatgttcatagaaaatcttgaggaagcccagtgcctaattttacactaccaggctctgtcaagttagtgctattttctttttcaagtaccatttaaaatacttgattgaaaaacatgattttgaattattttggattattttgaaattactcatatttctggacagaattggtttatcttgaacattcccttagatcgaattttgtttaaaagcgagtaccatctaaatttaagttttaaaagactgtcataaataactgaagtccagctctgttgttgccgtgaagatgtgatcatgagttgaatgctcggtgtctctaacagggtctagatgttcatggaagtgggtcttacacaatcagagtcatcagggccaggaaagtggaaatggagggggggccctttctaagccatcaagtcatatcttcttagctttgaatgagaatcaggaagccacagggaatgaactgcttcttatataaaagctatctcatggtcctaaaggcagggtctggttgccggaaaaaaatgaatgactgctgtgctcacatgcagctgccactgcgaggggcgcttgtgcctccttactgccttccgagttttgctctgccccatgtgtccagttagcagaagccaaatcacctccagaattcagatctcagactcctgttcttgctgcagggaacagacaccgactaacaggatccagcatggcattgtgctaatgtccacagcttcccattacacatggtttgcatgttgttttacagtatttatttatttgttttttttaatatatatatattttttagacagagtctcgctctgtcgcccaggctggagtgcagtggcgcgatctcggctcagtacaagctctgcctcccgggttcacgccattctcctgcctcagcctcccaagtagctgggaccacaggtgcccgccaccacgtctggctaattttcttgtatttttaggagagatggggtttcattgtgttagccaggatgatctcgatttcctgaccttgtgatctgcccatcttggcctcccaaagtgctgggattacagacgtgagccactgcgtccagcctatagtcattttaaatactctccttatatgaacactgtaaggtaaccaagataaaattccagttttgcacatgaagaaacatgggaagaggtctgataacttgcgcccgttcaaacaaatttgttagtgttacagcagattgtgttgtcccctctccaccaccctgttctcttttgtactggttaatcgagcaccaaatgaacagaaggaatttcaggggtgctttagaggggaccttaagatagaaagggcaccatcatagttctaggcccagtacattggaagagcatattcatggctgaggccacttccaacttagataggctattcccttaatttgctttttttttttgagacagggtctttctctgttgcccaggctggagtgcagtagtgcaagcagccacggctcactacagcctcaaactcctgggttcaagtgatcttcctacctcagcctcctgagtagctgagatctcactcgtgcactatcacacccaaacaattttttgatttttatgtagaaaagaggtttcactgtgttgccctggctggtcttgaactcctgggctcaagcgatcctcccgccctggcctcccaaggtgtcgggaacataggcatgagccactgtgcccagcctgttaccttgttttaaagaactagataattattgtactagttgtgacatgcaatgttgatctcagtatatttcttcttttttcttaagcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcggtaggtgtctggtcacacagactggatttggggttgagagaggatggctatccagtattgggtcattagctgtgtctaatggcttagctgttagtaattgttggaaattttattgctgtgtgaagcttggataagtatcctttaaagaatttagttataaaatgactttgctatgcttgattcttaatatcatgttttttttcctttctggattcctagagtgacaggagtaagatgagagactctcccttggaagctaaaaatgtattttatggaggatcaatatgaaatacaggggcactttaaatgtggttcaagacctggtattttttgtgaagtgagtttctgtgcattgaaaactcctttcccaaagactttcattttaaaattgaaggcgtattcatctttttggcgaaaacaacataataaaacatttttgaatacaatagatctcagagtttatgcagtagcaatgcaaataactctgatataatggctttgaaataaaaaatgactgtttaatgaatcaaagcactttgaaatacatagtaactcgacttcaattttaacatcccccagcattttcactgtggtgagaggcaggtctttacagctgctgcgtttccagatcccgtgtttaagttctttatagttaagcatcctcttttgatgtaggaaagtgagaaacatacacaataggcagtaagtggaaatcagggcagtagagggtgtcttggaagagaaaccaatctagaagaatttactctgtgctaaataaaaggatatgttcattttctaagtaacttgactctttagagaacttagagaatgagaatcagaaccatgctttgatttccaaattcagaaccagaaagtctaaaatagctgggcaagttatgctttatttaccatattaacataaaataaaggacttctattaatatgaaatatataggtcacgggagcctatgtagtttgagctgcagagaggccgaagtacacattgttgattgcagtttcacttttattaagaatcactttccgttgggagtggacaagcacaactctgttttataagtattcatactatataatgtgtgcccataggtccttctttcatactgcttttgagtctatatatttatttggcttataagctccctaaggacaaacaacacattttctatactttcttacctgctgtgatgccttttatttatttgttggttgagtgaatgaatgaatgaatctggtattatttttaactgagtttggcctgtaagggcgtgcaagcatgaaaggtcagaatcctaactggcctgtctgcacaatttggggatgaagcagttaaaggaacatttgttaatacagaaaattaagaatgaaacccactttcaggaagaaattgcctgagcttcttacaccaggaataatggaatattttttgaagcactggcgttcttgagacaaaggtgtaaattcagagcaaggcagtaagacaaaaatataagaggcaatttattagagcagagaggagcgaatttggagaggagcggtaggcatttgaatttatggcagaaaaggaagcgactcagaaggaaagaggttacagtccaggaaagaaaaagaccagctgtactagcgctcacagggaaagaagaataggtgaataccacctacaattccttattacttttctggccatgtgtttatttgaaagagtagtgtgtgaggaggccccaggcttaacttcctggtaccctgctaacccactaacagttaagtaggaggcccaagcttcagaaacgagagctgggaagactctaaaatctcagcactatctactttggaattatcttcgagaaggagtgtacaaatacgtagaaaatcaaaatcccagctaatttttaacagaaggcttaatgccttccaaatgtgtgctattttggctttttttatattgcatgaatttttacaaagcaagtgggaaggtaaaggaagcgtgtttggaggtcagtaaggacacctcaaaggtcatctcatgggacactggatcctcagttttatcagcattgacacagtggggtgttctttgagagcatgttagcccttctgggaggtggggctgaggctagagacaggaaatgatgggtggggatgcggacatcagtatattcatttgtgagatatcggcaaaggttggctcataaccagttacatgtggcagatccgtcaagtctaagttcctttggttgattgtgttaatatgtaagttattatttattctaaatagggatttctaaagaacttgaaagacagtgttttcagtaggtttaatgtcttctttaaagtcttatttaagtataaatttgcccattaaatctatgttcttcagtttctttaaaaataaatttaagcttagcttctctgtcatctaaaaaaatgaacccaagttcagtgtcttcctctgggtttgctataaagctggcaacatgaaataaatggaatgttgggcggggggaggggggcattttacagggcaagttttccttttgtcgtgttactgctttttaatgcttttctttgtaaaaggataggagccattccttctttccttatcctgaaaaacgttaagagggtaggtcagagagatggtggagtcagatcttgcaggtctttgtaagctattggaaacaattaggcttttatttcaagtgagatggggagccatagcagggttcaagcacagggtgatttgtctgtcttgtgcttttaaatgatcaccctgatgactgttttcttatagactatagggatgcaagggtggaagctgggagaccagttagaaggtgatggcagtaattctggcaaaagaagatggtggctgagtgagggtgggagcgtggcagtgatgacgggtggtcgaattctggatatattttaaagatagaaccaacaagatttgctgttggtctttggatgggacaggaagagaggagtgaaggatgactccttaatttttgacctgaccaattggtattttgattttctacgtatttgtacactcctcgaagataattccaaagtagattggggtttccaattattgaggtaaagaagactatgggaaaaataagtttgtgtgcattacgagtttaactttgcatgtgttaagtttgagatgtccatgaaccacccaagtggattgttgattaggagttggatgtgtggagtctgagggggaggggaaatatctctactggagatgaagatttgggggttcagtgcataggtttatttgaagtcaatgtgatgagatcatttggagagatgaatgtaggtggagaatataaaggaccagggactgagcctgcgtgtctccagtgtttatggccctgtagatgaggaggactagcaaggaaaagagggaggaggagcagcctgtgaggcaggagggaaactgtgtgtgagcggtgccttagaagccaaattaaaggattttaatgagagccaaagagtgctgatatgtcaaatgagatgaggactggaatcgaccatcagctgttgcaaggtggaaatgatcagtgaccttctgagtggtcactttggtgggaggtgagaaccaaagcctgcctgcgtattcaggagtgcatgggagagaagaattggtgcagtgaatacaggcagctcttcaggagttttgctgtaagaggaatagtgggatgggacgtcaacccgtggggaagtgagttcaaggaagggccttggctccttctttaaagaagagagattttataatacgcttgtatgctgatgagggcgatcccaatagagggagaatttgtggatacagggagtgtgtggagggcacaattgctgtaggggtgaccctgagcaagccaggtggggtgggaaccaagggtctgcagagtgggggccatggtctgatgtgggtctgggagtgctttgttacttgtctaagaggggagataagaaatagagaggaaacaaactttatagcaatttggtagagcagttttgtctgttgaggttgataaaatattggggcttgtattttttgtctttcatttttctagtagcctattttttattgaggtagaatccacctaacattaactattaaccataattgaagtgtacaattcagtggcatttggtacattcacagagttgggcaaccgtcacctctatctgattgcaaggcactttcatcaccccaaaaggaaaccccccatcctccctcctccagccccctggtaatcactaatctgctttctgtctctatagatttgccagttctggaatggaatctcataatatgtagccttttgtgtcttgcttcgcttagcttaaatgttttcatgattcagctacactgtcgtatagatcagtatttcattcgtttttgtggctcaatatcattccatagtatggatggatataccacattttgtttagccgttcatcagttgagggatattgggttgtttccaccttttgggtaatgtgaatagtgctgctttgaacatttgtgtacaagtctttgtttgaatgtctgatttcacttcttctgggtgtatgcctagaagtggaattgctgggtcctatggtaagtctatatgtaatttttgaggaacatgttactgtttttcacagcagctgcatcgttttatattcttaccatagtatatgagggttccagtttctccacatccttgccaacacttgttttccatttaaaaaaacagtttccagcctgagcaacatagtgagaccccatctctacaaaaaaataaaaaataaaaaattagctgggtttggtgccacccacctgtagttctgactacttgggagggtgaggcaggaagaccactagagcccaggctgcagtgagctatgatcacaccattgcactccagcctgggtgacagagcgaaaccctgagacacacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaatttttttttttctgtagaaacagagttttgccatattgctcaggctgtcttgaactcctgggctcaagcgatcctcccacctcggcctcccaaagtgctgggattataggtgtgagccatcttacctggccaagaaaaaagtctggggggctctagtaattcatttttattgtattttgccaaagtaccagaccacggtgggttggaaactggaaaaaaaaaagtttaaagcaggcctctcctgctccacagactgtttgaagatcacttgtctagtgcccagatggagggttggcttatataagaatgtggccacttcgtagtaacagatgcaagctgttcgggaagtggtagtgggaacagctttgaaatgatgcttccccagctggtgatgaagagacagatctccacagcagcccctgtgttttaacagatgcacctctgtctagaggtgggtggcactgcacatttgagaatagacatcgttctctgcatgttgaattcttgagtataagttgctggagtacgtggttggtcgacacctgcaaaaaggtttaggtttcagttggtgaaggtaatacacttagatatttttgtctgtttattttgtgatctcggtttaaaagttagaaatggtgccttatttcttttggttccgtctcagagtggcagcctgccgtgcaacttcagccttccttcacgtccaagctgcactcttttcaggagaaagaaacatttaaggtggtgcttacagatcatgaagtgttcatgtattactcatttaacacacagaggttgtcagcagttccgtgaagcgagttgcagagcatctacattttacccaaaggtcagatggccaccgtcagtgatgggctccatggagttgaaggcttcatgctcctctgtgatgtgtaagcagcttgcagaggcctctgtgctcccaaatacaacttttcgaatccatctggcgttggcaatgtcgtggaccagggagtctagcagtgcctgatttcactgataccataggcctctccttcaggatgaccaggactgcatgcaaaatgggtagcttgcacctcagggagtggacttgcttaatgctgcatgtcagacttggacttttaggaaaaggtcatctggctgcacctcccaagtttgcaggtgagaaaactgaggttctgctctctgttgggagcaccctgagatctacttgctcttgatccagaacgccaaaggtgccctttatgtgaggtgaggtgacattctgtgacaagcggccatgtggggtggtagagaattctgtacgtggaatctgaatgggacccatgacttagcaggttatgtggcagtaccagatgcttccctgagagcctcgatttccttacctgctgagagagggtgaggatgttggctctgtggaggccacaccagtgttgtgaggatgaaatggtgtctgatgtgcaaacaagctcaataatcacaaaatgcaggtaaaggatggcaggtgttatcatgacttgcccccattttttcctgcgagggctgtgtgggcatttcacatagctcttcttgtaggggagaacgatgcctttgaaatgttgtagagcttggctggcacgaaggagagtggggcaaagactcagagggctgcgtttgttatgtatgcgtcctgccctgagctgtatttctcagccagtaggatagaaaaacatcaacccttgtctttctctgctttaaggaaagctgaatgtgttttatgcaacatttagaaaatgctgagtttaatttaaacttgacattttagaaatgacttattatttgctaaatttcaaagaaaagagcactttgtaagtaaatctgttttcgttatgtgtccattttgttctcagctttaacttggaacagagaagtaagtggggctttcagtggcaacaaggccagtgaatggaagggcattggaactatcccaggagacgaggtcttgctcaggtccccagctctggagccagtagtaagatgatcaatctctttttttttttttttttttccacctggagtctctctctgtctcccaggctggagtgcagtggcatgatctcggctgactgcaacctctgcctcccaggttcaagcaattctcctacctcagcctcctgagaagctgggattacaggggtgcaccaccacacccagctaacttttgtatttttagtagagatggggtttctacatgtcagccaggctggtctcgaactcctgacctcaagtgatctgcccgccttggcctcccacagtgctgggattacagatgtgagccactgtgcctggcctgatcaatcccttagagcttcagttacatctggaaagtggaaaacaataataacacatgtatctatttttatatatggatcacataaggaattatgtaaaagtatggcagaatctgtcatctctcatatacttgtatgtagaccttttaccgtggcttatgtatctttctgttttggcaggtgcctggcagtgggctgtacaaatgaaaatgattactgtcattaaggagggctaagcgtatgtgtatcatgattcttgaaattagctagacatcatggtctgccgagtgaggaagatggagcatactaattttaagcagataataaacatttggaaatggcagctttaaagatgtattttttaatatattacacttatgatatgtttgccaagtaaaacacaccagtgcttttcagggaatgtgaagaacaccagcaggtccctttatgcctaaagaatggtacagaagcaagctgacatgctgttggatgaggacaagcagatttctgtctttccttcaaacttctttctctttctacatacaaagagcaccccacaaggcaaactgtgggcaagattgagagctgtcgggctcctaacgtgtcctctgtgtaaagcactgccatttgacaaggcctcctccaggctgtagtctggaaatagcaggacttcccaggggcctacctcagggaggtcacacttactcatgtaaggataaggtccattcactgcagcatgttagcaagaattaccagggtgtgtgcccacacggagggtcagcttcgtacttctccaggtgcctggcatcgtgcagtgttctcagatggctcccgggatggtttgtcatttcttaaatgagtaagaaaccaactgtggaatcttttctgttcgttcctcatctacttggagttaggtattccagtgaagcattcggtgaaataaatcagacaccaacaaacatggggtactgtccccaggccacagacatcttggatttatgccatgtagaatcttccctttggaaaacttgaattttggggacttaattatctatgtgtgactggtattttgattaagaacgcagccctgccggagggtcaggggtgcttattcaatattcacacttaacagagaggatgggtgtgcaggcagagcgccgtgacttcctctaagccttgttgctagtgtttaagaggaggagccagcctacgaactcagacccctgaattactttcctgggcgctctttcttctagtatatcctgtgtttttctcttcatttccttccttttctttttcttcccttacaaacacacgtgcagctcctccagtgtctgtaagacaatatctgaccactctgtgtataactcatttaattatctggataatgctattatccccatttgacagatgaggatattgaagcatagagacagtgcctgttaggtaggggaaaagaggggtcctgttccagtgtggcacgtggaggaactgaagctcagtgatgatgctgtttatccaaggcctcactgggctacagtctagcaccctcatgtcttaagtattttcaaggaaatggtggctgtgattggggttgagagtgcacttgggaatattctatttgcagggactaaaggcatggatgcagtttgtttggctgtaatgatgagatacctgtcttacaggtagcacatgcctgatgcagaaatgcccccatctggggttgtggttctgtagcacattactgtcatagtaaaaaaactcaaaagcaaacttaaacccttcggcatatcaggtgtggtgttctctttacattgctattcccaaagctcagtataaactttaagatacctttatgagcacagtaaagtcacttttaattttgtgattatatttgaattttccttttatttaataagagagagtcaagtggaagggttaatatttgataagggcagaaatcacaaaatttaactagtgattagctttgaaatcataagtgcaaatagaaacacaatcagctactttcaaaaatatttattctcttttttccctgtgggcatcagctgttaagtgattacatattctacttgttattttattgttaaactcctgtgactaagaggcctggcagttttcctcagataatttttgaggaagatgttatttaatcttcacctagtctgtcagcagcttatcatgagattgcttttacgactttaatttattctgtaaaagctatagattgaatacacagagcaactacacagaggttttcattttggctaaagattgcagcctagagaagacacaggtagagagagagagagagagagagagagagagaagctctggaaaccacagtttaggaatgcctaaatgctctgacatagccaggttgaacatacttactagaaaacattgcctgtctgttttcaatgctgatgttatcttcatgggattcaggtgtggcagtgagttccatccctgcctgctcagtagagggacccagctctcttgtgggtacatcacaaatcatcaagttggccagtttctgttactcatttagagaccatttgtatttgaacatcccagagaactgacgtctgtctgttgggccctccttggatgtgacactagccagttgggttagagcttccagcatcctcactcatgagatttcctcatttgaatctgacctgaatccacagggccctagcgatttttttcagggatggcgtggagtacttctggagtttattttccctgcttgcctcttcagaggcacggcccaggccaagtacaacttgaataaccttcaggaaaggtgtgctgtccttctttcggccggccgctgtctttgaaaattgcctccagagttagtgagcaggaacagttaagatttacaaacaatgatgaagcttgtcatgcatctttcaccattcatcatccaggtgccgtgcctgggcggtgaagtgttcttcataaaaaccagctcagtgtgaaatacacctcgctgcaatgtttactgctttgaagctcgtcagcggccctttatagtaaatccagattgcgatgtgacattacagtatatcattgcccggcgcggtggcgtttacactaggaatgagtgcagtgcacaccagatgaggtgtccaaattgagttatgtcagaatttggctgttatatggggatagcttttgttttctgaacactgaaagttagctttatatgtatttatatttatatataggcatatacttcccatcttgcccgtatacacggggtatacaatagatgctgaggtcaggttccaaatgcgcttcctggtgtaaagaatggtgaccagattttatgtgccttccaaattgttgtccgttgaaattggcataaatggaatctttggggggaactagagtagatggttatttcagtttagaagcagctttgattttgctatgtgtgaagtgaccatatttgccatcctttcctatgaaaacttggaacactttctcccgggagtattgtggtacattggaatgtccgtttgataggagggcaaagaggagaaacccatacaactgttgccacccattgtggagcatcttgcctgtcctgttgagcacatatgcttggggaggtctctgaagtcagtggcttatttattatttcttttagtgggtatcaaaatcctagtgctgcctagtgttatcttgaaagatgctgcttccaagagattgatggtgttttagcttaaatctgcaaaataaaagagcacactgaatttattgcatgatcaggtttatttacattcacgctaaaagtgccgatattaaaaatgagctccataaaaaaataatattcagagacagcagccggctctgcagtcccatgatcatctgcttaacacacatattttaaaattctctgttaagtatagcaggattgttaggagagtcattttgtggtctttaaacacctggctttacattgaatccagggtctctcccccatgtatacttgcataaaatctgggttagggatttcctctactttaaatgcagaggtcaacatagccttcccagccatactctctgcctcttagttgcagtgtcttcttactagagatgattaactcggccaggtctgagcttcctgaggcagcgaaagaaacaatcacaggtgtatggaacttgacctctaggggcagtagaggagccagaagctttccattggctttgactcttggagaaccagagactatacccaaatcagcccagtagttttttaccagggtgggtcggcccaacatgtacaatcactttattaagatttcgagataaaatgtaggacactcagttaaatttaagtttaagatgtacaacaacaaatgtttagtataagcatgttatgaatattttattatactaaaattatttgtttctgaaatttaaattttatttatttatttatttttatttatttatttatttatttattttgtgcccaggctggagtgcagtggtgtgatcttggctcactgcaacctccgcctcccagattcaagagattcttgtgtctcaccctcctgagtagctgggactacaggtgcatgctaccaagcctggctaattttttgtatttttagtatagatggggtttcgctatgttggccaggctggtctcaaactcctgatctcaagtgatctgcctgcctcaccctcctaaagtgttaggattacaggcatgagccaccactcccggcttaaattttagcaccctgtatttgtatttgctaaatctgacaaccttgtacttcatctgtgtcttctctgaaacaccctgggatagaaggcaaaatggaaagtgaacaaaggattgcagtaccttctctaagcatgttcagtaattttaagggtggtttcagtttttttctttttttgagatgaggatctcactatgttgcccaggctggactcgagctcctaggctcaagtgttcctcctgccttagcctccagagtatcatttttatttctacaaaaacagtacaagagggcaatgctaatcatgcttggaaagctcttattttgattgatgttgtttagtaatttcttggtgaaaagtttctggattgtagtttatccttgaacatattaacatattatttctccttctgcttgggtgatacataggtccagaaaggtcaaaagaatattctttctttctttctattatataggctagacacattcatatatgtaaatgaaagctaatccactgctgctcagaatgaaaatggaaatttatacttttcatgcattttgttccgttgtccccctgtttgtgccaggcctaacagtgactcttaaagctgttctgcagggtcagttcctcaatatctctttccttaagtccccccaggatgtaaactgatggctcagtcagtaaacaagtgagaaattcattgagtgccagttagtgtctgggcctagcataatgctctgggagatgaaccatgagagaaggcgtggctgcagggatagtgaaaggtcagcggttttagggacacctcccttcccttcctgtctgcagaacagccttgcgtctgagcttctgtatgctgtggaatggagtagctgtgtgcccagccgtcttgactttattcaagacctggttgaagtcttcctcataaacctaagagggtgttttcttctcaaattagagaaaccaggattacagtcaaattcttgataaatgctccaaatacggagccttttccaggcacacttcacctttgttacttacatagctatagaggtaggatggagctagattgttctatttgtttgtttttttagagacagggtctctgctacccaggctagagtgcagtggcatgataatagctcattgtagccttgaactccttggctcaagtcatctgaattccttggctcaagtgatcctcctgcctcagcctctcaagtagataggactacaggtgtgcaccaccacacttggctattttttttattaaaaaaatttttttttttttgagacggagtttcgctctgtcgcccaggctggagtgcagtggtgcgatctcggctcactgcaagctccgcctctcgggttcatgccattctgcctcagcctcctgagtagctggggctacaggcgcccgccaccatgcccagcaaatcctttgtatttttagtagagacagggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagacatgagccattgtgcccagccctgtttgtctttttataactgcttcattaaaatataactcatataccataaaattcatccttttaaaatgtatgattcattggattttagtatattaacaaagctatggaaccatcactgctatctaattccaaaacatttccatcatccccaaaacaatccccatattactcccatttctgcctccctcccagcccctgccaaaatactagtttactttctgtctctatgaatttgcctgttctggactttttgtataaatgggatcatagaatatgtggtcttttgtgtccgacttctttcatttagcataatattttctgggtttatccatgttgtagcatgtttcagagcttcatttctttttgtagttaaataacgttccattatatggaggggcttggtttatttttagttcaaaaactattagaggaccaagaaaaactattaaaccacaagattaccaaagtgaaatatctattctgtctcattttattaagtctccagttctttgaattcaacatacaaatgtaatgagtagaacctcttctatgcagtgagaggaatgtggtgcatatggacattgagcagtccaggctgtgttattttcccgttttgtgctaatactatttctattagtctggttgggctgctgtaacaaaaaggcacagactaggtggcccaacaacagaaatttattttcttatagtctggaggctggaagtccaagatcaaggtgctgtcagagttgctttccggtaaggcttctctcctgggttgtagactgccatcttatgtcctcacatggcttttcctctttgtgtgtgtggagatagacacagagagagaatggaatgtgagttctggtctctcttcttcttaaaaggacactagtcttagagagtatgacctcatttaaccccagttatctccctaaaggccctgtctccaaatacagtcacattgggagctaggacttcagtagttttagcacagagactacattcagtcactaacactactgaagggttttatgtctctaaatgtctcttcttgatgagatttggtgggtcggtgtgtgtaaaatgaacggagtatgttgtgtgttttcaggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacgggaacacttttccagattgttgctcttcttttcctcatttaactccctagaatttcatttcatttcatttctacctctgaatttcagaaaatttctaatccatgccatctttgccttttaacaaatgctctgcataaccttaaacagtttaactctgatgtactgctaaagtgagagactttgccagttttcctggcagatacagcagaatttgggcctccacacgcagggacatgaatgagagagcagtgcgttatttcttgatgttataatgagccaatgcaatggtaacttcagagtgaactggctaacattcatgaactatctaatgtctatatagaccatccatatatgaaaaataaacttttacttttggaagcactttgacatagatcattttgttcagtcctaacaacaatcttactaagtaatgagaggtttttttccttctgacacaaactgggtgtcctacaattcaattcaattctgacactaactttctgaagttggcccagatgccacaggttaagggctcagtcccacaaaactgcccccattttaggctccagctgaaaatggggtgcccaggttatccacatttctacccagctggctacaaattaggggttcctacaatcccccttttggtccagtaaatctctataatgactcacagaactcagaaagtgctttacttactctaagcagttttttttaaataaaggatacaactcaggagcagccaaatggaagatgtgcatggggcgcggtatctccgtgctctttgagatttccaagctttcttttttttttttgagacagggttttgctctgtcacccaggctggagtgcaatggcgtgatcttggcccactgcaacctccgtctcccgggttcaaacgattctcctgcctcagcctcccgagtggctgggattacaggtgcacaccaccatgcccagcaaatttttgtatttttagtagagatggggtttcaccatgttggccaagctggtcttgaagtcctgacctcaggtgatcaatccaccctcctgggcctcccaaagtgctgggattacaggtgtgagccaccacgccccggtgagagctccaagcttttaatcaaggcttagggtctttcgggcgaccagcccccatcctgatgttatctaactgcctgccaccaagtcactttattagaataaaagaggcttctacatccttagcactcaggaaattccaagggttttaggaactctgtgccaggaacccaggacaaagaccaagtatgtttctgcgataccacaggtaggtagagcaaaaaccactgaccctattttatccataagccgatgctgaatagagagaatgggtaacaaagctaggaatggagcagggtgaccttatctctcctgaccgggtttcttcctgggacacttttcagcctcaggctgtcaaaccagcattgaacccttgtctttagcctgatgttgtagacctgcaccatccagtacagcagctaccagcacatagggttatttaaattttaattacaatggaaaatgcaattcctctgtcacaccaggcccatttcaggtgctttgtggctacaagaggctagttatatcgtattggatagtgcagaaacaatatttccatcatcataggaagttgtattcggcaactttttgggtcttttacagtgacaggaaaggacattgcagggtttaaacctgagaaaacaagtcccatatgctcacaaacaccatttaaaggtcttgacttttgtgggaacatcagcccttattctcctatcctgtcgggttgaggagctgttactgacagacttattgagtgactgctaacagaattagttgatccttggacctaacctgtgatgcacacttaagaaaaaaaaaaaaagatgatgaaagtgagtaactcagctagaacttggttgatctcagtccaagaatagtacttgcccagagtggaaaacttgtcttatggccttggagcagcatgtgagccttggagacttggcaaggatgctttcattaaaaccaaaactggggatgtagcattcatcccttatcagatagaagatgtgcacatattttctcccatttcgtgagtggcctcttcactctgttgatagtgaccagtgagtgacctttgatgcacacatatttttaatttttgatgaagcccagtttgttttgtttcttcttctgttgcctgtgcttttggtgtcatatttaagaaatcagagctggatgtgatggcatgcatctgtagtcctagctattcaggaggctgagggaggaggatcacttgagcccaggagtttgaggctgcagtgagctgtaatcacaccagcgctctccagcttgggcaaaaaaatgagaccctgtctcaaaaattaaaaaatttaaaaattttaaaaagagaagtcattgccaaatctgtgtcatattgtcttctaagcattttatagttttttagctcttaggtttaatccaggtctttgatccattttgagttaatttttgtatatggtgtaagggaagagtccagcttcattcttttgcatgtgaatatccagttttcccggcactatttgttaaacactctcctttcctccattaaatggtcttggtgccaagaggacaaagtggcaaaagaggaaagttttgacactttcgatgactgtggcccttttctgtgagcatcagagaacaccagacattgaatgttgaatcctaagcacaagcctataaaatcggcagttgttgatacaccttgatctctctggtgaatattttctcggttatcttacttttgtttgtctctcccagctgtctcaactatatctttcctacagttctgaaataaaggcatatagggtaaccagggaagggaatcctccaaaatcatttataatagaagcagtgagaatagtagtgcatttaaagactgtgggtgattttcaatttttctagttctaagtgactagtgtttttctaattgaaagtgactaatggtaatttttaaaatacccagtttttaaggatcatctgtagctgcttatatgtaagagatggtaagttccagtggaaaagcccctatatcctctagtgtcctataggaatattcctaaagaaacggactatcagagctaacagcagattggcaaacgaggggggcagatggataatgcctggctggttgcagcctgaaattgtcaatcacctcttaatgtttacaaaagtgaaaagtcaatgtgtagttgttttaatttgacacactcttaggttgagagagtgtaattgccggaggggacagttaagtggctctgctccttgtcagcctgtctgagtctgactccagtgctaagcacttttctgatgagcgatagattgggttaaatactggcgtaattgctcgcttccgcataccagtctcgcaatgccttgtactacatttctatcagcacttgcctgaggctgtgagagtttatgctgcaaagagagcccgtatgttcattttcatgaatcagtgtcgggttttgaaaagcagttgttacagcgctaaatggactgtaataaattacaccccctccagacccgttgagtaaatcagaactgtttatatccatccaagtggtcttttgagtataaatgacttttgtttacttatcaaaccaaatgtttgtctccaggaaatggaggcagatgatttgttcattttttaatcctgtgaatagcacttcactgctgtgaaaccagagaggaaattctgtgtattgttaggtagaaaagtgccacctatccccaccctcccataagtgaaatatcccaaagtcgttttcaaggctggagacactttattgtaattctgcaactctgagtagcagcctgtctctacccactacctcatatgtggcaacaatgcagagctcggaaaagcatggcttcttgtcccagtcatttctatgagaagaaagtgaattttgtaaaatacatttctctctctttggattgcttgtctccacttctttatgaaggatgtgtgttgcttgatacttatttacttgggagtcaagagagaactgttgaaatgtatgcattccttttgcaaattagacttatcagaggtctgccccttcttggtaggacatagatattgcagttttattgtagtagctctatggttatgaaatacctgcttcatatttaatactagatgaaagaactatctcctggctttcttcttggcttttttgatgggccattgtcttcttccacttaacatctcctgtgaggttattaggctatattaataatgtcttcttcaggccgggtgtggtggctcatgcctgtaatcctagaactttgggaggctgaggcaggtggatcacctgaggtcaggagttcgagaccagcctggccaacatggcgaaaccctgtctctactaaaaatacaaagaattagccaagtgtggtggcaggcgccagcaatcccagctactcgggaggctgaggcaatgagaatcgcttgaacctgggaggcggaaattgcagtgagccgagatcacaccattgcactccagcctgggcaacagagcaaaacttcatctcaaaaaaaaaaaaaaaaagtcttcttcaaggaagccctgataatcctttcttattacattttttcttactgtgttaaatatacataacataaaatgtcaaaatttgccattttaacatttttaagcatacaattcagtagcgttaaatgcattcacaatcttgtataaccatcaccactatctatttgcagaatgtttttttatcattccaaacagaaactctttacctcttaagcaataacttcccattttccatttcctcctgcccctggtaatctctcttctactttccatctttatgaatttgcctatttcaaatacctcatataaatggaatgatgccatatttgtccttttgcatctggcttatttcactaagcacggtgttttcaaggttcatccatgttgtggcatgtgtcagaccctcattcctttttatggctgaataatattgcattgcctgtgtgcgccttcttttgtttatctgttcttctgttgatgggcacttgggtttccaccctttggctactgtgaaataatgctgctgtgaagtttggtgtacaagtatctgtgtgagtacctgctttcagttcttctggatatatatctagaagtagaattgctgcgttaaatggtaattttatggttaagtttttgcagaactgccaaactggtttccacagtgtcagcatgattttacattccagtcagcagtgcatgatggttcaactttttccatatccttcccaactcttgttgttttccgtttttttgataatagccttcctaatgggtgtaaagtggaatctgatcatgagtttgatttgcgtttcactgatggctaatgatgttgagcatttttttcatgtgcttcttggccatttatgtatcgtctttggagaaatgcctgttcaagtcatttgcacatttttaaattgggttgtttggttttttgtcgttgttgtaggagttctttattatgttctggatacaaatccttttaagctatgatttccaagtattttttttcccattctgtgggttgtctttttactctctttttagtatcttttgcacaaaagttttttttttattttgataaagtccaagttatctagtttttcttttgttgcctgtgcttttggtgtcatatttaagaaaccattgtcaaatccaaggttataaagatttatttttgtttttttaagagttttatagttatagttttagctcttaagatctttcattaattttaagttgatttttgtatacaatgtaaggtaaggatctaactctattctttggtatgtggatatcccgttttcccaacattgtttattgaaaagactccttttcccagtgagtggtcttagcacacttgtcaaaaatcagttgaccgtatatttgagggtttatattgcagcttttgtagtgagttttgaaatcaggaaatgtgatccctctaattttgttctttcttttcaggttatgttggctatttgatgtgccttggaattccatatgaattttacaatgggtttttctatttatgcaaaaaacagattttgagattttgatggaaattgaattgaatctgtagattgttttgggtactattgtcatcttaacaatattaagtcttccagtccatgaacacgggatgatgtctttctatttatttaggtatttaatactttctttaagcatttttaatagttttatctgtgcctgtcacctccctggttaaatttatttctgaatattatttttgatggtattgtaaatagaatttcttaatattttgttgctagggtatagaaatacaactgatttttgtgtgttgattttatatcctgcaactttgctgaatttattagctctatcagtttttttgtggattctctagtattttctataataagtttacatcctctgtgaacaaagataattgtacttctttctttccaatttgggtgctttatttctagtctatttgctctgactagaatttacagtattgtattgaacagaggtggcacaagtgggcatcgttgtttggtttctgattttggaggaaagcattattatttcaccattgaatgtgatgtttagctctgggtttttcatatacgaccgtgatcatgttgaacactaatagcctgatttgcttgttttctggactctttaatctaaggtaatcattaatctatgaagaagtgggtggtggagttgtcaactgctcagtgatcttgtaacccacccctgccttcactggttaggttgggttgccccactccatagccttctagggctaccttaaaggtaccagtaacaccccatttatgcctgtgcatccttttcccctaagaatcctcttcgtttacacgatttagtggatcctgacctagccctgctcatcttctgtctgtcctagatagttcagcttcttcctttcaagatgcttccatcccagtgcttaccctccactctagagaccacttaccaggccactaaggacctccttttaactgtctgcttattcctgttgcacttaactcccaaattgcaccatatgctgggaacaatcttaactccctacccagtcctcctaacttccctcattcaccaagtcttcttctttaattagccgtctctaaaactcttatgtcaggatatttccaaaatgaatgacaaaaacagagttaatttaccgtggccagtcttgttttgaaatatgaaacttccccacacatgctgaaaatattttgtcctgttctctgttgtatattctttctctcgtttgttctctggactttattattcctttattggcatttaatgcacacctaagctacaaagagggctttgcattattctctgcttaactcctattttagagcatcatacaaagttatttttatcatttttaccaaaagcaatacaagctcacggggggaaaagtcaaataatgtaggagtgtacaaagtaaaaccagaaattttgtagtgaagttttatagtttctttcatatagatactacatatttttcctctccctcctctgtatgttgtagaaatagtcattaatacctataagggtggacattatactggcagaaagatttgcccaatttaaaaatgggcaaatgacttgaacaggcatttctccaaagacgatacataaatggccaagaagcacatgaaaaaaatgctcaacatcattagccatcagtgaaacgcaaatcaaactcatgatcagattccactttacacccattagaaaggctattatcaaaaaaacggaaaacaacaagagttgggaaggatatggaaaaagttgaaccatcatgcactgctgactggaatgtaaaatcatgctgacactgtggaaaccagtttggcagttctgcaaaaacttaaccataaaattaccatttaatgcagcaattctacttctagatatatatccagaagaactgaaagcaggtactcacacagatacttgtacaccaaacctcacagcagcattatttcacagtagccaaagggtggaaacccaagtgcccatcaacagaagaacagataaacaaaagaaggcacacacagacatagagaccaatagactaggatagaaagcccagaaataactcccacatgtatggtcaaatgatttttgaccagagtgctaagaacattcaatagagaacattcttaacaaatgagctaggaaaactggctatccacataaaaaaaaaatgaagttggagtcttaccttataccatatacaaaaattaactcaaaatggatcaaagacctaaatgcaggacctaaaattatgaaagtcttagaagaaaacagaggaaaagcttcattacattggatttggcgatgacttcttggatatgacattaaaggctcaggtaacaaaaggaaaaaaaaattggacttgatgttgaaaatctgtacatcaaaagacactattcaacagagttaagaggcacaaccttcagaatgggagaaaatatttgcaaatcatatgtctgataaggaattaatatccaaaatacacagagatctgctaaaactcagcaacagcaaaacaacccatttcaaaaatggccaaaggacttgaacagacatttctccaaagaagatatagtaatggctaatacgcatatgaaaggatgctcaatatctaatcattagggaatgcaaataagaatgacaatgagatactgcctcacacacattaggatggctactataaaaacaatgacaaatgttgacaaggatgtggaataattgggacccttgggcactattggtgggaatgtgaagtgctatagcctttatgcaaacagtatggtgggtcttcaaaatatgaacccaaattaccacatgatccagcaattacacttcttgatatttaccccaaagaagtgaaagcagggtccagagatatttgtacactcaatgttcacagcagcataaatgggggtcaacctaagtgtccatcaacagagggtggacaaagaaaatgtggcgcatgcatgagcgtgtgcgcacacacaccccctccccccccccacacatatgcaatggaatattaaaggaaggaaaatctgactcatgttataacatggatgaaccttgaggacattatgctaagttacatgtcgttcacaagaagacaaatactgtatgattccacatgtttaaggtacttagagtagtcaaaacatagaggcaaaaagtggagtagtggttgctgggtgttgaggggaggacagaatggagagttatcgtttttttgggtatagagttacagtttgagaacataaaaagttctggagatggagggtggtgatggttacacagcagcctgaatgaacttaattgctattgaactgtacacttaaaaaatggttaggatggtaaattttatgtttacatgtatttcaccaccaaaaaaataggaagaaaagaaaaaagtatggacattttatttatatcaagtatcttttttgcatgtatcaaaatgataacattattttctctttatttatgtagtaagtcacattgatgaatgtcctaatgtggaatgattcttatattcctggaataaatcttatctggttatgaggtattgtccttttagtacattgctggattcaggttgtttgtatttatttaggacatctgcacttatatccagaagtgagcttggctttctatcccagtttgtggtatccttgtaatgttgttatatcatggttatgtataacatgaaacagaagccatcatcttcctttattctctgggacattttaagtgacataggtatgacaacatcttggtatttgaataaaattgcccatgaccatctaggccttggtctttttggagatggggggtaaatcttttgattaacttttctgtttcttttatggtaatcttttaaaaacaagctttcttcctcagttttggcaatgtgtctttctttaaagagaaatatcaattttccttttcctttttatttgagtcagggtctcaatgtgtcacccaggctggagtgaagtggtgtgatcatggctcactgcaaccccaacctcgcaggtttagttcatcctcctgcctcagcctcctgagtagctgggactacaggcgcgtgccaccacacccagctaatttttaattttttgtagcgatggggtttagccatgttgccgaagctggtcttgaactcctgagctcaagtgatctgcttgccttggcctcccaaggttttgggattacaggtgtgagccactgtgcctggcctatttttcattttaaacttgatataaaattgcaatgatgatctctcaaatttttaaaaacactatacctgtggttctggaggtacatctcaagtttattgcttttctttttgtttattttcttgtgttcatagtcagattttccagaggttcgttggttttattggtgatttcgtagcaacatcatgagtttatttgtgcatgtgtaaattttggttgatataatttatagttgtttctaaagagacttttgaacttctttatttatttctatttttttttcaatcctcacaaaaaacactggggtgttatttaagccatctgtcgcaaagaattactcccttaaggaatgtggcaaataaatcgcagagcaggaattcaaaaccagatctgactttaaacctctgcacacccctccccccaaccctatatgatgctgcttagtgaagtatacaggatatctgtgtcttagtttgggtttcacataaaagcagaaccgaagacaataaggatttgcgttttgatagcatatcaggttgttattccaaggagtaagagtgaaggatcaggaggaggaagaaaagccaacataaaattgtgaaggcaacaggtgttagattcagggctttctgcagagttcctagagagccttccagaatcattcatctgaggataaaacagagtatttaccttcccatcggcccttatctctcaatgaggtgttgaaccccctcacttctgagttgcacctgtgtacttgaaaaacagtaacaggagccctggggcaggaagtgactcatagtctcatctccatgcaggttgctgtcacagggaggtgaggtgatgctttcacagaggcattggctggagaatgagagttggcaccaggggcaacgaggacactctctcaacaggcatgtcactggaactcacacttgacagtacatttacccaaatattttctgtgcaagtaatacacagttgtctaacacttacatcctgaatttggggtgctgataattatttttatttccttaaattctgaaggtcatggggatggtggggatatgtatgtggtccatagcgaaatggacttcttcttctgctagaagcaagaggtcagggaggagtgttggaaataacgtgttaaagatccgccagcagattacaatttactgatgaaggaccccattctcaagaggatttatttttgtaagaaaagccgcaaaagcacaatgggaaagaagttatttttatctttcttaatcaaaatacattgatttaaagaaaagatgagtttaaaggtatccttcagagtatgtggttggcttttgggcttaagcactcatttgtggccaaattcttttcccttgtgtttcttggagtggggcagcattgcataatggttgagagtactgtgtttggggtctctcagacctgggtcatcacttagtaaccatataaacttgggcaccatttgacttgggcaaatttcttcccctctctaaaccttagttttcctgactgtaagttggaggtgataggatgcatttcatttagtttttgtgtggagtaagtgaaatagtgtttctaaagggcttaacactgcacccggcacatgagtggtgttcactaatttgtagttactacctttattggttgtccaggaattccatgatctccttaattattgtgtgttcctgattttgaacctgccacagttttttgaaagatttcagtggaaagattacagtcaagagtaattccaggaaacagtatgcttagtaggattagactgttgtaatttcccctccagcatcctcacacaataagcacattcaataaacacatatacaattttcagcagctcactcccctcttgctcctccctcctttgagagaaaatgatttgataaataacatggtaaaataaaactgattttgtgtcttagtcctcctgattgtttgcattttaaaaggagatggatatttaattctgaagaaacggatctttaatggtggaatttcagatattttggtccttgcttggcaggcacattttgagaacagaatccgttgccctcatttataagtagcaacctcttttgggtaaatggtaccaagcctgattcttgctttttgaagtgctttaagttgtgtttgattccaaatactatatttgtgcacccattatgatatcaaatgcttataataaaaggttatgttgtcataaaatattactattctatggtgtttcaaacataggcactatcgtgtattttagttctgttagttacttgctttggaaagcacatgaccacctacaaagttaacaagataatttggtaaatctagttgcctaaaattaatgtcccccaaacaaccgacttaatctggggaattgtccagacctctgtcagataaagcagctgtataaaaacacattgacaataattatgaaatctactacaagttttatccacaaattagatcctttgcaaaatagcattttcaaaaagtgaaaataaagtgcttcatcttaacagtatagctagctagactctaatgtttttgtctttctttctttctttcttttttttgacatggagtcttgctctgttgcccaggctggagtccaatggctcaatctcagctcactgcaacctctgcctcccaggttcaaacgattctcctgcttcagccttttgagtagctgggattacaggtgcctgccatcacgcctggctaatttttttgtatttttagtagagacagggtttcaccatggtggccaggccggtcttgaactcgtgacctcaggtgatccaccggccttagcctcccaaagtgctgggattacaggcatgagccaccgtatctggcctgtttctgtctttcataataatttccaatcagccatttcgtactttcatcaagatgaaacttgctacactgctattttttgtatttttattcatctaaaaaatacctttaaaagcagagatttaaaagacagcagtcagaaataactggaaaactggtttttcagaacatgtttctcaatgtatagttaagacagctttatttttttttcttaaatgaacagaacactgctgtttttattctctgtagttcctgatgagttgcttttttaaaaaaaaatacacactttttttttttttttgccagttgtaatcttggcgtaatacagtgttatggcctacttttccctcattttatttattttaacagttgcctcaagagctaaactcttgatgtgtgttgttccagaccttttgctatgaaattacatgcagatatgtgtttctgtagaaatgtggtttgcttggctttttaacataaggggtgttgtagtcaatgtattgttcctcagcactttccttttttcaatcaatgcttggtcttagagatcttacatgtttagtacatgtaggtctactttattattcttaactggcacctactattccacagtttggatggagcatggtttattagttaattttcttatttattggcagtcatgttatttttctttctttcttttttttttttgatgtgacaaacaaatgctgccctctccttgtgcaattgtgctggtgtttttctggggagatgaaagcctgcaagtaaggttgtattgaatactgccaaattaaccccaagactggctgcacctggttacaatcctagcagcaatgtattcctagcaatttggtattatccaacatgtacatttttgtctattgggtggatgggaaatggagtctagtggtggtttttatttccatttccatcagagccagcatggtaagggaggtgccccatccagcatctgtgcagtgcctgaagtgccaggtaactggaccatttcatccaccgtggctctctcctccctctgcaagaaaagtacaagagtgggtcacaggtcataagacaagccccggcatagtccatctctgcctaacagccacctcacactgaatcccaatcaatctccacataaaaacgctggcttttgtacaaacagaggttccggtaaagagccttgtgactttccttccttgtagttactttctcattactaggcgatctccccaaaataaaaccagaaagcagaaggccattccaccctgcactcttgttgacatgatgtggggacaattgtgtttccacttgggctgaaaaatgtgctgcctccttggtaggaaagattggggaatacgtcctttctgtgctaatgggtgtgtacgtccaggtctgcaagtttacactggcagtagttgagattcacacaaaagagcagtgcctgacaatgcaaggactggattcacagacggtgcccatcaagataccaaagagccgataatgttaggaaattcgtcatgcagaattagctaacgatttgattttgaccagttacatgattggcagtttattatgaggcagaggctgtcattacgtcacttgaagcaactcgtctacagcagctgaaggatggaggaattgaaccctaccccatttagtggctgaattccagtaaatggaaagaacctagtccaagcttgtccatcccacaggactacagccacatgcggcccagaatgactttgaatgtggcccaacacaaatttgtaaactttcttaaaacattatgagatcgttttgggattttttttaaagctcatcagttgtcgttagtgttagtgcattttacatgtggtccaagacaattattattcttccaatgtggcccagggaagccaaaaggttgaacacccaggcctagtccattattgacagaaaatgttaatgtgtctattaaggaaggaaagctcgtaatttcttgcttcagaagtaatcactcaattctaaattatcctctcttgttttgtactccatttattctgactttgagcaggcaccaaacctttagcacttaaaagaaatggagattggcgaaatcataacaaaatgatagaatttaaattctggaagttggaggtcacggagctcaaccccttcactttatttttattttatttttttgagacagagtctgactctgttgctcaggctggaatgcagtggcgcgatctcggctcactgcagcctccgcctcccgaccaaccccttcactttagatgtggaaactgaggccccagagatgacttgcccaaggggacggtatagcccttcaagacaaatactgtctgaagtcaagttttattattgtactactaaccatttcctgtcgctggagtcatagatctcagccggagctggattctatgttagcttctttgatgaatggatttctcccaacagtgggcctggggtcagccatgctgtgtttctgttagatgttccaggagcccttgctgctgctgactgggaggtgctggagctcactggggtgaatcagttcatttttcattttctccaccttgacttcatggaaggtcacatgaggtggaattgggtaattacttatctactctgaaaacacacctgtatggatttgcacagaatgtgggcctcctgtgctgctgctttgtgctttgggaacacagtggggagcttgaggcctgtggggtggagcctgccttggttgcaacccagccccggcctgctcaggcccgcccctcctcccctctgttgaaagtgtgctttaatgaacagtttttctcatcgttatcttaaatgagatgaagggaaaagcaaagtttttatattaggaagattatttggcccattttttctcctctcctctccacagggacatgaactactgggaaaaacgagatttcttgaaaactctttgacatctgggtgtctggtagctttcaaattcccagaccctatgattccatttcagactctaccattagatgccctagagtctgtggaagtcagtatcctctccacagcctgttggaagcctctctgctggcccgggacagaccatccttcccctgcgctctgctgtgttggggcccagaaggctccgcaacaagtggttgatttaaaagaaaacctggaattttaccaagcagcttacactgtgttgactgaaacactcagaatctgccaggcagcaaacagttgagtggccacccaacactttactccacccaatcacacaatgggtccttaaagtctctccctttaaaaacaaaacaggctggcgcggtagcttatgcctgtaatcctagcacttcgggaggccaaagtggatggatcacttgaggtcaggagttcgaaaccagcctggtcaacctggtgaaactctgtctctactaaaaatacaaaataataataataataataataataataataataataatagccgggcgtggtggtgggtgcctgtacttccaggtacttggaaagctgaagtaggagaatcacttgaatccgggaggcagaggttgtggtgagctgagatcgtgccactgtactccagcctgagcaacagagtgagactccatcttaaaaaacaaaacaaaacaaaaacacacacttgccaggtgcagtgtctcacacctgtaatcccttgaggccaggagtttaagatcagcctgggcaacaaagcctttctcttcaaaaaataaaacaattagctggcatggtgacgtatacctgtagtcctagctacttgggaggctgaggcaggaggatctcgcttgagcccaggagttcgagactgcaagccaactgtgacagccccattgcactgaagcctgggagagcaagaccctctctcggggaaaaaaaaaccccaaaaaacccacaaaaaacttttctgaagtatgattgacaataccgaaagctgttcttatttagtgtatacaacttggtgagtttggagataagtatacacccgtgacacgatcaccacaatctgtgccacaaacctacccatcacctgcaaaagtttcttactgtctgctttattattttgtttattcatgataagaacacttgacataagacctaccctcttagcaagtttttaagcataaaatacagtattgttaactgtaggcactaagctgcacagatttctaggacttatcttgtgtaactgaaactttgtaccctttaagcacttccctgttttccctttctctcaggccctgtagccaccattctactctgcttctgtgggtttggctattttagatttctcatgtaagtggaaatcacagagtacttgtccttccgtgtctggcttatttcacttagcacagtgtcctccaggttcattccgttgcaaatggtaagatttccttctttttaaggctgaataatattccactgtatgcatatagcacattgtccttattcatctgtctgtcagtggacatgtaggttgcttccatgcattccttgggtactgtgactagtgctgcagtaaatatgggtgtgcagataccttttcaagatcctgatttcaattctttgaatatacactcagaagtagcattcttggatcatacagtagtttattgaagtctcttctgcttggaaagtggaaagatgtgggaatttgggtctcttggatatctccttactcagctcatttttagaaggcaaacctgcaactcagttgatgccttagacttcaaagctgtctttttgcagcaaaatcatgattatctagagagatacttgggcaacagatttgtggatgtgaagaagaggaaagctcactgcagaggtctctctgggtcagcaggaggcagcgtgaggaacaccaccagcaagcttgttgtgatgcactgtggtctcttgtgaacagtcccacattcagatcctgagtacaaattctggctctgatactcagcagtcatgtgagcttgggcatgttaatctgagtctgtttttaaaatctgtcaagtaaggatgttaatatccacctccccaaagggtttttgtgaagatggtaaagtatagtgcctggaacatgataggggctcaacgaatgatagtaattattattaataattatgctaataaataatgtggactgaacttcatttcacaagcctgcttccccaagtcagcatttaccagctcctgccttaggctggtagatgagccttcctaagaattcctgtttcatttccccagcatctcctagccccgactcattaaagaaagcatctcactcctgcagttcaagtgaaaagcagtgtttccagaaacgactgttttcttggacttccttttattcttgctttctgtctttttctatcactttttgttactacaaaaatgtttcgtcctttattgtttcatagttgttttgatatagaaaattataagtgcttcttaaataaatggatgaccttggtttaggattataaaaagtatatcccccttactaccaggcatattagttagctaatgctaatatttgtgtcttttgccttttctctcaattttatctgattcagtattacaactagtaatatttgctaatggaaataattaaaagttcattttattaaaatttctgacaaataattaaatcctagagcctcattgaagcactagacaacatgagagttaactgctagcaaaaaataaatttattttaatatatatttttctttaaataccagtcatttctgtttggctgtaaggactacattcaagttaagctcctggaaggcagagttaaagaaaaatgattttgagattagctcactggtaaatcactttgaaaggctaagcctctggtaagctggaaacacagaccagacatggacagtaaccttaatcagcaagaatgcgtcttttctgtaaattatgaaaatttgatgtagtaaaaataaaacttgatttatccacttacctagcagtgcattctgtatactgaatggtacagatgacacttcagcaatttgccctgcccctaaagatgacatctctgcaatgtctagaagcttcctctttaaaatgaaaatatcaacaagagggttggcagcatgaagcttgcatgtacctcttgggtaaattagtttaattgaatgcttttctttgaagagctccaagcaatatacttaaagaataaaactgttctggagcagattgagggagggtataagttgtagtttgacagaaatgagaccctgggagtggaccaggggccacaggatacctaagaacagaaaagaagcacagatgtgaggaagatgcagaggaccaggcaaacacataatagagaaaaaatggcaccttcttctgattctgtttcaggtagtccctggtgccagtttgaagcacttactgattatctgctctcttcttacaggaagggaggggggccagtgtccattcaatgcctgttttgagctaaggagcttgctatgctatgtatatatttttaaaatcacaacagcctttaacattgttgttttcctttaatagatgaggaattgaggctcagagctgttaaatgattgcccagggtcccataactagtaagtgacccagccagaatgtaatcccaggtgtgtctgattacaggtgtttttcttctgagaacagagccttgtttcattcacagccatatcccctgtatctcgaacagtgctgggcacagagcagatgctcagtaaatgttctgtgaattacgtaaccaaattagcgccacagtgccttttatgcgtgagttttagttagttgtggaggtagattaagaaataaaaaggactaacagtagtcattgttttccttagagtactcggctcccaaagaggctcttccaacaccttggacgtgagataaaacatgttctaaaatttatacttttaaaattacggtgtaatcaaaaggccaggcagcccgtaaacctgagaatttgtgcaattggactaacatttctgattcccaggaagcttgcgcctaacagtggaaagcatttttacatgtaaattggtcagttttgagatgagctgataatttctgaaattagcagattacttatgcttgaaggagctgaggtcgccatttgttatctgactgctctttgccctgagcttcgaagccagccaataatgcagtgagtgctggacttccactctttttttcaaattaaagatttaattacagtcttcactgaagatgaaccaagtgtgaaaatacctgatctacttggaatgtgggatcagggaggagtgtgtgggttggagtcagtgcctgggcatttaaatactttcaacagtaacattaagggtgaaattaattatattgtgaccaaatgttggcgtgttggttaggcagagtcagtgaaatttatgttctttttttgttgatcattttttaaagccgaaagggtttttttccttaggagatattctcatagcctatagacttaaatctttaagacttcaaaggttttgaaagatacacatctttgaaatgtgtagagactttctttgtggactggtacatggttattttgcatacatgctttgtgtgtccctgtgaagaatgcggatttgttcattgttggatgcagaattttatatacgtggagtcaagcttacttatcttgtttacattttcagtcaattaataatgaaagtgatctatctaaaacgtatctgacggccaccccttatctatttttctaaggtagtagctttaataagcctcctttattatggagaaaaaaaaaagtctgtgtatctttttggtcttctagctttagtcattctgatatttctgttagtgtctggagtttagttatacccatccaaggacagagtttaagggtagattcgagctgcctcattaactcgccatcattgagaaatgatctgtttcacatacatgcatttattttctaaatgatgaaaatcttctcttgcagttgtcaaaggcctctgcccccccgacctttgatgacaggaaagtttatcaagtggattcttctctctcgcctgcaggaagctgacccattcttgaggttttggattcgttgccacctctgttgttgtactccctctccactgctgcttaagctgcttcttagttttcctcgccccttccttgacgtggggccagcaatcatctcttctctcttgccagagctgcctctccaccattctttccatgcatacttacctagtgtgctgatcacgattggtctaggaaacagattggctggctttgtctcatgacagtgatctttcatttattcatcaactactatttgttgagtgctggccacatgtaagtcttttaactagtggccaccaaagggctttaaagatagaaccataacatggtccctcctctggtctgtaggggagtcattagatccataatgagagtgaaagtgatagtggcacaaggaaggtggagtactgtgggcattagagaagggggattagaggaggttggcatttgagttgagtgttaagctgtggagattggggaaagtctgtgggactggcatgaactcagcatcaaaggcaggggaccttagaggtctgtgcaggcatctggagcaggagagaggctaggacgtggcataataagcacggggagaagtgggcaatcagattgctcttgaaatgccaggctagggagcttggacctttgcagaaaccaccaaaggtgtttatttaggaaagatgtcagagacgtgcttttggaagcgtaacagccaccagggtaaagtgaagcagagagagaagggaccggatagggcaccagatgccagcagagaaggcgcgaggggatgagggctggaatttagatgagggtgcggtaggatagggtcattggaaaggaaggatatgtgtaaggagggatgtggcagagttcaagagagcaggatgcagcagctgcttagatgtgggagggaggtggagtagtcttaagcttcgagtctgagctggctagagaagagggtgtgagcccaagatccaagagatgagggagggtcaggtttgttattggaggaggagaagttggtaggttcagttttttttgtttgtttttttgttgttgttgtttgggctttattttattattattattattttttagagtcttgctctgtcgccaagctggagtgcagtagtacgatcccggctcactgtaacctgtgcctcccaggttcaagcaattctcctgcctcagcctccctagtagctgggattacaggtgcgtgccaccacgcccagataatttttgtatttttagtagagacagggtttcaccatgttggccaggctggtctcggactcctgacctcgtgatctgcctgcctcggcctcccaaagtgctgggattacaggcatgagccactccgcctggccgttggttagctatttaaaatacagacatagtgctcagtaagaagtcagggaaagagacatacattgtgaagtcatttgcaatgaggtgatatttaaagccttgtgtgacaaaagagaacccagttcagcagttggagaatgtccgtgctcagggttggattagagaagaggtggtcagtggagtggggagggcctggagaaaggagagtactgtggcctgaggactggggaggagggagagggtagggcatgggcacttgtccagtgctcctgagagagggcaggaaagagcagggcaggccactggcattggtgaccagcaggttacatgtgagcatgaggaaagttttctgggagttcgacagtagccagtttgccagcattactgtgtaataaaatagagacaggacagtaggtcatgactaagggagagcaggaagaagggaaagaaggaaaagattagtataaaagaggcaaaaaacttggctggtgtggtggctcacgcctgtaatcccagcactttgggaggctgaagcaggtggatggcttgagcccaggagttcaagaccagcctgagcaacatggcgaaaccctgcctctactaaaaatgcaagaaattagctaggcatgatagtgcatgcctgtagtctcagctactggggaggctgaggtgggaggatcacctgagcccatgaaattgaggctgcagtaagccgtgatagtgccactgcactgtcgggctgtgggtatgaaaccctgtttcaaaaaaaagcagcagcaaaaaactaaatcctgcgtttcacacccattatgatggctgtcatttaaaaaataatcagtgaacggaaaataagtgttgctgagatgtgggtaagttggaactcttgtgcattaccagtggggatgtgaaatgatgttgtggaaacccatatggcagttctcaaaaaattaaagatggaattaccatacggtccagcagttctgctctgggtaaataccccaaagaattgaaagcagggtgtcaaagagatatttgtacacccatgttcatatcagcgttattcaaaggtggatgcaacgcaaatgaccattagtgcatggatggataaacaaaaggtgtatacttatacaatggaatgttatttcgtctttaaaaggaaggaaattctgatgtattctacaacatggatgaaacttgagaacgttatgctaagtaaaataagccagacacaaacggacaaatactgtatgagtccatttatatgaggtacctacagtagtcaaaatcgtagagccagaaagtagaatggtggttgccaggagttgaggggagaagaggatggacagttgttgtttaatgggtacagaatttcagtttgggaagatgaagaagttttggagatggatggtggcagtggttgtgaatgtacttcaaatgcatgtatttcactgaacgctacacttgaaaatggttaagggccaggtgtggtggctcatgccggtaatcccagcactttgggaagctgaggcaagaggatcacctgagcccagaagtttgaggctgcagtgagttatgattgagccattgcactccagcctgggagacagagcaagaccctgtctcaaaaaaaaaaaaaacaaaaaacaaaaaacccaaaatttaaaaggccatacagacaatttttaaatgatgaaatgataaatgttctgctatgtgtattttactacaataaaaaattaagcaaatgctggaagaagccaatttgttgaccaggggaagaaataattaaataaaaatttatctcatgctttggtaaataactgccagcctttctttccttaagttcagagcctcgctctcttgacccagtaccaacaggccctttctgggatcatctcacccagagatcataggtggttgttctgagaagccccttaagaaagtctacaattaagtttggcttcaggtgggctgcagctagggagaaaaaggaaacccttttttgttttccctttaatttttattttagattcagcgggttcatgtgcaggtttgttacgtcagcatattgcatgaagctgaggcttggggtatgaatgatcctgtcacccaggtactgagcatagtacccaacagttaatttttcaacccttgcctccccgccagtagtccccagtgttgatcgctgccatctttatgtccatacccaatggaacatcttttcttgaaggcagactaaaatacctgttgaaacatgagcatgagctcacctgtcctgaaacaattaaaaatatcataaacacctggagagaagaaggcacagtaacaataacattccatgaatgccttatattgcctacagactaaacctctttagggttaaagtcctttcttggggctaattggacagaagataccacaaaaatgttttaagaaatacatgtattaaagaattttagcaattggagtcttatgcaatgtatagaaatattatttcagaaaagcctacacagtctgtgctgttattttcttatttctcttcagccctaatgtgaaccattcctaaacagtgtgcacttgcttctgtaatctgaacttaccttatcatccatgatggccgtgttatatttaggtggtaaaataacatgtgcaactttgagtaggcatgtattctcctgtctggaaatgcctaaaatgttcaatcttgattgtttttcgatccgtagatgttctatttagatgtgtcctggtatttgcttcctccttctattttagaagaaaatattgagctgagggcagtggctcgcgcctgtaatcccagcactttgggaggctgaggcaggtggatcacctgaggtcaggagttcgagaccagcctgaccaacatggcgaaacactggctctactaaaaatacaaaaattagccagatgtggtggcgggcgcctgtaatcctagctacttgggaggctgaggcatgagaatcacctgaacccgcaggcggaggttgcagcgattggagattgtgccactgcattccagcttgggggatagagcgagactctgtttttaaaaaaagaagaaaaagatgaaaaatattaataatttatgaatcttaaattttcattaatgctagttataaagaaacagaaggaaatagttggcatagtatgataagccaacattgaagttttgtgtgttacatgtaatgttcaccctaaatagtattaatagttgctttttgaagaatatgagtctcccagtagtaaagagaaaataatttgctgtatgcaatcctctaccgtgctactagcatatcatttgtgccacaatatttattttcaaattataagctgcaaattctataaaattctacttgagaaatggcttgggaactttctctcatatccacttaattgcaaagtgtcagaatatttttatttttggagatggagtcttgctctgtcactgaggctggagtgcaatggcgtgatctcagcttactgcaacctccacctcctggcttcaagtgattctcctgcctcagcctcccaagtagctgggattacaggcgcacaccaccacacccagctgatttttgtatttttagtagagacagggtttcaccatgttggacaggctggtctcaaactcctgacctcaggtgatccacccgcctggacctcctaactctccgggggttacaggcgtgagccaccacgcctggtccagaatatttttaaatgaaaaactttctaaaaaccatatagctaaagatgcacatcctaagtgtaaatattttgttaatcattgtgttttattagagattatataaatctaaagtgaaaggctaactgcagtttgtggattagataggaaaccaagctcattggcgctctggatgagaaggcagtgttgacattattgtgaccagctcctctggcagtggtgttgactccaaaactgtaatcctttttcttagccttaacgagatgcccatcaaggttgggatttccatcacaccttaccctttcagactggagcatctgtgattcttctgcaaggctgctttaaaattttctcatactgcaaaatatctggacagccaacctagtttgtagagtggcaaatgtcacagcctactttatgggtttgattacttttgtatctgagaaaacagctttcccagaatcaaatgataagtctatttcagagacgactcgtagagcatcttctttgcccagcctgccttcgttactgagatgatcacgtatatatttaagtctgttttcaaatgcacttgtggtgtgtgtggccaacccagtcatggcacctatatgtggatctgagcactcatttgcattgcacagagtccctgaggaactcattaaaagctgggggcctttggcctgggctgacagggtcctggtgccaccacttgtcagagggtgtgtttgatgctgcttttccctttgcctctgtgtccaggctttgcatagagtcactatgtagtcactacaggcagaattgattcaaacacttgtactctaaactccttaaactggttttattgttgttgttgttgttttgttttgttttttgttttttgagatggagtcttgctctgttgcccaggctggagtgcagtggcactatcttggctcactgccactctgcctcctgggttgaagcgattctcctgcctcagcctcccgagtagctgggattacaggcatgtgctactatgcccggctaatttttgtatttccagtagagatggggttttgccatgttggcccaggctcgtcttgagctcctgacctctggtgatccacctacctcagcctcccaaagtgctaggattacaggcgtgacccaccgcacccagccaccttaaactggttttagacttgagactgtctgccagtgcatgcatgggttagtcctgttttatggttgcagtgtgtcttgtgaaggctacattccattgtttttctcactcatgcatccattattaaacacccactatgtgctctgcactgtgctggacatggacaatggatggtagacattcgcagctcaatttccatttacccgaggtttgtcttttaccttgtggactttgtgtctttgcctccaggtggttctcctggctctttgccctagcctgattcagtggagtcggcttgcctgttggcccagcctcaggaatggttaagtgtcactgaaggcctatacatgatgccgtgaaaagcacaaacaataggctcaggttttagcttggaattcattttaactttcagtcttttggtgtgtaaagagggatgaagaaagcaattgttgactttccttcacatcagaattgaaacttgtccaagaacattcagaggtgttgggtgtgttgtcactttttttcctttctcaaccaatgtttaataaaaatcctattaatttccaatggagtacagacactcacaattctttcctggagaagagtataggcttctgccagaggagaggggacagaaaataatgagtaacgagtgtatagacctttagggtttacaaactattttgtctccttgatcctcaatgcaactttgtgagatatttattaccttcctttacaattgaggaaactgaggcacagggtgtttattgaggtgccagtgtggatggcagagctcctggtctttctggacaattctcagacggtggctgctcctggctgaggggtacgagctgggcttggcccagcctgacaggtactcctaagtgagaggagccagccagaagcaggcctccctcagccctcctgcctagcgtgcagtgtggtgggaaaacagtctcccagaaaggaggctgtgtttctgctgcctcttcgagctcaagaaagatgaagtagggtggggtggggcaggtgtagacaagggaagtggagtgggggagcagtgctgagaagtgacgctaggaacagggctcagttcagacagcatcaggtgctgagatgtggttgtcaccgggccacacgtgtgggtgaccacaggagggaacgtagcacttaatggggccccacgccttgtgtagaatcctcctaagtgctctactgtatccccaattttacacatgaggaagcagagacatggagaggttaagggacctgtccaaggtcttcaggtagtaagacagcccacctccggagcccacacctgacccctctactctgttgcattctgacccagggacagtttctggaatgcctcgttttaattccctttagtaacaacatcctgcagcaaacccacacactgggtaactctttgctcttctctcctcagaacgcaagcctcgttgtgacagggctccaggaacccagtaattgtagattaggaacagatgagacccgtacttatttggagacattgacacctgtgccatgtacttcccagagttcccaacttttaggacaaacttaggctcaaaaaccacagattcttccttcctccaaatgctagtctgaagggatggtttgcttgatcgtgggataataatgctattttctgtttggtttataaagtatgttcacagacattctggtgtttgatttgatgccagccatcttctcacctccctcctcaaaaagattgaaaaaggcagaactgatgttaacaaaggccgttcaagtgaggaataggttgttttgcctcttggatgtgaccttcaggctattacatagtaaacatgtattcctggttctctgaaaaaggcaacatgtatgtgtggcctggaataaacagaccttgtactaaatcctgatatgattctgatgcgttcaaaagcaagaatcttctcacattaagacatggagatttagacagctgacagaggaattaaggaaactaatatttgttgagtaaacattactccagtcatcttcactactatctgttattacccccttttcacagatggagaaactagggcgcaggatgcttaaacaatgtcccaggtaccagaggagttttcttaaaagtctaggtcgtgtttattttactggagagcagaggagagcaaagagttagccagtctgtggttttactgcaggatgttgttactaaagggaattaaaagccccacgatgattaggtgttaagacttaatatattttggttaaaacatagttttagagtgactttgactgtttggattgcgtgtatcaccaaatgcgacacccctggacgggactggtcaactgagtcagtaaaagtgagtcagcccctcgtgtgcacgcttgctcacctctgagagggtttaggaagagatgtcagtgggaggaaagttcccacaactgactgagtttgggggcaagggagcagtctggagcatcaccattgctgacaggcaagaagggttttttggaaggtgaggagtgaggggagaggaggtacttcaaagggtgctgagcccctatcagggtagggctgctgccatggacatgttgattattcatggctttgagacacaagttgcttgtggtgacctcctccatgaaacaagcagggaatttggggacccaccagctttctatgctgtggtccaggagggcttgggtggggtggggtggggtggaggtggcactggggacccaccagctgccatgctgtggtccaggagggcctgggtggggtggaggtggcattggagaaggaacgcctggccgtgagctaattttgcttgagtccctggttggggtataaggctgaatgcgccccttctttctcttccctttttgcataccatgttaatataaacaaaaaaggcttcttccctttgcttctcggttgaactctgtaagtgggggagtaagtttgatgggtgcattatcacttagtttcacaagcagcagggaaactaatctgcagctacagtaggaccagactgtgagcccagattctcagactcccgggccagtgctcccccaacctctgacatgctgcagaaggatgcttgcttggctctgttccttttgagagttaaaaaattggcctactattattttgtgaattgtgtgtacattatgttttacataaaatttagagggaaagaggtaatgttgcataaatatgtactttctgttaagttcacctagtttttaaagtatgctatttgccagtgcttgcaaaggttgtgatagttgtatcaacgaggaagcactgataatttacctgattccatctataggatctttcatttaatttacctgatgccatctataggttctttcatttacagtgattggccagttctctctacaatacgcaaagtgcagagctagcccccttcaaaaccgatactcgattttaaagctgataactaagatatggtgttacggaaaacacaatcctatgctccactctctcatcactactctttaattgcactcgggggaaaaacacatttaattgtttcaacgatcattacttttttttagtaaatttatagtaaatggaggagattaccaaagggctatttttttctcagcttgtggtttctaattacatcagttacagctcagccttcttcttaactagagtgcaggcatgaactggaaaagaatgagctaatccatgatagatcaggtggaataaagatctccattcatatctttaccttttatcccttgttctgagtgccaagaattaatgctatttgaaagtacaaactgaacctgccaagcttcggacagctaagataatcctaattattttaaatgttagtgagaagggcagcagttccactctggaaaagagttctattgtgaaacattaaatatatgctaagtggtattgattgcacatgattttatttccaaacactatggttatcatgaagtggaagaatttgttgtttaagaaattttcatcagcttttcatcagattctttcttatgcctacaaactctaggaaactgaagaggccagcaattttgtttgtctgccttggcagtcagcatctagatgaagagttggtaacaactgaaaaatgccacttgtattttattttaaaatggtttcttaggagtttaatagtgtttaacatatagaggaaggaaaaatgtttttaaagcatgaatatcctgttttctcacatcactggaagagaattattcgttccagtccattgacttccaacagatcattcaagttaaaagtcaggggtctttgcaatgtcaaaagatttagcacttagagttttgtggttttttttttaagaaggttttcttttttgacagtataaatatttttcaaaaataatactcatggttagatggcatcaaaatcatcttgaagtgttttttcccctcattggtaagaatgatcctgtgtaaggttttctgtttatttttaaatcataataaaataacatcccagtagcttcggtagacaaataggcttcttgagagaaaacagatactagatttgctggttcaaacaagggtcagcctcggaggtttacccacctttcattgtaacacaaaaaaatatcagatgggcaagttttccttttttcttttccttacttttcagtctctgctgtggtgtgcagaaataatttcttctatttctgtaaatgctgggaggctatcaatgattatagggtagtataatccttaattgtttattgcctgtgaatgcttcctgcccccaaccccagtgcagctggccccaactcccttccccaagcacaagagcagtacactaacatcttcactgacggtgtgttgagcatctcaggctcaattattcttcctttcttcggggttattccccagagtggaattaccaggtcagaggggctgaacagctttatggttcttattacatgtcactagattgctgtccagagagattgaaccaatttctagtgctaccaatactatctgttcccccacagtgccactgacgctaggagttagcatttttacaaaatgacctaagacaagacttttgagttgaaattagcctggtgtagggccccttagaatcaaagagcgaaaagcatcattttgatttttgaatttttaattggtatgaaataatttacaacggtcaactattagccttctccttccaaaagtttaaggaagctgcattaaaatggaaaaggtacctctgagggacgatctttaaggatggtagtaaaagtgattttggacattagtcactaaggaaaaacacactaaatcttttcatgtacctagaactctatgaggggctatacttaaacagatactatccctaacttcaacagcctattatttaaaaacaatgctaagccttgaacaaatgtaaaaatagcatgggtttaaattttgagtggagaaacactataaacaatacggctgtttttcaaaacagggtgagttttacattttctctagagtgcagtcatgcattaaaagtatgcttggagccccgctagtccatgcaggtaatattctgcatgctttgtggccccacgtcgcaagagcactttccaagaaaatattcataaggcaagttagagcaaaagggggatattgtcaaattcctttcttttgcaaaattcccactcctccccttttcagtcccaagttggctaaatgaggagagggcatctcccggggcatctcccagtcagctgctaactggaaacaggcccagggctctgaacatgttgggagaacacatacctattcctttacaagcctctgcatcagcttggcaaaggtccgttgctttgcctccttaaactcacacagggattgggaaggttcagctgccagttctgaaatgtggggcccaggagaaggttggtgcaggggccagagcacgccagagtcagcctaatcagtacagtgctgcccttgacagcttgcacaggatccctgtgttaaacggggagagtaattctctcagtgaatggtttgagggtgaaatacctcactaaagtatgtgtgtggcatacaggtagtagtcagtaatgtttactgttcttctccatagcttctatacagagaaacttctgtcactggttgggggtggggacattaacgcacggactccaggaagctcttagtcggctctccagatctgtatagtaacaagatctcaaagcagtctgctgcctttggaaaacatttctctgtacatatatatgacaaccaggtgcatgtatacaattaataaatcaccttggatttgcatggaatttaaatgcatataacaatacaaatttagtaagatacttttatgaactgtaataagatgaaggcttcagatttcctagattcctagttttggttgctatatttatatatgcatatgcgtgcttttttgttatgaaatactacttaatgactccctttaaattaaaaaaaaatattttcctatattttaaagcttacaaacttatcctttgctttttatttaccttattaaagactaaacaaatctatcaatataaaaagtaaccacttgtcaggaaattgcctaaattgtttttcaaatttattcacttactgaattttcagatcatctctttccttcttggatattgaggtagctgtacaaaactatccatttgtctatctgtctacccatatgtcacactggaagaagggggccttctgaaagaatgtggtccagtggagtggttaagggcctgcttcttaaatcctagctctgttcttttatttctgtgtggtaccactagctgcagcaaaccttttccaaacccgtaacgagtgtaaatagtgttcagttgtaaaaaggtctcttttcagcatggtaatataccttattaaattccaaacataataagtattgatggcaaacacatcaggacccagtgcagcttctactatgatttagttctctacaaatgacttcagcactcagctcccaatgcattttgctaattacatcatagatttccctattgatgaacacaagctgaattaacacaggagcactaatgtaccctttcaccattattgttgtacaagaagccgtggcagatgctggcagttagttacacaaacattagtattaacgattggccatttggaattggtgacaaactactgcccggcagaatcctgaggctgaaaccaatcaggaagttaatgaggagagaaattaccactgcagcttccccttaattacattcacactaggcaggaagggagttctgggggtggatctaaactcagctaaggttaagaaggtcagagacccttttgcttaagttttttatctactgtggctgctaaggttgcaaaagttgcttaacacattattacttttgcatccttcatatttaatgtgggttttccagtggagttttatgttcctaggtttgctttcacaatttatctgacttctattttagtgtgatgtaatttatttacttttctgtttttacaatttttctctcccatttactgtcttttactttttaaaagttatgtatgctgacatccctttcccccgtctttgtcctgttatgccaagagaaataatagtaaagttaatatgctatccacttcacctgctgtatcttgaaaaagtagggtgggttacctgtcgtggtggaaatgcatgggtggagtcttgcttgaggtaatgtgtcagatggatcacttgacaagtttcatcagcatactttgcataaaggggaggagtccggtgaagggtggaaatagtttcccaaagaggatgcagccgacttgttttgttttttaatgaacgttaaactggaactctgctatctagcttactcctttcgttaaataggtatactgtgtagaatactatttttttattctaaagaaatgctaggagttttaatgagtgtctataaaaacactttcaactcagaatagaaatggagagcgtcactttctttgttgtaacctaattgaataatgaatgtataaagaccagccacttttaacattactccctttctccctttctctctttctctctcacctcacttcccagtattctcgccgcccagcagtcaagattctggcttggtttccctctcgagcagctctcctattagtaacaagagcacaaaggcagtgcttgaatgtgagcctgcgtcggagcccagcagcttcacagtcactcccgtcatcgaggaggacgagtgagcagtgcctgctgccgatggcggttcacttggagtaacaggcttattccactttccatggggtttgttaatattttgcattgactcatactatcttaactgttgagaacgtatttggtttatattccttagagtttagtccagaggctgtaacacatttgtaatactttagggtccgtgactaccatctgcatgatttaagtgctttactcacggagtttaaataatagtgttcatttttttaatgacactggtttcatgtagttttcaagaaataaaagaattcattcaagtgaagccatttgtgtgcctctaaatgagtcatctaattagatgttacttttagttttaaaatgaaatcttaggtgccttaggggtttttttttttttaagtattttttaaaaacctgcaaagatataaatttagccaagttacctgacgggtgagaagaaaagagcaggcaaaattagtgatttttttagaagtctgctaaatggatatattgtgtgtgttgctgttggaaatagccccaccccatcctcccaatccaaaacgtaactgaaatataatcagaaacattaaagcctgtaaaaaaaaattgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatggagtactttgttatataacagaagccatcctgaaatgaaactagtctaaaaaaattcattgttctacttagttgcagctgtacctgaaataaaaatgttattgatgactgaattttcttgtgtgtatatttggtgagcggtattaaacaggaaaaaagaaattacttgtattttcttcgctctgtgctttgaaaacatctatttgatttcacccccatctgttgtaatcaataacctgaccatcttgttttttattaaatgcacttactcttaatttcatccaccagtggttttagagagaataatgtggagttacctatataggtttgacattataaatcacttcttggggctgaatcgtatagcggtatcgattgatcctgatatatcacagaaatttactgtcacttctgttttcaattaaagatacaatcagtcagataatgacttaattggattttacagaagattgagttttattgcccagtgctttacgagtttagttaaggaagatcattttatcacacttgtcaggctgctgctactgcagccgtgtgcccttcggcgggcggctgtagctgtagctgttgtgacggctacggcggaggctgcgggcgcgcggggaatggagccggaccgcggagtcgtcacctccaaggtgtttctagtggcctcctggaagatgatcccgcgcccaccttgccggcgtgttcgcgggcccctgcccactgccccccctctttctttaggtctggcttttgaggatcccggagtcttgcagctcccgccattccgcagataacctccgcacacttaattgtgacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttctaaacccaccggcctcgcctaacgccgtttggtgctgcatccgagcggcctcacgcggtcccctggaagggccactcccagcgggagggcggggcccgggacctccgctggccacgcagggtctcaagctgaccggaagacccggcttttggcctgtgtccaatagccccagaagagaggggtctggagccttcctcccacgcgtagtgacgctcaggtgtcctcgggttgttagtcttgacccaggagagtgcaagacaggcccaaggcctggggggattgcgttatgaatgtccaattctaaacacaaggtagagcacagacagtacatcctcacggctggattttaaccgtattttaataaacacattcgagggggtgtcagtttccccaagctctgcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggttttgcagatgtttgggtgctacggtgtggggaaacccaggcaggagcgccaggcctaattctcctggactcttggtgagcggccgctactccacgaggggctagaagcaaagggagcacgcgcttttccccaggccgcctcttgctgccgcagtggctgagggcgctgatgacccctccccgcttccagcggacttgacccgctggctgacaacccaccgcgacaagcaggcggctgggttcgcgccgccgccccggggcccttggctcaaatttcacctcgagtcctgcagaccctgcgccactgaattggggcccaggacgcccttggtgacactcgccttcttgctgccacaaccaccgtcatacccgcagccggggctccctccgctaaccacgcttggagaccccaatcggggacagaggtgggagtcggaccccccctggcctgcactgcc

SEQ ID NO: 12894 - DNA, 23257 bp, Human
aaaacaaaaactgaattcacgatcattcccctgacaaccccccgcccgtcccttggccaaagtgattatcttccagggcccttggtcagggaatagtgtcattattccttcagttatgcagctgaaaatcttgacacttctacctcccatccaacccaccatccagccctgtcaactttacctcttaaacatgttttcttaatgccccttttttactctctctgtctccttctttctcttcctctctctctctccctgccaccctttttcaagctccagcagttcttgcctggagtattgcaacatccaactgttctgccctaatccactctagcaatccccgctatagagggaccttttaaaatgcaaatctgacctggattcacttctgcttaaagcttatgactggtttcctttaattcttggataagcacaaaacttctcggtatggctaaggctctgcttcctccggctccagcttcaactcacaccacactccattcaggtcgattagctcaaacccctcagatattcctcagcctttgtactcactgtgcttcctcctgccatccagcctttgcacgcctgattccctctgcttagaggagttccctcctttctttgtaaaaggcatcagatctcacaccaagctctcattacaaaagcctttcctgtcctacctctcaagatctcgttattgtaaatactcaaagtatcattaacctctaatgtttcaatttacagcaataattcaacatttgtttgttttggagacggtgtctccctctgtcgcccaggctggagtgcagtggtgtgatcatggcttatcatagcctccacctctcggcctcaggtgatccttccacctcagcctccagagtagctgggactacaggcacgcaccaccacgcccggctaatttttagtagagaagcggtttcgctatgttgccaggctggtctcgaactcgtgacctcaagtgatccacccgcctcggcctcctaaagtgctgggattacaggcgtgagccactatgcccagcccacatttgtttatttgattaaaatgtctgtgcccctcttccaggattgggctgtgagcccaggggaaggaaagaaccttgtctgccattgtatcttcagggcctagcggtgcctggcgcacagcagttgctcaactagactggttgactaagtaaataaataaagcactacggtctattatatccgaaggcttggcttcgggaggggcaaaagacaggtttcgcgctgaggtagggttcatggtgccgacattttttttcaagatggaagaaagcggagataatacgcagccctcaaaggaacttagtctaatcggggggagcagacgatcgttcactgtgggaaaatggggtacgatttcccccagtgaggaaatcaactaaagccgagctttgaaaaggggagcagaggagcctgaggggaagcgggggcgtgtcgcctggcgtgaccagcgcggcagggaaagcgggcccagggacccgggcctgtcacgccgcttccgcgcgtccccaaactctccctcggctcgcccacccacgcggcggggacccctccggcccctccccggccccacggccacttcttcccccacaagccggcctgcggtccgccttaccagcccgggccggacggggccgcagctcctggcagaccgcacagccttcgagcccggaatgccgagacaaggccggcgccgattggcgacgttccgtcacgtgaccttaacgctccgccggcgccaatttcaaacagcggaacaaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggaggtgagcgggatgcagcaatggagtcccaggcctggcctgggcacaggcggggagcaaggcctccgggcgcggaggtcagggcgtctagcagcagggcacgggccacgagtggagatttgggtcacacgggaagaatctgagccagggtgcaagttttttctgcgtccacctcctggccgtggccttctcactgcttaaagcgccccttggccttccctggaagtctgacctccgcaccctgcccgcggcctcgggagggctggggtggcctaccttcttaggccgactgtggctgagatgaagactgagattgtactacattgagtcaaagaccaacctgcatacacactcccctgctcccaggctgtctcaccactaggcaacaccgcctccatcttacttacccttttgcagggcccttttcctggttcttgagaatgtagcaagatttccccgctcaggatggggatgggtcggaggagccactctggaagtttcccgggcaagaaagtgttggcaataataataacgggctggtcaggaagtagaagagaaaattaagacttagatatcctgtggaaaaagaggaataatatctactgattgatgcggggagagagggaagcctggaaagatcggaggtgaaagtaaaactgagatttgaaggtagaggtgtggagggcctgtgaactctatgcagatgacaaatgtcaaaaaagtgcagttgcttttcagggagagaataagtgtcctaaaaaagagacagccaattcctctgtcttccaaagttccgtgaaatagaattacacaattttgcttaatggtagaatattccatgtatctattaaaatcaacaaaaggccgggcgcagtggctcacgcctgtaatcccagcactttgggaggccgaggcgggtggatcacctgaggagttcaagaccagcctggcaaacatggtgaaaccctgtttctactaaaaaaaaaaaaaaaattagctgggcatggtggtgcatgcctgtaattgcagctactcgggaggctgaggcaggagaatcgcttgaacccgggaggccgaggttgcagtgagctgagattgcgccattgcactccagcctgggtgacaagagcgaagctccgtctcaaaaaaaaaaaaaaaattaaaaaaaatcaacaaaagacttaaaaaaaaaaagactacactgttagcatttcagaaccaccttagtgtaatgatgatagctcattgtggtactaagaagacaggggttatagtcttatttctggaaaagaaattaataaagtggcatgcttagttaaaatatatataaccacatgcaagtactaaaatgccactgtataaatacaatacaaattgtaaaagaaaacatgctttttaaattagagcaagtataatagcctgtgaaataaatgtcaccctctagagttgttcagtgcacaagctgcacaactttacatgggccttcagtagaggtttccattttatgtgaggttttgtaaactgggagatgatttttccagtagtgtggcaatagtacaatctgcctttcttccctgattctgtgtgcactggtcctatttacaaagtaatataaaaatcaaaaggcttggccagacgcggtggctcacgcctgtaatcccagcactttgggaggccgaggcgggcagatgacctgaggtcaggagtttgagaccagcctgaccaacatggtgcaaccctgtctctactaaaaatacaaaaactagccgggcgtggtggtgggcacctgtaatcccagctactcaggaggctgagacgtgggactcgcttaaacccaggaggcagaggttgcagtgaactgagatcgtgccactgcactccagcctgggtgacaaagtgagactctgtctcaaaaaaaaaaaaaaaaaaaaaattaaaatcctttgtcttgaatggattatgggatcagagtttcttcaggactcctaattaccatatgctttcctattctagcatcttccatttctgtccatacagtcattgcaagtgatctatttatattatagtaggcaattatagagatttccacatatttgtagctatcccatccatttctgtagccaaatattctgaagcttcaaggagatctttgtcttatctccaacccagtcccatttttgccctttgaattgcttctgtctgctgtaattttagccttcttttgtcagtaaagcttatctccttattatctgaggtctttacaaaagtccatggaatgtttacctgggcctttaggctcatgttcctggtcatataaagaggagcacctttctctaaaaggacctcttctcagcctaaacaatctctaacatcttgccactatttgcattttccagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtggtatgtggtcttccagggaaaggggtgagggagcccagcctttcctctgtagtggcaaggtgtgtagtcagtcttgatgcttacaacagtcaggcttctggccgagcacagtggctcatccctgtaatcccagcactttgggaggctgaggcgggcggatcacttgaggtcagcagtttggactagcctggccaacatggtgaaacccgtctctactaaaaatataaaaaaactagccgagcgtggtggcacacgtctgtagtcccagctactctggaggctgaggcaggagaatcgctgaacctgggaggtggaggttgcagtgagctgagattatgccactgcactccagcctggccacagagggagactctgtctcaaaaaaaaaaataaaaatgaaaaaagaaggggtctcaaaaataaataaatgaagaaggggtctcactatgttgcccaggctggtctcggactcctgagctcaagggatccaaccatatgggcctcccaaggtgctgggattataggcatgaacgacagcgcctgacttcattttccttcttttttttttttttttttttgagatggagtcttgctctgttgcccaagctgtagtgcagtggtgcaatctcagctcactgcaatctccaccttctgggttcaagtgattctcctgcctcagccttctgagtagctgggattacaggcacccgccaccacacctggctaattttggtattttttagtagagacaggggtttgccatgttagccaggttggtcttgaactcctgacctcaggtgattcgcccacctcggcctcccaaagtgctgggattacaggtgtgagccactgcgcctggcctcattttccttcttgataaaggagaaaactgaagcaagaggaggaaaatgactttttctttagagatgcggtctcgcactgtcacccaggctagagtgcagtggcgcaatcacggctcactctagcctcgaatgcctggactcaagccattctcccacatcagcctcccaagtagctgggactataggcatgcaccatcattcccagttaattttttttttctttttgcagagatggggtcccactatattgcccaggctgaaaagtgacttttttggtgtgcatatctcaataattcttttgtaagcctgccttgattgatctctaaggctcagtgtggctcagcttgaaatgcaatttgaactatgctcctaaatttttcctgaaatgcataatggggcagagtaacttagagccacaatagattcagcatgtgttctccgtccctaaaggcagaggtcttggacaagtgatccctagccaccaattctttcttttttattttttatttttctgagacagagtctcactcaggctggagtgtagtggcgcaatgttggctcactgcagccttcgtctcccgggttcgagcaattctcctgtctcagcctcctgagtagctgggactacaggcgtgtgccaccacacccagctaattttgtatttttagtagagacgaggtttcaccatgttggccaggctggtcttgaactcctgacctcaggagatccacccgcctcgccctcccaaagtgctaggattacaggtgtgagccactgcacccggcctgctagccaccaattctgatggacacacctgggcatctgatgaggcagctaagtggggtgttggattattttccctctagcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggtgaattgttccgtccctcactaaagaaatcagatccagtgtagggaattcctaggtagggaaatggatcaagtggcctgatggaccagaatttccaagttctggtattagctctccacttcatgctattctgcataacttttgagctatttttctgcctgggatcttttctctcccatctgtgaaatttccttgagggcagagtcccttggtcactctgtattccagccagcactgggtttagtattttgtccttagtaggtattcaggaaatgattaagaggtcttcattttgggaatccacctgaactttaaagatgcttcccaacagtatgaacagtatgaattgaatagaatacaacaagttaattttattagaagatataatattaatagcagataaagtcagttatatatatacacgtatatatattttttttttttaagacagcgtcttgctctgttgcccaggctggagcgcaatggtgcagtcatggctctctgcagcctcgacctccagggctcaactgatccttctacctcagtcttccaagtagctgggacttgccagcttggtgcatgccaccatgcccagctaatttttgtattttttgtagagatggggtttcgctatgttgcccaggctgatttcaactcctgggctctagtgatcctcctgcctcagcctcccaaagggctgggattacaggcgtgaaccaccagcctggcctagatacgaattttaaatacttctctagcaatcaaaattgatctaacccaattgtgtagtctgggtttttttcccacagttaccaatataacacatctagattctattgtatatatgtgtaaatcactcattcaacctttattttcttttttttctcaacttttattttaggttcagggggtacatgtgcaggtgtgttacatgggtatattgtgtgtcgctggggtttagtgtacaaatgattttgtcacccaggtagtgagtatagtacctgctaggtagtttttctgtctccccctcctcccactctccaccctcaagaaggccctggtgtctagtgttcccttcttcatatccatgtgtgctcaatgtttagctcctgctttttttttttttttttttttttttgagacgtagtctttctctgtctcctaggctggagtgcagtgctgcgatttcagctcactgctacctccacctcccaggtcaagtgattctcctgcctcagacttctgagtagctgggattacaggtgcccgctgccacgcccggctaatttttgtatttttagtagagatggggtttcactatgttggccaggctggtcttgaactcctgacctcgtgatccacctgccttggccttccaaagtgctgggattacaggcgtgagccactgcgcccggcctctttttttttctttttgagacggattctctctttgttgccaggctggagtgcagtggcacaatctctgctcactgaaacctctgcatcccaggttcaagtgattctcctgcctcagcctcccgagtagctgggactataggcgcccgccaccacgcccggctaatttttttatttttagtagagatggggtttcaccatggtggccaggatggtctcaatctcttgacctcgtcatccacccgcctcagcctcccaaagtgttgggattacaggcgtgagccaccgtacccagcctagttcctacttataagtgagaacatgcaatatttggttttctgttcctgcattaaatcgcttaggatcatagcctccagctcaacaatctttaaaagtgaaaatttggccaggcgcgataactcatgcttgtaatcacagcactttgggaggccaaggtgagtggatcacctgacgtcgggagttccagaccagcctgaccccgcctctactagcaatacaaaattagctgggtgcagtagtacatgcctataatcccagctactcgggaggctgaggcaggagaatcacttgaacccaggaggcagagcttgcggtgagccaagatcgtgccattacactccaacctgggcaacaaaagtgaaactctgtctcaaaaaaaaaaaaaaagtgaaaatttacatgcgtgtatatgtaagtaaatattaattgtgctatatacataaaatttgtgtactttagaaagtaatatctccaattttaaaaatgtgaatgagaccgggcatagcggctgacaattgtaatcccagcactttgggaggccaaggtgggcagattgcttgagcccgtaagttctaggccagcctgggcaacatagcaaaatcctggtctctactactaaaaatacgaaaaaaaaaaaaaaaatcgccaggcgcaatggctcatgcctgtaatcccatcactctgggaggccaaggtgggtggatcacctgaggtcaggagttcgagactagcctggccaatatggtaaaccccatctctactaaaaatacaaaaaaagtagctgggcgtggtggcaggcacctgtaatctcagctacttgggaggctgcagcaggagaatcgcttgaacccaggaggcagaggttgcagtgagccgagatcgtaccattgtactccagcctgggcaacaagagtgaaactccatctcaaaaaaaaaaaaaaaattagctgggcgtggtggtgtatgcctgtagtcccagctacttggaggctgagacaggaggatcacctgagcctgggaaggtcaaggctgcagtgagctgtgatccagccactgcacgctatcctgggtgacacagtgagaccctgtctcaaaaaaagaaaaagaaatgtgattgatcagctctttgcctaaaacttagctaactgtgtgctttgcagacattgtctgactcatagtcttgagaatgtttctctcatacaaacattgaaatgagatgcgtttattcacagcacatcaggaacagaaatgggactaagacctaggtttctagacccaaaagtctgaaaaatgggcgtggttttagtgtaacatcaatgctttgagaatcaaagtacatactcaaactttcctaagaaatttcaactggaagggactggattttctccaaattcaacaaaatgatggatgacaaaaccagtttcttattggctagggtctaggctagatcatctccaagattcttcccaactctaaaattttattctatgagatagtggtctcagatgagtttgtttctagaccgtcctatgggataaaggtttctctagatgttcttcaagggcttgggttgggggtgcttctcatgaactctttcatgtcattccctgtgtcataaccctcaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaaggtaatgtgtcccacagcaaccaaaatcaaggtcagcccagcctgacagtctctccagtgctgtactgcaacttgtatctgggacagcagttaagtgcaaaggacactagaatgataaacaaatgtatcttttagattgtgactcaatcttattgaatccaggcaaaatcattaagaagagctccttaactacttcatgtgttactacctaaagtccatggagggtcttcaatgtagcactcaagcccacttttctgctacactcaacagccgtcctagatgccagcagctagagtggctaagtagttttatgaaaatgtcttgattaaaaaaaaaaatgctgtctgtgagcctcatgacccaagatgtcatctcctgtagcgtcacatagcatttctagtgggcaggggttttcctttcacttcattcatggaaagaccgagatgcctgtgagtcaacatagctcacgcagttggtcggtgtcagagccacaaatgaggtcttctgacgggtgctcaattccaagtcaagtgtgctttgttttcctcatggtagaactctttcttttttttttttttttttttgagacagagtctcgctctgtcacccaggctggagtgcaatggcagatctcaggtcactgcaacctcctccgcctccaaggttcaagcgattctcctgcctcagcctcccgagtagctgggactacaggcatgcgccaccacgcctggctaatttttttgtatttttagtagagacagtgtttcaccatgttggtcaggctggtctcgaactcctaacctcaaatgatccacccgtctcgacctcccaaagtgctgggattacaggcatgagccaccacacctggcccctcatggtagaactatgttttttttttttttgagatggagtctcgctctgtcacccaggctggagtgcagtggcgcgatctcggctcactgcaagctccgcctcctgggttcacgccattctcctgcctcagcttcccgagtagctgggactacaggcgcccgccactacgcctggctaattcatggtagaacttttaattttactcccttccatcagcttactttcctagttttttgtttgtttgttttttgagacagggtctcaccctgttgcctgggctggagtgcagcctcagccccctgggctcaagctcttccctcctcaacatcccaagtagctgggataacaggtgcaccaccacagtccgctaattttttttttgtagagacagttgcccaggctggttactatgttgcccaggctggtctgaactcctagtctcaagcactcctcctgccttagcctctcagtgcactgtgattacaggcgtgagccaccacacccagccttaatttcctagtttcttgtttgtttgtttgagacggggcctcactctgtcacccaggctggagtgcagtgacatgatcttggctaacttcaacctctgcctcccaggttcaagtgattcccctgcctcagcctcccgagtagctgggactaaaggcatgcgccaccatgcctggctaatttttatatttttgatagagacagggtttcaccatgtttgctaggctggtctcaaactcctggcctcaagtgatccactcaccttggcctcccacagtgctgggattataggcgtgagccaccacgccgggcctaattccctagtttcttaatttctctgagccacctttcttgctattgatcactacctcacagccttactctgcttttctagcccctgacagctatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccagaactccatccgccacaacctttccctgcacgacatgtttgtccgggagacgtctgccaatggcaaggtctccttctggaccattcaccccagtgccaaccgctacttgacattggaccaggtgtttaaggtgaatgccctgctttcctctaaatagggcctaagttggaggttgtcatagccatctcaaaaggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaattctgggaatgcttgctctaaaaaaagcccttcctgctgggtgtggtggctcacgtctgtaatcccagcactttgggaggctgaggcaggtggatcacctaaggtcgggagttggagaccagcctgaccaacatggagaaactccgtctctactaaaaatacaaaaattagctgggtgtggtggcgcatgcctgtaatcccagctacttgggaggctgaggcaggagaatcccttgaacccaggaggcggtggttgtggagagctgaaatcgcaccattgcactccagcctgggcaataagagtgaaagtctgtctcaaaaaaaaaaaaaaaaaaaaaaaaagcctgccttaggctggagaccagaagctgagctaccagaacgtcttttcagaaagaagttattttggtttttcagagtgcccataaggctgctggtagctgtaaccattctcctgggaggggcagttgtctggggtgtcttttgtcatcagtcaggaataagtgtttttcccaatccggtcaaattgaccacgttggtggtaacttcatctcatttctctcccacaatgcctggccgccaccagccactggacccagggtctccacaattgcccgagcacttggaatcagtaaggttctttccctctggctcggggcttggccttgttttcctttcactgctcagcatggctttagtggacagagacaagatgtgatgtggggaagggtccctatggccatgttttgtctaggtgccagccctagacacagaacaccctgagggtcaggcacacacccacttccctccccttccatgggcatcacaagggcacactgagcagagcagggcacagcaggggagcatgctgcagcagccacaagcgcatggcaccagcctcaggggcggcagttcgttcgctcacttttgtgcctagcttttctttgccacgcatatagctacctgctctggcatcccccaggggtgttgaggacacgtgggtgaagcggtagtgccactctgccatcatgtgtctgtaggccacccacctgcccactcatcacagttttggagactgctcgcctacgtccatcccctcaggttggcctcctctctctgggctgtcattaactcaagcacacaccaccagagcagctggtggggttttgccatcccctctttaccttattgtgttaacataggtttctttctctccccatctgccacaagcagcagcagaaacgaccgaatccagagctccgccggaacatgaccatcaaaaccgaactccccctgggcgcacgttagtatgggagagtgggccttgggcctggtccttgttctggggccatatctttagggaaccagactctgggattctgttcccacctcaaagggatctgagcccagagaaggagagcaaagctcctggggctgagaaggggtgtactccagtccccctgctcctgatctctcgtgtttcctcctagggcggaagatgaagccactgctaccacgggtcagctcatacctggtgcctatccagttcccggtgaaccagtcactggtgttgcagccctcggtgaaggtgccattgcccctggcggcttccctcatgagctcagagcttgcccgccatagcaagcgagtccgcattgcccccaaggtgggtgtcctattttcctctgaagagagattctggccaattaagaatgttggaccttcagcttgcaaagcactctgataagtgttccttgagagcttataaatctagttgggtagaaaaggcataaaaacatagggaagtgtaatagcattagaagagctaaaaaggtatttggattacaatgtaagtggtgtcagaaggcccataaatacctgatgagcttgtaagaattcagacaaaagtgattgtgatagatgggctaggattattaaggaagatacacaagggaggcaggccttagaaagagatggatttggccgggcgctgtggcttacacctgtaatcccagcactttgggaggccaaggcaggtggatcatgaggtcaggagtttgagaccagcctggccaacgtggcgaaaccccgtctctactaaaaaatacaaaaattagctgggcttggtggcacatgcctgtaatcccagctacttgggaggctgaggctggagaatcacatgagcccaggaagggaagttgcagtgagccgagatcactgcactccagcctgggtgacagagcgagactctgtctcaaaaaaaaaaaaagaaaagaaagaagtggatttgaggctagacgctgtgggtctcacttgtaatcccgacactttgggaggccgaggcaggggtattgcttacagccaagagttcgagaccagcctgggcaacatagcaagaccccagtctctgctaaaaatgcaaaaaaaaaaattagccacggtggtagtacatgcctgtggtaccagctactcaggaggctgaggcagaaggatcacttgagtccaggaggttgaggctgcagtgagccctgtttgcaccactgcactccagcctgggcaacagtgaggccctgtctcaaaaaagaaaagaaaaaaagtagatttgggtaagcaaacaggtgtagagagagcatgctaatgggcagtgccatggaggcgggaaatgcagttcgtacctggcagtagtaaagtgactgggtcagactaactcagggtttctcaagtactattcacgttgacagctggagaattctttgttgggcgtgggagggactgtcctgtgcactgaagggtgtttagcagtatcccttgttttccccactagacgccagtagcacccaccacaggcgcggcaatccaaatgcctccagacattgccaaatgtcccctggcagggagggaatcacccctgcttgagtatcactggtctagcttgaggggaaggtgagaagggtaaattcagagccaacttggatcagccatcagatctgcacttaacactgttaaagggttctgtgagtacgggctgacatgtaaccaaagtgaaaagcttcccccatccccttcagagagatgaaaatagcatagagtctggagtttagagcgacttgggtttgctttttttttaatatataaaatcttttaggccatgcacagtggctcacacctataatcctagtattttgggaggccaaggcaggaggatcacttgaggccaggagttcaagaccagcctgggcagcaaagtaagaccctgtctgtaacaaaaaaaaaaaaatttttttttaattagccaggcattttcatgtatacctgttgtcccagccacttgggaggctgaggcagaaggattacttgagctccagagctggaggctgcaatgagctataatcgtgccactgcattctagcttaggcaacaaaatgagaccctgtctctaaaaaacattttctttaattataaataaaacatattacacacaaaattataccacacatacataatttagcgtaaattcattcatgtggccgtagcatgtgccctgtttgggttttcatgcagtgggtttttctcccctttcctttttggctccctctccaccctaccatcacccacatcacccctactcccaagataactggttgataatttatgatgctttcttgcatattttatcaatgctcttagttatactatacatgtatagcgatagccattttatatgtacacatacaacacacagaacattgataatgtaatcatgttgtgcatacttctctacatgtctctttttttttttttttttcctgagacggagtctcactctgtcgcccaggctggagtgcaatggcatgatcttggctcactgcaacctccgcctcctgggttcaagcgattctcctgcctcggcctcctgagtagctgcgatcacaggcgcacgtcaccacgcccagctaatttttgtatttttagtagagatggggtttcaccatgttggtcaggctggtctcgagctcctgacctcatgatccgcctgccttggcctcccaaagtgttgagattacaggaatgacccaccacgcccagcctctacatgtctctaactcaacaatgcctcatggaatttcttccaagtcacttggcatagtcctaattcattattttttagtgtccatgtaatattccatgatgtggctacaccacagatttttcagccattccacttttatggacagattctgtttctcaaattttgcccaatgaacgacactgcaataaatatgtttgcaaggatctctcttactagtgctttcatttctctaggatagagtcccagatgtgagattgttgggtgagaaggtattttaaattctactaaatattgctagattgctttccaaaaaagctatgataagtcatgtttaaaccagcaatatatgataagatctatatctttgccagcaattggtattattagtctgtttaatatctgccaatctaatatgtataggttatatcttcttaattttttaaaatgttttatttatttatttttaaattttttatttccataggtttttggggaacaggtggtgtttggttacatgagtaagttctttagtggcgatctgcgagattttggtacacccatcaccagcttgtttaattttatctttctttgtttatcagtaagtctgagcaccttgtcattatgtttggtgacttggaattgtcctctatgaattggttatttatgaacattgcccatttttatataggttttgttatcaatttgtgagagctctttttttttttttttgagacggagtcttgctctgtcacccaggctggagtgcagtggcgtgatctcagctcactgcagactctgcctcctgggttcaagcgattctcctgcctcagcctcccaagtagctgggattacaggcgcccaccactgcgcccagctaatttttgtattttttagtagagacagggtttcaccatcttggccaggctggtcacgaactcctgacctcatgatccacccacctcggcctcccaaagtgctgggattacaggcataagccaccacgcccagcctgtgagagttttttttttttttgagatggagtcttgctatgtcacccaggctgaagtacagtggtgtgatcttggcaacctctgcctcccgggttcaagcaattctcgtgcctcagcctcccgagtagctgggattacaggtgcatgccaccacgcccggctaattttgtatttttagtagagacaaggtttcaccatgttggtcaggctggtctcgaacttctgacctcaggtgatctgcctgccttggcctcccaaagtgctggattacaggcgtgagccaccgcacccagccccctgtgagagctctttgttgttaaaataatcttctttcttttatgctgaagatatttttctacttctattgtttatctctttactttcctttcttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacccgcaccctcagattgtatatgtagtctcctagattctctttcaggatttgtatgattttaaggttttcattttttttttaaagccagtcaaatttagcagttgggggttgtgtaccaactttagtgacaataatgtcactacccgctaccatcagagcagcctaaggttcttattttcatgcattaaatctttgtatacagtgtaagacaagcatgcaattttatttcctctcggatgaatgctattataattatgccactacatactacatacccgcatcttttacccccagaattgaactaccaacttcaacatacatcgtattctcatatttaatagattttaagacttcaaaacgacacaaagaggatcagaacccgtatgtgatatttttgtgcgtcctgtctggtgaccgttggttcaccttatctctgtttccctttcaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgctgggctctgtggtttattggcgtctgattcctaaggcaccaggagaggctggaaaagaaagagggtgttgatggagacgatggtgatagggaagaggcaaggcctgaagttcacccaaagcagcagttggagcacttgcacaggcacacacttgacaacacaaattgccagttttcccagtgctagtcctgcacagctcacctcttttccctggcgtctctgaccttgttccttgggacctttggacctgctggttaacttaggccttttgagggttcttaataagacaagctcacgaggggtagggccccctgaacattagggcaggaagggcccagttacaggtgcttcattcccactgccatccccaccctgaggcctgggagccagcctgccctgcttttcttctgcccggcagcagctcctgttacagttttttgcagtcagaacttgaagaaagtgctatcccctgcctgtctaacctgaaaagtagccaggggcccaagggtcacaagaggctccagggacaggtgagggcctcttctctgcatcaccactcaagcagcatcaccatagcaaccccaggagtaaacaatggtgccagaaagggcttccccacaaagccgcccctcctggctctgaggcccagaagaatggccagtaaccggcaaagatcactcagagggcccagtcacccatctcatatggaagaacctttcctgcaggtagggggtggcccatctctgccgcctacctttttgtaccccactgggctacaggctgtcccttatagtgggccaggctttcttctgggcagcagactgcctggcccatacattttctgctgtcttccccttttcatcctatgacactaggaacccagagctcagaacagagaggagatgcctggctagtgccacatctcccagccccacccactggggtgatcctgtagaaatgacttaggggcccaagctcaagaaacaggtgggtttttgcaatcagaaaagtcctgggggccaggcacagtggctcacgcctgcaatcccagcacttcgggaggtcgaggggaacggttcacctgaggttaggagtttgagaccagcttggccaacatgatgaaaccgtctctactaaaaataccaaattagccaggcatggtggcacgcgcctgtaatcccagctactcaggaggctgaggcaggagaatcacttgaacccgggaggtggaggttgcagtgagccgagattgcaccattgcacctccagcctgggtaacaagagtgaaactccatctaaaaaaagaaaacatccctggggatggataggagggcgaagcattttaaaagaggcacatttttgttgcagtcaggcactgtgctaagtaaggccatttcatttcacccagcatggtatgccaagcaagagcacagacagagggcttaagtcccagctgtcactcaggcaccagcaccctgtgtgagtcacctacccttactgtgtgttgctttctgcatctttgagatggggacgatagcaatacttgctcatagagttgtgggggttcaataagatccatgtaagtatttagcacagcatcaatatgtacttgctgctgtttatttaatggggggcagggtgcagaaaggggaaggagctgccattctagatgctttctatactagcgttttaatgaggagtgggaggaaagcgtcagtgacggacaaatgagtattgagaggagtctgggatgggaaaacccctggccctattttctggaggactttcctggtataccgccaagaccaggagcaagtgaaggtgggctgccccccttggcatggtagggagcatttcccttcatgatttcctgaggcctgatgtgccctctaaggagcaccagttcctgggtgggaatgtggggatgccagaacggaggagggaggtgaaggtaaagagtgaaagctgagtacagagggtgggaagtcaaagccaa

SEQ ID NO: 12895 - DNA, 6336 bp, Human
tgtatacaagatacatataatgaaagttgtaatctatcaacatggtatcaaatatttcaaagcatttgattttatccattatatgagttttatctaaatagaagttggaatctcttcttttgtctgattctcaaatactggtttgcagacttttctccttgaccttttcttactttgaatgctttaaatagagaaatagacctacttgcgtggccccaactacaacaaaaacttttatgtttttgtcactcttatgagtccatgccaatggtacacagctatatctcatacagcatgctataaaatgtaatgatttttatctctagctcccctaacatgcttcttgtcaaaggtcatctgttgaagctagacacctaggaaacaccattgacccctactccttccttactcttcacatccaaatgcttctcccagacctcttggctttatggcatttttttcctcaaagttttgttaccaaatgagatgtaagtgtttctaaggcaatatttagaatacctaaaatgattaattataaagggagggattactgttaatatgagtataggttaattctaaaacataagagtttcatgcatgagaagtctgaaatgagatttgaaatatgagtgaactttgggagactggtatagggaggcaaggggaacattttcacctaagatgagagagctaggatacagtctcaggaggacgagaagggcggcactgtcaaatagtgcagaaagaatggggtgaaccaggactggaatgagtcacagcatctgaaccctggggagtcaccagtggtcttgagtgaacagtgtcactgcagttggacatgaagcctcaactgaaacatgaattatgaaaacaatatgtgagaatgtaggaagaaatttaatggtcaagataaagaagaaacagaactgatacctgcagaggaagtaaagagaagttttccttaatgaaaagcagtttttcagccaaggatgggagaagataaaatgagaaagaatagtaataatatagcaagtttgcagatggaggcatgggttgtggaatcaggagtagacatagaggtactatcttccaaagaagatgggacagttttcctccaagatcacagagaaaaaaagatgacaacacctaaataaatttgaggcaaaataaatgtaatattgagagaacttttactatatggttctgatcactggaagcaggaagtgtgttgaaacttagctgggtagcttttaaaaatattaatgctgggtcatactcctaaagattttgatataagtggtcttatggggagcccagatgtcatatttttcagtatttcccaggagactctaatattcagtcaggaccatgggctagagagaagggctggggtgaccatatttagaggcagtagaaaaggtaaacaaggtgtgaacacctacaaagataaaagggtgagtaaggaacaacatcttttcactgaaatattggagaaaaagggaagctggaagaggaaggtgtaatcaaaatgcagtttaatatatttcaagtagatgtggttttttgcatattctttcatcttatttattcacttttcttatcaacttcctcctattttccttatttatttctaaccccaccctttctggttgctttggcattccttccctctttatcatttacttttcttacatcttccattctccacactttttaacttttcctaatttttctgcccattagttcctttctcccttcctctaggcaaagtagcaaaaataacttaggctaggcgaggacagaaaacaagacggttttaataaacgagccaagcctgagccaactgcagaatatggtaggcctaggagatcctggactggcacagcgactactaagaaagttaaatcagaagaaggcaaaaggcagagtcccgtgttatgtccatttccccccagaggtatgatcccaggtgctctggggaaactacagttataccagtgtcagggtatgaaaaaaatactggcaatcagtccacgctttcttgtgccagtgggtatgacttggagattatgctagttaggactgtttcagttacaactgagagaaagcaacttgaaatagcttaagctaagcagaaaattactaaaacagatatgccataggataccaaaggcaggtaaagatgaaaaccaggaactaaaatgctctccaggctctttcatattttagtcctgtcttctgctgactttctcctctccacttgcatgccagggtcctccactgctgtggtggaaattgttgcgtggataatagttttagacaaacaaaatgtgaaagagagcgaggaagagaaagctaggctgtcctaattttagaacatagaagaaatcatccactgggttgaattggaatcacctgttgactttagccctggacagtcagttttcagctcttcaatagcaacatggctgccacatttgcacccctcaaagttaaggaagaaaaaaattgaagaatctgagccaccaaaagatcattgcttcagagactgtccctgaatcttttttggtaacttgtgttaattctcccaaagtttttcaaagataaataattaagaataaatgatatggtttggctatatccccacccaaatctcatcttaaattgtaccccccataattcccacatgtcatggaagggacccagtgggaggtaactgaatcatgggggcagtttcccccatactgttctcgtggcagttaattagtctcaggagatctgatggttttataaatggcagttcccctgtaaaagctctctcttgcctgctgccatgtaagctatgcctttgtttctcctttgccttctgccatgattttgaggcctccccagctatgtggaactgcgattcaattaaacctctttcctttgtaaattaactagtttttggtatatccttattagcagcatgagaacggactaatacaataaatatatcttaacatccctttggtagtttaatacataaaatttctctgttttgaaacaaaaggaataatgtatttcatgaatcaagattcaccctagaagaatgcagtaagtgtacttaaatgtaaaggaaactgaaaaattacaaatgtgataaatttagacaggtgcctaatttcatttatgttctgaatgtgaaacagaagatggggcagggcctccataagtgtgctgcacactttgcctcacacaaaagtgaaagggagatctattgagcagacaatcctgcgcttgaagacaggagtgggcatttactctcaaccctatttctttccattccatctactgttaactataaatcatgtggcttcactggcatttgaaacatatgtgcataagtattagtaatggtaataatagcagtagtaacaacaagagcagattttcctatttgcgtgtttcaaaatttgttttttgtgtcactggttgaaaagtctgagaatcatagcttgcaagcatttcatttactatttcatttatattttagcctagtactaatataactgatggtgagtacttattggcaatgagaaaatagcaatttgcatacaataacagctggagttgatggaaaattccaggaatcattgttttaagtacacgacagtggtaatatgagatgctgattggagtatgatgcagatcagatacctaagccaaattatcttactcatttcccctttgactccaattctgattttacagattctatgctggtctagactactgttgtctaccacctgaaccactgcagcattttcctaattggtttagctacggctactgggctccctttcatttatcctccgcagggttgccagagcagtcatctcataatgccagtctgaacctccaggatgaatatgactatttacgtcagtattttttgctctcttcctggaatcatccaaaagcaacaaggagaggttaaaaactgaacaaaaaaataattgaacttaattttcagtgaatctaaaaaacaggtatgatccgtcaatgccaaaatatgcataaaggaaaatatgcataagctatagccctgtttgcagcagagagtataggaatggagttatagctggagggactggtttgactcagagaaatggaggaagtgaggctgcacaaagattgacgtgtgcaagcagcagtttccttctggtagcagcaactggaggggccattatatttataaagtaaatagtatattttatatagtaaagtatttttatattatatattatatagaacatataaagtatatttatatgttctatataatatataaagtataaaagtatatttatatattttatatattatattatatattatatatttatttatatgttaaagtatattatatatactttatatattataaaatatataaatatactttattatattatatattatattatatatatttattataattatatattatatatagtatatataatatataaagtatatttatatattatagtcaagtatattttataaagagtgtaatattattatatataataatattattatatataatatataaatatactttctatataatatataaatatactttatatatggtcaagtatattttgtaaagtaagactgtaatatttttcagcaaactgcaataatgagtgattgcatttgttttctattgatgtgtaacaatcttaccacaaacttagtgactaaaaacaacacatgtttactatctcacagtttctgtggatgaggagtccaggcacagcttatctgggtcttttgccactgggtctcacaaaaactcagtcaagatgtttctggggctgcaggcttgactggcaaacgatctacttctaaactcacgtggttgttagtagaatttagttccttgtgccagtgagattgagggcctgtttccagctggctgtcaataggaggctgccctcagcttaaggccacatggccctccccatatgatgcctcacatcatgtttcttcaaagccagcaaaggagatgggttacaatcttaagaaaggttacaatcttatgaaacataatcatgtaatcacatatatcccaatgtttttgccatagtcttttggatagaaacaactcaagtgcccacctacacccaagggaagaaatcacataagagcatgaataccaggaggccaggatcactgggagggccacctttaagcttgtcatctatagtgatttttttttttaaaagaagatacatagcatatacaaatattttaagagtctatagaaaaaagaagaaaaataacaataaaattttataagagattgagtactcactagaaaattgttgccatagaatgaatgaaaagtatgaccaaaagtttataattaattgaaaatcttattgacacaatcacctgtatgaaggaagattacaaagtagaaatataagaactcagggaagtgatagaaaaaaaactgaaatagatgaaaagtaagttatagaattaaaataaaagtaaaaaatataatgaaagaaaattagaatgagtacaaggaacactagacacttgacatgaacataaagcatgtggatgtagaaataagaaaaataaacacaaaataaaaatatagtttaacaggattaaaacaaaataatctacaagctcttagaactaacagttaaatttgacaaagttgctggattaacagtcaatatgtaaaattcaattgtatttctatataccattaacttaaaaataaaactttaaattttaaaaaagtatcttatacaaagacatcaaatagctaggaatacttgctactgaaatgcagttaataactgcacaccaaaaactatgaaatagtatagcaagttcttaaagataatataataaaatgaagaggtattctatctttatggattataggattcaatattataaagtggccaagtccccccaaaattattcatagattcaatgttatttcaatgaaagccttttgcaggttattttatggacattgacatatcgactctaaagtctatgtagagaagcaaagggccaagaatagctaggataatttttttttttttgagactgagtcttgctctattgcccaggctggagtgcaatggcatgatctcagctcactgcaacctctgcctcctgggttcaagtgattctcatacctcagcctcctgagtagctgggattacaggcacccaccaccgtgcctgcctaagttttgtatttttagtacagacagggtttcactatgttggccagtctggtcttaaa

SEQ ID NO: 12896 - DNA, 451924 bp, Human
ttggatggctttgaaggttcattgtgacctcaaatacttgttgagtgcttactctgtgacagccactctaaatgttttgtacatgctaacatttattctttattgcaattctatgcagtaacctcccttgtcattcttctttcagagatgaggcagctcagactgaggttttaagcaactgcccaaaattatacagatagcaattggcaaatccagaatgttaaacccggtctagctccaaataaatgttatatataagggtagagagtaaagaagaataccactgttcttctccacatacacagaaggaatctaggttagttctttacacccattagacacatataattattatccttttgcttaacataagtcaccaaagacttcaaatatattgagtgccatttcacaagttgattgttttagtaagtacacccttaaattggttaaaatccagaataagagaaatatttcaaatgaatatggtatcaaataatattttttatcttgttcctgaatgtaaatttgcctcacccctctagtctattctgagtcctaattcctcatagttagaggaattgttacaacattacgacttcttactaatttataataggtagtttgctaatagtatagtcacctgacattcatgtgtcaaaatatctttgatgaggtatgaattgctagatgtggaatagcttattcaagaaagtttaatttatgaatgactgtacggggagtacatggtgtgaaatttgaaaggaagaaagataaatgttctgcgtttttaaagtacttgtttcctaaggacagaggttggaggggattaggaatcagatgctccaccttttatttcattattcaaaccaacaatgattcttttggaggcaaaggcctcagttgggtcactcccagctaacgagagagcaatgatattagagagaaggaaggttgtgacaagagtgagggaactggaatgagacagagctggtggaaggtcacaaattgaagggacatattttaaaattatactctatggccaaaattatatactagttttattcattgattaaaggagttgcattgttttggagaggcatccttcataaatgtcaagtgtcttcttaaaagggacttagaataaagcaactagcaaaatgctaactctcttttctcgcaagtaagatgctgaaatttgcaaataatttgggcttttaacacaataaatgcacggtggctcactcctgtaaatcccaacaatttgggaggccaaggcaggcagatggcttgagcccaggagtttgagactagcctgggcaatatagtgaaaccccgactatacaaaaaatacaaaaattagctggaaatgatggcacacgcctgtagtctcaactactggggaggctgaggtgagaggatcacctgagcccaaggaggtcaaggctgcagtgggctgtgatcgctcctctgcactccagcctgggcaagtgagtgactgtcttaaaaaagaaaaaaaattgtttaaaagaattttgatttctgaatggagacggaatttaacacatttttttcaatgcttaattttatagtatatatcaatgaagaggattgattattctggaactgtttacaaattttgggggggataaatttcagtacttaagtcaagacctctctatacctaggccctaaaataagtaataactaaagaaaaaaagtccaaatcatatttgtatcatgttaaattttggcagcaatactaaggcaattttaccagtatggctgtggctaaaagagaatatcccaaagttcataaagtaagcacacaccccatgtacttaaatctctccctctctctctctctttctctctctcacacacacacacgcaaatgcacttgcacatatataaaagtacagaaaacttctgatattttctttatcttgtgaaaattatgtttattcttgtaaaatttatgatttttctctttctttttgccaggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaaggtaattgatagatttttaacatctttgtttcctggaattcaaatttctaggtattcttaagagatttttttatttttcaacatacagttaataagttgttaggaatatttgcatgcaaagatttattttcaaaatgcatataaattttatcagagaagataaagtataattcctcttgcaaaaaatctgcttataacatgaaatacaattacatctgttagtgaaattttttttctattgatccttccatcttattatagaagcattcctatttttaagaacccacaaatataaaatttatatgagtggattttaccaattttgcaatccattcttacatctttatttgcattatctttcaatcccattatattattactgtggtctcaattgattggctaccttgaaagttatgtggttctaagtgacttcaaaatgtcagcatatattgaaacttaattggaaaattttaaacaaccattagtttatgtatattccatgctcatattttaaccatctaatatttctttttgtaactgaaaataaatggctgattatgtaaaaactgaattatataaggacataattagaatactttatgagttttattttcatgttataactgttgtaaatgtcaaaaatatagaaaaagaataaaaagaaaaataatttggtggaataaaaatttaatatttatatatgaaggaaggcaatagagaaaactattattaaagcatttattttaaccagacagctgtcagtagtaaatgtgtttgagaggtgcttctatagtcttatgtgggtgatcttttcttatatatgtagataatcttatagtaggtgatcttttcttttgcatagttagcatttatataataggaattaaattttataataaagatttttctcaaaggaaaaggcttataaagtgtttgttctaacattatattttaaaacaatgtttgcctttctgtaatgctaatatggttttactgtagctaccttatattggtggaaatgtacataattatttataattccaggttagtgcaaattgtttaagctcattaatattaatggtagctgacaaggtacagtatttctcgagatgaaagtatccttcttttcccccagcagctaagtagtgtttatcaaagccatactttgcatgccctttgaattcatatctttatgaatacaaataagtttccacatttcagagcctgtcaggtgatgaaaggttttgaagactgagaaaaaggttaaaggtaactgtgaaatattacatttgtcatcataattgcaaaataaatcattaattcaagactattacatttgattagtggcatagttcatgattgtttccattaggaagaagaagttctgcctctaatgaaagcattttgatcaaagaatatggagtatgagtgcagtatagataaaatattagtagatttcttaatggtgatttcaaatgaacagcataaaaaaacacaggttcggatgttctcacaacagagtactatcctgggaatgccctagcaaaattatgaattgataaagtcatgtggtttgaccaaaatattataagaaatttacaagctttgttacccaataaaaactcactgggaatcaaatccatcatttcactttggcttgaagctaggaaaagctgaaataagtgtatgaataactgtctttgtgaatgtcatggtttggattttatcttctgaatctcttgtttgttgagttattactgcttggaggacacagcaatacataaaaacataatataacagagccaatatttttttaactttatcaagaaatgtatatattgataatattgttaatgattaattataaaataactttagatattttaaaaatgtaattatttatccaatgcaagaaaataataataaatgagatgttaccttttgacattttatctaatttttttctgttatagttttaaagggtagtattgttctgctcaattaataaatactttgatgtattagagcttgaattattgtttgaatcatatatttttaaataactcttctgataaccgaaagctctaatcttgcttgaaacacacttagaaacattctaaataacttaattcagtgtttttagcttttcttggtttgtgatttgtcacaaacctggtgaaggaagatcatttatcttcagtatatatgaattaaaatctcatgttgagtgaaaaattctcaagtctagccaccatttatactaatttagaattccacatgttatttaaaaagtaagaatccatgtatttaaaaacaatttatttagatcatattgatttttaaagaatgtttaaacaagtgttctgacaataatttacttaattattaaatatttccatgcttaattcacgtataatattatattttatggagaaaactgagggaaaatagcagaaattttcacacggtagaataataaactatccattttggaggaattgagtctgaacacctaatttatgcctaaagctcagtaacaatccttctctgtcctttaaatatttgcagtgatgggcaaaccattgcctcttggggaagactatttcatttttcaacatggtttactttttttttgacacacagttttggtctggcacccaggtaggccaggagtggcaccatcatggctcactgcaacctcaatgtcccaggctcaagtgatcctcccacctcagcctgccaagtagctaggactataggcacacagcaccatgcccagctgaatttttttttgtttctttttgtttgtttgtttttgtttttctttttgttttagtagagaggaggtctcactgtgttgcccaggcaggtctcgaattcctcgtctcaagcgatcttcctgcattggcctcccgaagtgctgggattacaggtgtgaaccatggcatgaggccattatttagaattaaaaataatagccgggtgtggtggctcatgcctgtaatcccagcactttgggaggccgaggcgggtggatcacgaggtcaggagatcaagatcatcctggctaacatggtgaaaccctgtctctactaaaaatacaaaaaattacccaggcttggtggcatgtgcctgtagtcccagctactcgggaggctgaggcaggagaatcgcttgaacccgggaggcaaaggtcgcagtgagctgagatcacaccactgcactcaagcctgggcgacagactgagactctatatcaacaaaataaataataaataaataaataaataaataaataaataaatatgaagtgggtaaaaattcaggggaagcttctattttttttctaattcccctttgcccatcaagtgaaacaaacttaagcttctttcacatgccaggtcttcatatatttaaagataagttttgtgttcccaataattactcactttctaggcccaagctcgctatttgtgtcagtgtgccttatagaaagttcaggtcatggcacagtctattttaatctgaataccctctagtttgttcatgcctttcttaattactgtggttattattgatatgaataaaattttctgtgagtaaatacaaactttaaaaaatagaataatagaaaacacttatagcatccaaaagccaaatatataaagatgactgagtacttgtctaatgacttttctgtttttctactcagtgtgactgatccatatgaaatcactctctaagagctatagcaggttttgtgtggctgagtgttcgcataacccgacatgtatcatcagataggtggaaatgttcatctgtgtgtgagcatagctaattgcacgagtaaagggggaaccatgtggcttttgattaagaaatggaaaatgtaaaaactgttcagtgaatttgagaagctgcactattccctcattcccctcatataaactagtcttccaaaacaagcactgcccccttaaattaaaaaatattcatcctctctctccttgcctgtctccctcccctgacattatttatagaattatttgaacattgagctgcagggtgagttaattcccttgtaacaaacggaaagtgttcagagtcagacaaaattttaaattagtgaaaagtagatatatattttttaaaaacacaaatctttcttgagaatgatacctttgggtttaaaataataatgtggtatctgttggcacactggcacctctcctctcattattgacagacctttatctcctcttcagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtaagaaaaatcagtatcttttggagctatgctttaaatatagataattttctgaagcccattccaggttcttattgtattcttatgtgctttattttgagttttgaaaattcagctaaggggtagaaagacagaatcaaacaccaatcctaatttcacatatccaaacaaagaatacctatgttgaatacttcttctctgtatttgtaaaataagcatttttttattcctgtgaaagatcagctagtttggtaggttggatgaaagatagatgtagtaaacaatattatagatagatagatagatacacacacacgtacacatacacatacacacacacatatgtatatatatatttagaattccagtcatttaaaaagtaagaatccatgtattcaaaaacaatttattcaaaaacaatatggtctaacaatttagatcatattgaataatgtgtgtgtgtgtgcgtgtgtgtgtctctgtgtgtgtgtgtgtgtgtgtgtgtgtgtgtgtacatagacagatagatagagtcactctgtcgcccaggctggcatacaagggtgcaatctcagcttactgcaacctctgcctcccaggttcaagcgattctcctgcctcagcttcccaagtagctgggattacaggcatacgccaccacttctggctaatttttgtatttttagtggagtcagggtttcatcatgttggccaggctggtctcgaactcctgaccttaaaagattcacctgccttggcttcccaaactgctgggattacaggtgtgagccactggacccattctgaaatatttatttaaagaatttttctgctatgaagtttttgctagggtagtttctcaaggcaaagccttgtgatgagtcagtgaaacttgccaagaaattcagaattatgccttactattttatctggctgtttatgtgcaaagaatgcatataaaacgtaacaaactttataaggcatgttaaggttagaaaagtttttactcatatgtggaacaatataatattcactgaaacactcaagtttgtggaactgcttttgtgtagatgtcatttagagacttagaaaatagaatttactaaatgatatttatttcagtgagttaaaggaatattttaataaatatttgctaactacaggttgtctgctttcttatgttaatgcattttattatttttgcatacaaatggttatcttgaattatcagttaaaaacaagtctcagagaaatacaataaagtaacaaaaatgaaattttaattttcattgaaagttacattggtgatgcagctgcatactattttgcttactatagagtgataattaattttactttaagatgtttatcaacaatataaacagtgctctttaaattagaacataaaaacattttattttaggacacttcgctatactttcataattacattgagattgaatttcatttgaatttaaattctctcaaagtatgccaggagcacattttgttcatgcatgcagtatatagaactctgtgcagaaatttgcccatttgccaataaaattggtcatctgcaaattgacagataagaactctttcaagggaataggaaactgggagctacaggattaaaaaaagggaaaataatttcaaaaacattttcaattagataagaaagagtgaaatgcatctagatacaaattagagtaattttgttttcttatttaaaatgtgaaatatttataaataattaaaaattaggaatacattattaagagtccttaaaaataagtatgtttgatctctgttagctcaaattaaacctattaaatttattatattgctttcttcctaaatcattacttctttgtcattggtaaagttctgtgttccaattttgaatgtcaggttctatatgaatgatttctgtgagtatgtgtaatcaaatgatccaagggatcctcagttgcaaattggtccacttatgtttatggatggtcatctacaaaactatataaatatagatacatgtgcattgttaatctgtggattgtttacttctccattccttcctgatgtaattcatgtataggttgtccaaacatcatatatccttataatgtatacattatatacatatgtgcatgcacacaggtatgtacatcatacatgtgatattttgtattaattatcatccttaaactcctcataggaagaagaaaattgacaagtattcaaaatgtctacagacatattaactttattcacaatcctacgtgtatgcacatgtgtggcatttttatttaatatatgtgggtcttaagtgattcactaaatagataatgggatttgcaatcaggtcctacaataatttggtaaaatacagcctcatgtatttgttctattcctgctttaaattatattctcaattatatcattgaggcaaatataaatagggacatatgtatagctagttgattatatacatttaatggagtcctgacctcaaatttattaaaatgcttactatttagttactcgttactatttaaaggaaactttgccactcccttggctttgaaggtgacatagacagttggatatttgaaaagtctgattagttaagtggtaatgctaacttagaattgttacagaattattcatagaataaatatgtcttgaaatcctctgaagaataaaacatattgctgttccattttatgcaacatttaattcaatgaattttgattatcaactgatacatgccagggagagttaaatgccacgaaaggaattatatgccactaaaggaaacaaaggcccagcccttgttgagcttctaatccctattgagggacatgtaataactcatatttttaatactatttgcaatgggataattgcacttgtaacagaccaattgttgcctcttactttacagcatttttgagaactttgattatttaatatgatagaactgactcgaaggcagaaaagtccctttgaaatgtatttataaatatatagtagactttttgtctttttgtttatgtgtcaaagtctcaaggtagaatttttttcaactttcattttaaaatcagggagtgcatgtgcaggtttgttacaaggctatattgcatgatgctgagcattgggtacaactgaaccaatcacccaatgaacagggtatccaatagatagtttttcaacccttaacctcttctctccctccccacgcttgtagtctccagtgtctattttttcctagatttatgtacgtatgtaccaaatgtttagctcctacttataaataagaacatgaagtatttggttttctgttcctctgtaattcacttaggataatggctttcagctacatccatgttgctgcaaagaacataattttgttcttttatatggctgcatagtattccatggtgtatatgtaccacattttctttattcaatccacaattgatgggcatcttggttgattccatgtctttgctgttgtgaatagtgctgcaatgaacatatgcatgcatgtgtctatttgatagaatcatgtattttcctttgtgtatatacccagtaatggtattgctgagtcaaatgtcgttctatgtttagctctttgaaaaatctccaaacttctttctacaatggctgaactaatttacattcccaccaaactgtacaagcattcctttttctctgcaacctcaccaacatttattgttttgacttcttaataatagccattcagactagtgtgaaatggtatctcattgaggttttgttttgcatttctctgatgattagtgatgctgaacgtttctttcatatgtttgttggctgcatgtacatcttcttttgaggagtatctgttcctgtcctttgcttacttttttaatggggttatttgttttttgcttgttgatttatttcagtttcttataggttctgggtattagacctttgcttgatgcatagtttgtgaatatttgcaaggtatagttttaatgatagaattcagcaaagagaatttgtcagcttctcaaaagagcaagatgactatttgatgatgtgataggaaatttactgtgaactgaaatgggaaaaactccacctcatacacaataaaataaacattactgtctttatgatggacttatgtatctgcttttactgcaaaacacacatgtgcttttttttttacatatttcctttttcctttccatatttatttattatgtatgctgttgctcccatttgtattcatttcttttttgttgtgttgtccagtttgatacatgataattatactttcatccagtctttgttcccacccccaaaacagatgggatgataaatgaaatatagtgctggaataggataaattcttaaaatgatgttaacaggagctatttattttttacgataattagcatttgttgttgtcatggatgaatgcttttaaacacgctgaaagtctgttatagctctgaatgatgtccaaaaatgatggaaaagaattggcttcagaaacaaagctgtgtttctgtcagtcattttggaacatatgattcattttaaatataaactaaaaataagttggctagatgacagcttgtaagcaattccagaataagttgttcatatttgctttaaaatccctgtgtttcatctttgtttatagatcagcagtccattaacaaaaaaactctggactggtaaacagaagcatgggattctattcccagttttgctactaaattactggtacaacttcagaaaatacaagaagggaatggaaatgcctgcagaaatgagctataatgcactatgaattgacattgtgttagttgctgtcacgtaaactatttcacttaatcttcaaaacaattctgtgtgtcccaaaggaaacaggtgatcatgacatcatacctgttatctccagtgactggctctcctgctcaccagagcctaaactagaaacatgaacatcttccttgattcttttctttttttggctcgacaacaatcggttgtcaattctatacttgtatgatctctcaaatcttttatttttttcctaccccctaccacttcttaggtcaaaatcacctccctctgtcagctggatgattaacagccttctaactggtctccctttttctagtctctccattgcagttagtgtaatttttttaaaaatgcaattctgatctgtttccctcttaatagcttctcattcctctaaggcatttttaagaagacttacaatgcttagtgtgatgtagcccctatacttgtccagtgatatttgagtccaaatcccccactaatttatttcaaattgagccagtagacaccttttagttgttgaaaataatcttctgtttacctgggaagctctctttctgatcctattcctcctagccatgaagtgcacacgtacatgtgcacatttgcacaaacacactcaggcataccatccggcttgggtgtcacaaagaaaggctgccctgacccctgctttcaagtctggaataggtctctccaaacacatcccaaaggaccatggaaacacccatgaccatccccacccccatgagaactcttatcacactctgaatggcttttcttgggtggatcttctactggatcaaccacacatctgagcagggtgaaccctaaggctgctcactgttttatcaccagcatctagaatgttgcctggttgtggaagtaccttaatacttcttaataataggaagatgtgttatatccatttttaagcaagataattccaatgagttaagtattctgccaaagtcaaatttggttaagtagcctttaactacttgccaaggaataaatagattcagccataattttcagatatatggacatgactcttttatgatttcaaaaattttataagaaagctcgagtgaattgtgtttctttgatttcaactgcagttaaacatatatatgtgagtatatacatatatatgtattcttatttgagcaattattaaatttctgtataccagctgctatcttaggcagaggggacaagaattatagataaaactttgaccttctccatgggctcagagtagagtaagttaggagagaataacactacactctagtgtaacaagtgcacagagaggcaagaaaacagcatcatgacatctcaggagaagaagggctcaggagaagaagctgcctggaaaggatggagaagagttttagagaaagtgacgttataaaattatcatgaaggataagtaaaatgctgcaactggagaagagtctacagtgtgcaacatgtgtaaatgtgaagatgactgagggagccagtttgtcaggaaattgcaagcacttcattatgactgagtaacagaaacaaggaagatgaggaatgatcaatggattttataaaaagctagcgtaggagagatcacagagagctttgtactaccaagtccaccttttcttgcccaccctgccctggaatctacatggttatagcaatatcagtgatgtttgtgtgatgtgagcctgctttcaaaccaccatggaatgcctcaaaaattggcatatatccattcacctttttcctggaaactcagaaaaagacatagagggccatctgtcagcctagactattgtggttactacggtctttggtatcaggacattctagactgaaatcctgaccctgtcgtgtagtttttagcaagggatttgaccactaacagtctgagagttgatgcatgtataaggtgaggataatatgtgtcatacttcacaggattgttgttgtgtaaagtgcctcatagaggaaacataacaagaatttaaaactttcaacaatataaatgctatgggccatgtgccatttttcttcactaaactctatgataaagaaattattaatctcacaatttttgaaattgatgcttgtttattataggaaattcaggaactacaataaagtttaataaaaataagataaaataatcaagattttttgctatcaagttaatcattttagatttctttccagtctgtttctctacaaatacacatacacatacacacaaagagcatatcatttagagttctgggaaagaaacagaagaaacacgtagcttgtaatcccactattttaatatgagaaaacttagatgcagtgagttgaagtaatttgcccaaggttacatacatagcacataagtgatagatctgggttttgaaactaggcagtcaactttagaatctactctgttaaatactgttacatgatgttagttgttgttttattttgtgggggttttttttggctctttttaaaaatcattattttaagcaagataatggcaagattagaactatttttggtaatggctttctgactgcagtgtggagaatgtgttggggatatgagatatggagagcaatagggcaacactggaagcaggggaattcctgaattagccaagttgaaaagagatgacagtttcaattaagaagattttgatggaataatgttgacatgaagaattctaagaggacttaggagatacagattgtagaatttagtaagtggttgccgggaaggagtgatgaagacaggaaataagaattactctatgttcctagttggggatactaatcagtggcacatttacctagaaggggaaaacaagaaaaacagcttcaagagagaagacggtgtctgcttcttaacatatgaagtttgaaacatctatgaaatattcacttgctatcattcagtggtattgtatatatcataaattcatcttaaaaataggaacttggtctgggcaggcatataatgcttccattggcattttgctgtgcccttcatttgaacttctttgtagtattaggaaatgaagaaaatcaacaaaaaacaatgaaataaaaatagggtgatagtacaaaagaaatgagttagtaggtgggcagccatggagataaatatagacatgagaagagcttacagacagaatgtacattcttttcattagtgaaggaaaagcagtaatatttttagaaatagtaatatttaccaaattgagcctagactaatttctatgatacgatcacaggaaaaaaaaaagccaaagcttttatcttaagcaaaaacacaaacactttcttaaaacactaactttattcatttggatgaagtatacttatagattgctttagatacatttttgtgtgcttttggagttagcataatataatggaaagtcaattaatagtgaaaactcattttattttatcttgcacgtatatttaaataggataaaataaaattaaagttaatataaaaatgtatattcctggaagacactaatttttgaataagataatttttatattatgaagcatacaatcaaataatttccattttattttagggagtggggtaatttggatctcagatgattatatgttgtacattttaaatacaagcttcaagtgctgtgttctctaattccaagtgcaaatacaattagcaattatgagttaaacttaattatttggatatacttgattacatagcttggtgtagtagtatttccacacagttggttatgcttgaacttatttttttattcctatttaagcaatcataaaaatttttttagaaaaaagttaactcaagatggattaaagacttaaacgtaagaccaaaaaccctaaaaaccctagaagaaaacctaggcaatacctttcaggacataggcatgggcaaagatttcatgactaaaacaccaaaagcaatggcaacagaagccaagattgactaatgggatctaattaaactaaacagcttctgcacagcaaaagaaactatcatcagagtgaacaggcaacctagagaatgggagaaaatttttgcaatctatccatctgaaaaagggctaatatccagaatctacaaggagcttaaccaaatttacaagaagaaaaaaccctatcaaaaagtgggtgaaggatatgaacagacatttctcaaaagaagacatttttgtggccaacaaacatatgaaaaaaagctcatcatcactggtcattagagaaatgcaaatcaaaaccacaatgagataccatctcacaccaattagaatagcaatcattaaaaagtcaggaaacaacagatgctggagaggatgtggagaaatagcaatgcttttacactgttggtaggagtgtaaattagttcaaccattgtggaagacagtgtggtgattcctcaaggatctagaaccagaaataccatttgacccagtaatcccgttactgggtatatacccaaaggattataaatcattctactataaagacacatgcacacgtatgtttattgcagaactgttcacaatagcaaagacagaatcaacccaaatgcccatcaataatagactggataaagaaaatgtggcacatataaactatggaatgctatgcagccataaaaaaaaggatgagttcatgtcctttgcagggtcatagatgaagctggaaaccatcattctcagcaaactaacacaagaacagaaaaccaaacaccgcatgttctcagtcataagtgggagttgaacgatgagaacacatggacacagagggggcacatcacacactggggcctgtcagggggtgagggagtaggagagggatagcattgggagaaactcctaaggtagatgacggcttgatgggtgcagcaaaccaccatggcacatgtatacctacgtaacatacctgcatgttctgcacatgtatcccataacttaaagtataataaaaaaaagaaaagaaaattatttcttgggttctgattaaataatagtgaatatttacaaatatgtttataggactaattctcaagttttaaaacctttaaaatatatgccaacacggaaagacaaaaatcaaattttgaatctgtagcaatcacacaattcatgtttctgtagatagtgaaataaatccacactagatctaaaaatgtagaaggagcaagtcttatactaaacctcaataatatttgcattttgggggggcggggaaatgtgaaggaagaataattctggtgatagtcaaacactgccattttttaatttacatttttctaaatttaagcatattggcatgcacatttttggtaggtactgccctcctgccccctacagcctttccttgttcttggctatcttcctttctatgtggtgaagtgggaaggatagttcttgtatcatctctctgaaacacttgaaaattttgaccattccttttttcagggcaaaaataaaaattattttgctttggcttctgcactgtcattctatctgtgttacctccttctttttggccatttattcccattgtcatactcttaaactcctttttcttttcctatttcttaactcatgatgttgttcaagattttattcccagtcttgttttctcattgtttacctcgttctccctaaaacctttcatttgactcgtgtttctgtacctgtatgctgtagactcaccaatctacattttcagttgtttgtactgacctccatattcacagttccagccatcactgatcatctttatttgaatgtctcataggtacatctaacgcaacataacaaaagccaaactcagtatctttgcccgaaatttgctttttactcctgaatttccctctttattgggttgcccacatcagatccctagtgatcattctagattctttcctctctctcaccctctattttcagttgatcatttagacttcccatttttatctcacatttctcaaatttactcctagcttctatccctgtcttagttaatatcatttagtgctgaaacaacgccctgcctgctactctatttaaatgtgtctacctgacgtagagaaaagggtctttttttgaaatgatagtctcatgaggtcattcccaagcttaaagctgttcatagtctccccagttcagagaaaaacgaattgttcctcggcatgacacatacagtgtccatcattgacactctcatgcctctctgattttaaatttctggtattccttctcttaatattgtgctgcagctttccttgaataattatagctctctcttaccaagcatgctatgctgtctcaatctctttgctgtgcacaagttgtcctctctgcctgatgtgtctttcccatttggtggcctattcatcacctgtaagatgtaccttaaaatagaatatcatttctaaatatttataaattatttctaaatattctaatatttagaatattatttcttgatgcaagagttactttagtagataaaatagttcatcttcatttctgtagtaagtcttatttttagcatcctcacataagtaatttagcaggagtgatgctgtcctggtcatggaagctctaaatatcttacaatttatttacctatttattcatttactgatttgtttgtttgttttattactttatttactccacaagtaattatcaagtatctagtatgtgtcagcactgttctaggtaccggagatatataagtaaacaaaatagataaaaattctttgccttatggagcttacattctaatgtaaggtgataaacaataacaaaataaatatgtgtacacaatagtatcaaacgtgataggtgttatgaagagaaataaagcaggagagatgtgtagggagtacatgggaagaaatattgcagtattaagaagggttgccagaaaataccttatttagaaaatggcatttgaactaagacttgaataaactaagcaattatgccatatctaaagaaaagtgtttcagaaaaagcaaggagaaaaaaatataaccacggggaaaatagattaagaattttgagctaaaggagccacgttttagttttgatgatgagttttgggaaaatctaaaaaccaaagaagactattgtgacatctgtcatttgttgtgtgtgtgtatgtagatctgtagatatatgatgacatatgtagatgtttcattactgttttagtaacaataatgtcatttcttttaaaatagctttgtgtaagcctgggcaacatagtgaaacctagtctctacagaaaaaaaaaaattaattagctaggtgtggtggcactcacctgtaaccccagctactcaggaggctgaggtgagatgattgcttgagcccaggaagttgaagctacagtgaaccatgattgcaccaccctactccagcctgagcaacaaagtcagattctgtttcaaacaaatacacaaacaaaaaatagttcagtgtaaggacttgtccacgtaaaagttcgtttttcttgttgttaagagggagtctcgctctgtcgccaggctggaatgcagtggcgcaatctcggctcactgcaacccccaccttccggattcaagctattctgcctcagcctcctgagtagctgagactacaggcacgtgccaccatgcccggctaattttagtattttttagtagagatgggatttcaccatgttggtcgggtcgcaaactcctgatatcaagtgatctgccctcctcggcctcccaaaatgctgggattacaggcgtgagccaccaagcacagccagataactgattttataagacagttatgttgacctagtgtatcacatgtatcaaacctaggtttaaatttaatccagataggatctagactttttagaggtatttctgatacagaatcacttatttttagttaagtattcaataaatgaccatgttagacttatttctcctctttatagttcagtgtaaggacttgtccacataaaaattgagtgccactgcaccccagtctgggcgagagagcgacactccatctcaatacatgcatacatacatacatacatacatacatacacacagttttctgttttctgggacctaatatttgctactcaacattctataaactttactttgttttaaatatatagtatatatggtatattcagagataacattatctaagcatctaactttttcagaatgcaagaaaataattaaaactcaaattctagacaggctaattgtccattccagagttcttccaagttagaagtggaacagtatccactaggatagtatttcagtgactcaaaaaggaaccaaacaaataatttttttgcatgaatgcattaaatgcgtactaataatatcttgttacaaacagaattctgactaacaaaccctaatgaaaatacaaagcctaacatatacctcttcttatccccaaagggattattttactattcataaatacttgtatttttgtaagcccagtaatctttcttttgagaaaacaaaacttattgtgtaacatatcttacagttataactcaaagcacttgtttttaaatttaattcataacacagaataaaatatctgggctactgttaaaactaaagattcctaggcaaatctctatgattcagtaactctagagttatattcaggggcttgcatttggaaacatagctaattgtagtaggcattcctcacatttaccaatatctctggttatcttcacttctaaacctcaaaaagttgcagtttccaaatccttgctgtggccaagaggattgctttagctgatgaaatgtgataagtggcattgttcacttccaggtggatgcatttaattgccttgctcttcctctccaactcattcatttcccaacatagcaattgtgctcaagttcaaagcatcctaaaataccgccaaaatatcaaagattgctaacctggagaattatctggacctacagcagacctggcttttatgagatatgaaatcttgttctgttaaatcactgtgatttgggaagggggatgatttttactatagtataacccagtcaagttgtcgttgaatttccatgtgtattaaaaacattaggaaggcttgataaaacactgcttgctagactgactcccagtttctgattttataggtatagttgtggcctaataatttctttttctaataagtttctgggtaatcgtgatgccattagtttagtaactccacttgagaatcactgatctagccaatcttgaccaatatacaaattttcatattttgaaacaaattgacattaagtcaaacttatcaatatgataaacaaaggcatcattttgtatgtaaaacaaatttaaaatgtttaaacaagcataattttttagtgatttaacactgacaaaattattaatcacttcttaaaaacacttaattgtctgaacttcaacactgagtagcaattattctgctaaatattcttgtccttaagagtattcaaaatggttttgaattagctttaatatgaaggaagaacagtcccctgtaaatacagtaaaaattgtgaagtataaattgagatttaaaacaatctgatattactagaatgttttataatatccatttcatataaatttaaaaatagttttactttttaacttttaaaaaatgtacaaaaagtactaattaattacatgtgcaatgattctgacttgtcatttaagtatttttttcaaattccccattccactctcacaatgaactttttatccaattgaaataattgagttggcattaaagaaagaaaattaagtcagctcttaaaatcttaacactaacttgttaattaccctattaataacacaatgaaaaatgacaagctgtaattccttttccaaaaatatggctgaaggtcagagagctgtcttgctggcatattgagagaccgaaaattacaaatgatgagcttttttttcttttaaatatcatcagatgccattagaaattcagcgaagagactagatcaatatttaaaatataattttaaacataattttcctattattaaagaaaacaactgctatatattaggaaataacctagcaaagatacttgtatttgtgtgttaagaagacaaatctaaagggtttccaaacattgtccaggtctgagcttttacactattgaaaaaggattccgtgtgcttttagcctacagcaaagatcaaaaagcattcacagagcctactggcaaaccagagataaatagaatggttttctctgccattaaacaataattcttgaaaatgacttttttcttttatgtggggtagagtaaatccaaattatgcaggacaaagtttacatgcacagtaagtgatctattgtggtattgtttgcatttttcttggtacagtttaatttattgttgtaactgcttcgctatttaggagaatagaattggttaccaaagacattgtaaaactgttctataatactgtagtactcatttaatatacatatataaatagttttactttttaatttaacttttaaagaattttgcaaaataaaacagaattctgtttcagagtagagacacttaaacatttgtagttttcttagaacatgtataacagtaccataatcttgtattcagatttttaaaatttgtaattgtggtaaaatacacatacaatttgccatcttaaccatttttaaatgtacaattcagtagtgttaaaaatattcacattgtagtgcaaccaatctccagaacttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtactggtttatttcacttaaaatagtattttcaaggttcatcgatgttgctgtgttgtaaagtgtcgaaattttctttgtttttaaggctcaattatattccattgtatgtatgtgtcacatattattcattcattcatcaaatacttgggttgcttccaccttttagctattataaataatgctgctatggacatgggtaaacaaatatctctttgaggccctgttctcaattcttttcagtatatacccagatgtggaattgctggatcatatattacttctctgttgaactttttgaggaaccatcatactgttttccataatggatataacatcattcctaccaacagtgcacaagagttctaacttatccgtatcctcactaacatatatatatattttaattgtactcatgttgatgggtgtaaggtgatatctaactgtggttttgatttgcatttccctcatgattaatgatgttaaacacatttctatattcttattgatcatttgaatattttatttggggaaatgtttaagttgtatgctgatttttttattttagctgtttgattcattggttgttgagtttcagtaattctttctatattctggatattaactgactatcagatatattatttgcaaatgttttcttctattccatgggttgctttttcacgttgttggttgtgtcctttgatgcaaatttttaaatttcataatccagtttatttttactttttttaaacctatacttttgctgtcatattcaataaatcattgccaaatctaatgtcatgaagattttcccctatgtttttttctaagggttgtatagttttagatcttacatttaggttttttatgttttttgaattaattttttttctatcttgaagagtaagagtccaactttattcttttgtatgtggatatccagtttccctatctctgtttattgaaaagactattcttttgtcatttattgaccacatatgttagagtttattgttgaaaatgaaaattattttaccacatatgtgagagtttatttctgagctctctattttattccattggtttatatgtctgcctttgtgccagtatcatactgttttaactagctttgtaataagtttgaaatcaggaactatgagatctccaactttgttcttttttaagattgttttggctagtcaggatttcttgagattctatatgaagttttagctgagtttttctgtttctgcaaaaaattttattggaattttgatagagagtacattaaatctatagatcactttgagtaatgtactcatatttttaaaaccaaggaaatttgagttatactaaaatatactttataaataaaacaacatttatttgtcaatttattagtctatttagtagccaatcaactaacatagattctttctatagcagtacatttgctgcttcagttagggtccatcacattctttaatttgagctcacttccttatttgtctgaaaattattttttctttataaactttatatactgatgacatatacaactatataaagtaatatcttatcaagcacttccttggccaaagaagaaccaaatgtgaataagatgttttgattctccaaatacttaaacactagtgttacaaataaattacagtacagtatgataaatgctaaaagagagttatataaaagtgttatggcaaactggaagttgaaatcaaggagatccagttggttggagaactaaacagagatgacatttaaactgggtctcaagtaatgttaagagtaggtaagataggaaatgcaagtgtacagagctgtgaaatggtatggtgaactggtagcatgatgaaacatctactgaggttgatacaccagacatcatctagagatgcccaagaataaagacaaatggatcaaaagagatcatgaagggactggcaagactgaaaatcagagcatataaccatataagactaaagtaggttagtcaccagcagccctgtagaagaggctgtggctggaatttgaaattattaaatatcactggacaggttggaggcataaataggttccaaagaacagtcttgatttaggcctcataatgctgcttaccaagaatcaattaactttttaggaaaaagtgatataatgaatttttgagtatggaatttttaattcatataatgtatttagaacattaaaaggttattaagttttgtagttattggtgctatttaccaaatatatctagctctggtctcaggcatagaacagaattgcattttctcaccctctttgaggttaggcaaagccatgtgattttcttttgccagtgaaatgtgagcaaagtactgaaatatttcttggtgactgtttcaaaagtcagttatcagtttgtcacattttcttctccatgctatagtaatgatgagaacatgattcttgatggaggtactggagtaactgtaaggtgcaaagccaccctaccaatccatgctagacaaacaataggaacggcaataaacttgcctgttgtttagcccctgagacatgtaaacataacttaccctatcctgactgtacaacaagtaagacataataatggctgtagaaagccttgataacagaataagaagaaaaaaaaaaaaactaaaatcaaccataatcttacccaaatgagtcattgtaactatttttatatttacctcttaaactatagtgttacaaagaagcttaattcatcatgtcaattatttacttaattgtgacagatgtttactctgctaaaggtatatgctgttgctctctctctcaggagattagcttccctgtcagtagctattgtgttataactagccatcatcaatttttctcttaagtgggaaactacaatacataacaaggttgttttgaatctcatatgagacaaggtatataaaataagtggcacatagtacgttaaacaataaagatgggagaggccgtttgtctttctaaaggtttgcttatcaaaattttaaaatacttgataccttcaaaatataaaccatttttgttcaacaaaactaaagcataatgtaataattctccatctcccttaagcaagtgtatgccatttgtcattttctttaaaaataaatgaacttgttcaattagttgaaaattttcttttatagatctgattttacaagttgatgggtttttattgcagcattatgtaaaaaagcttgaactttattgctcttgattagtccttatccttctaagaattttaatggtaatagaatattttaagatgcatcagtgcacatttatgttgaatgttagtatcctttctgctctttactgactaacactacagttaataataaaaatttatctttatttttgaaggcttattatgcatatatgatatttatacatttttggtgataaattctatcgccacctagtgctttggacaacattttatatttctgccatttctttttgcattacattaagatgtgtaaactgtgactgcccattcttctcataagacttttctctccccagtaagcttacttttctctccccagtaagctgttccacaagggcagagaatgcgttttctttagaactgtgtcctcacctcctggatcagggcatggcttgtagtagatgcttaatgcacatttggggagtgaactaatagataaatactatacagttcagagtccaataactatattctgacacaactacatcccctacttggattttaaaagagaaagtttttgtatcttcttgatgatctaattataatgctgtgcatctagtttagccaggacaagatttacatatgttgctgaatttagtaaattcttacttcctggacttcagataaggtaaaaagtaagcataattacaaagggcaggaaaaacccttagttatgaaaatatgtattatcttgactatggtaattatatcataatgtcaaagttaatcaaattttacactttaagtacatatattttagtttactttaattagaataaaattgaaaacaaaagccaaaaaagtaagaataacatattaaattgctttatattacaacagcaatatttctgtaaatattcttcctctacatttcaaaatttgcaaaagatatcaccacaggcaattgggcattacttttgagattctttgtcagtggaatacattaaatctcccgcctgatagagaaattaaaactgccacatttctgtctctgctagcatcatcttgaaatgttcatccctcaaacaggaatagatggaaaggagaggaaaggagagatgaacagagtttggagaggaaattacctcattactatgagcacagagaagagagacaagaaagagatataaaacatgagaggtaaacataataatcatcatgacaacaacagctattgaaagctcgctgcatgccagtaacagtctaaacacttagcatgcatttctcgtttttctgttttcatggcaactctgtttagtctccctatataaaaaaatgtaaaatctgagtcttaaagatgttatgaaacttttctgagggaaagtacaagtgtcagaataaggatttaaacccaaaatgttgaatctaatagtcaggttcttcactgaacgctatacctgttcataacagacacaaaatgtaaaaaacaaagaggtaaaacagaaagaaacaagcttctatgtgtattggtagatgaggagagactttgcagctgatgctaaacaagaggctagggtccacagctatctacacatctcctcaagacagagctccactgtagacagttaactccaggtagacagaagttaagacatgtggaaaacattaaatagaagcaattgtttgctataatctttgccacttttgcactgtatgcatttttgaagatccaaggccttctcccaggctatagaagtgcactttaagccaatattttgttttatgagatataagaaatcacagccatataaataaggcacaagcagagatgagtaaatggtatatagtgtctccagttttagaaaggatgcagattatatctgaaccagcataatgtcactacaagaaggatgcataatgtcataaaaatgtacttcatacgactcagttatttgtattttttatttatttgtttttaactaaagatgaatagcctctgccatattttaaaagggcaggcaatataaagttcaatattagaaaatgtacctaaatgactggaaaacacatcttatgaactagtatattaatcattcagtgtaggaagcagaaggcaacattacatatcactgtgatgtgctaagtgctagtctcaaatattcatggcttaggcaagagtttatcaaccttggtgctgtttagttgaagtcatggggggctattttttgtaaaatgtttaccagcatccctaacctttacccagtagatgttagtagtagttctcatccccagttgtgacaattaaaaatatctccagactttttgccaaatgtcccctagaggcaacatcacccctgatggatcactggcttcatttgagtatatttctaatcattatttttcattaaataattatgtttcagacttgcagtaaagatatgctgtaactttagatatgatttagaagtctatatcttagaaactactataaatagactcagtacaattggaagtggaattggactaccgatgattatattcattcacataaccatttgttaaatacacactaaatgcctgtcactgttccaggttctaggaatacaaaaataaaggacacatttgagatctgcattacaccaaaagtgatataaactgtttattgatccagattctccaagatctacttttgtattctattaatttaatcatcagaaaccatgaattgttaggccatattaccttacatctatgtagaaatatttttcctaagttatcatggtttctctgggaaatgaatataaaaatttcctttgaaatattttttagttttttttaaagtgatgagccaacataccatgcaccatgctattcactgtcttcaatccaaataacaatttacatgataaactaaagattgaattcaaagcataaagattgtttatcaacccttgatttcatttatttatcatttgagataacaattctactttttaaattatttatatcgttagagaattagagaagaaactatatgtattagtctgttctcatactgctaataaaaagatacctgagattgggtaatttataaaggaaagaggtttaatggactcacagttccacttggctggggaggcctcacaaacatggtggaagataaaggaaagacatgtcttacatggtggcaggcaagaaagcttgtgcaagggaattcctatttataaaaccatctgttcttgtgagacttattcactaccacaagaacagtatgggggaaactgccccatgactcaattatcttcacttggccacacccttgacacgtggagattattacaattcaaggtgagaatatgggtggggacacagccaaaccatatcactaaatgttctgagtacttaccagaatcattctctccggaagcttccttctaactgtgctctctcctctcttcctttcaagaaggtagtttaggtcctgggataaaaacaaaagacaaacaagtgacataatactagctccagaaactgtgatagcatattttatttccatcacctcaatcccctcaggaagtacagaaaactcacagagagcattgaagaagtaaagaagttatgcaacgtgcccaaggtcacacagtgcttggtacccatgtttgactcaatcttaagtccatgcttttgtcatgccactgcttttcctctggatcacgtgggttggagtaatattaaacatgtttaacaagtgatcttacagacagcaaccaacagctcgtacatcatagagatgtttactagctgataatcagctttcacccttctagaagacccagtctacatacaagtacaagccacatttaatttcctacctgtattctcataaattagtcgaactgagtcaccttcctaaactctggataccctccttataataatcttggagatttaagattatagcaaacaggtaaatgagtttataaaatgttcaaggcaccagcagtgttactgtgcttcagggtagagtcagggaaattagaccaggtgccagctaagagtaaagggagaaagcccagagtatgattctggatcactgacaactgatgctgtgggctgaggaagggaaaggtgcagaagggtgaaagtgggtggagtttggtaccaagtctgagcagaaactacacattaggactgcaaaggagatcagtaaaagccagatgatccctttttccatctctagatcttctagaagtaaatttcacacagttaaggctcattaagtgctcctagacaagctctttgcaacagggcttcctggggagtccagacaaattactgtttcctttgaccaaagcagcctgaaagcaggttggacctctttattagaatgaacttaggtacttaaattctcctttccctttcagagcacataggatttttctgaccataactaaagtgcaaaggtttaaaatactaataattccaagaaaggaaacattggaaaccaattagtaaggatatccatctaaatgaccagaaagatattttccactgtttggctagaaggagaggaaaaaggcgtgctgaccacttggtttctgaagcaccagaggggtcaccaatgtgaggaaaaggataagagaggggaatcttagagcaaagatcaactttaaccacctccttttcagtttaagtctccaaattcccctgtcaaagaatactcagtcgacaaagagaagctgtaccaaaaactgtttcatccataatcagctgtgcccagaaacagctgatgcagggagtgaggtgcattagcagaaagtcaggtcaagccccaagcaaaagtgatggttggtgagcccagggtctctttgaggagactccagcctgaacctcccattatctgccctccctctttgctccattagaaataatcactcctaagtggcccattatcaatgccagcatgattttttcacatttgctaaaagcttttccctttttcttttgtttctaaggaactattttaattccctctcccctttattttgcagttaactgacttgaaaaatatctgatttgaaatggggcttacagaccaatttcttctttccttcagtacatcccacgacccattccccaccccctagcacctagtaacagccatcgcatatgcattaaacaaaagacccattagtggagcattgttttgcacttctgcagacaaagaagaaagagacctccagttagaatgaactctttttgtatttctttctttttctttttttttttttttttggcaacaaatagctttcttttaaattcagaaatgaaatggaattgagaccctaaattgctctcatctaaaatgtttcactctcatcttcactttcctagattatgatcaattttccccagaatgaataattcaaattgagcccagtcttctgaatccttagaaaaaacaatgccttagcattttgggtctattctactcacttatcacttggcacattttgtctggtactggcagatattctttttgtaacatataatttatttttccaaatggactacaagcttctgaagattaaagaccatttcattcattcattcattcattcaacaaatgtatttgagctcttaccatgtgttagacatgtgctaatcacttgcaatacagccaagaactaatcagacaaaaatccctgcctccctggagtttatattctagtggagggagacagagaataagaaatcagtgtcataaatatgtaaattgtagagtatgttagaaggcgataagtgcaacagaaaaaaatagagcaatgcaagaggaatctgaagcttaagggagggctacaattttaaatagggtggtcatgggggatgagagagtaagccatgtggataaacagaagaacattccaggcaaaggatatacattaaagtgagaacttaaaaaatggagttgccatcagctgactgggaaggctgtgtttggatatgttaagttttgggtgcctactaacgtctcactggagatctgatggagtaggcagttggatataggtgtctgaagatccagtagggtctgggatgaactattcatttgagagtagttttaaaaacatgaaattggatgagatcatcacagaagtgagtataaacaaagaagactcggagatgacaggaaatgatctctaagataagaagaaaactaaaaatgtggggtaccctgaaagtcaagtgaagaaatcatgacaaagaagcagagaataatactgctggtatgtcatgtaaatgaaggctgaaaattggctgtggaatttagcaatctggaggtcattggcaatcttgccaagaaaagtttccgtggagtgatggaggttaaaacttgattagagtgagcttaagtgagaatgcaaggtgcagtccaccagatgtttgtgttccccctaaattcatattgaaactctcatcccagtgttattgcacttagagatggggcctttgggaagtaattaggtcatgaaggtggagccctcatgaatggaattagtgtccttaccataagaggccagagagctagctcactctccttctatctgtgaggatacaaaaaggtggccctccacaactaagaagaagattctcaatagaacctgatgatacgggcatcctgacttcaaactttcagcctctagaactgtaggaaatatctgttgtgtataagccatccagtctatggtactttgttataccagcctgaactaattaaggcgggggcaaggatttgatgattatatatacagacaacaatttttagaatattttctacaaagaaaagcagagaaatgaagtgatagatggcaggggaattggtgtcaagataaaacttaattaaaattaaataaataacagtatgtttatattctgctgggaataaatcaggagagaaggaagacttaataatgcagtattgagagaattgtgaccaactgtaacaatacaaaggaaatgttattttttatagcaggtagcaaagcggtttcctcaaaggagagaccctatttgtgatttctttcataagcctgcttagtggataggcctccaggacttctttgtcagctggtgcttaagcttgaggagttgaaatgcgtttgtgtttgccataggaaagaggaagagaactggacaaggcatgaggggaagaagactacatatcacgtagccaagaagacagatgtggggagtgcattgtgacttgtgatataaaccttctcctctgtctctctatcttttcaccaaaatctacacttgtagttttgctaatggaaaatgtcaagacgtgctgaaagttgccttgaggttgtaaacagatttaaagagtgaaagtagagcctgcccatggaaggacaagtcatgggggttacagagtggactctctctgacagacttctgttattattgcttgccccaggcagctctcacttattttgtatcaaattatcccctcagaacgtcatacctgtctcattctacaaagtcttccctggcaacacacactctagactcctaacttacttagctacctggtcttgacctttggagctgtcatcctatgcctatataatggcccagcctctgcttactcctcacccccaccctgcgccctcactccccaccacctgatctctcactaccatgtttcctccttgatcaatgccaggcaaagtgaactatttgcagttccccaaactcgtcatgctgtctcattactaacgtctttgtgcattaagttccctctgcctgagtatttttctactctttcaagagtcaagccctcctctttgctgatttaactcagagtcctttaaaattttgtctaaaacatctttattttctttctttcttttttttttcctcacttgttgcccaggctggagtacagtggcactatctcagctcactgaaatctccacttcctaggttcaagcaattctgcctcagcctcctgagtagctgggattacagttgcctgccaccacgcctggctaaatttttgtagttttagtagagatggggtttcactatgttggccaggctggtctcaaacacctgacctcaggtgaaccacctgcctcggcctttcaaagagctaggattgcaggcatgagccactgcacctggcaatttaaatatctttctagtggaaaattataccggcttatgcacttctctcatggtaatacttttcataatgtaccacaactgatggtttattttctgtctcctcgtttaaactgtgaggtctctatcatcctggtattctttgtacctaggatagcatctacttcacagtagctgcctaataaatatttgctgaaaactgaataaacatctaatgtcaaaagttgtgaataccaggtaacttagcataagccttgaccccatatgagtggggcttagagttcatctgctgctctaaaatcaaggtcattgtatctagtagtgaccccctggtactcacaactatataaagatacaactgggatcgtgatgtttgttcctattttattttactttttttccccagtcctgtattagaactagaagctgattggtcctgaatcacaacgaatttgactggagtcctatccttcagattagttcttctgatgtctgcttctatacttccagctaatagagcctttcccaaggtcaggtagttggcctacattctctagagcctgaatggctaggagactgaggttgcacagcatctgctgctatttgactcttttctccctactcctctccccattctgtaatatgttcaataccagcaccagtctgtaataaggcaaattttatgactggatttaggatcccatttgggaagaagtattactgtactattgcattggttttctatctcaactaggctacttccaacttacacttcacccgtgtcccacccacccaagatgtcaggtacatctcacagctgagacctgggttattgttccactttaacctctatgccagatgtctacctgctgaaccattttgcatgctcaacccactctcctatccacctctgctctgaaatctttcccaattcccactcttcatcttgcatgtactactctcagctcttccttgtgttaacaacttagtgtcttttactgaaattaaaaattttgtcaggaagtttgcagatgacatatatatggggattgagtgtcctggtacaactaactttgacctttgaatactataaaactatagctgtggaactttgtatgacaaatcagtgattcttctagttctggttcccaaatgactaataaaaagttaacaattttccacatttctctgattttaaggtactcatttaatactcattcctatccctaaagctcaagttcataggtttcctccaactgtctaggaagattaaatcacatgtgtaaatgtgataagagtattttaggtttgaacacatggattgcagaatttgtatgctggccagaatttctggtggagtaagaattttttgtagaaatttattccacccatcatgtaaatggctaaattcttcttaaggcagatcattacctagatattttgacagatttggcaaaaagaaacaggacagcccaacctaattcaattaatcttaccacctattcttaagaacaattactcacaagaaaaatacagctgcaccaaagaataaaatccatacctgccacttattaaagtaattttcaatttgcttaagtctctgtgcctcattttcctgtacgaagaaaaaaaaccacttcctcgtagtaagttgtcataaatattatcaaatatcattctcaaaaatcctgagttgcattaaagcaaaaataaatcatgaatggtatatttttattttctttttaaaatgtagaataaaacacaatggaccatagacatgtacttagggtaccaaccagtggacatgacaagataacataatgttgatagggaataggagtagggaacaatgtataactatctaaatgtgcatgggaaggggtgctaactagccctagtttttaggagttccctacagaattacaaggaccactgcttaatatcagttatgagagaggctgtggtatgcatcagcttattgtttgggaagagcttagtatgagatggacccttctctcatcttattaggactgaaaaattaagttagttgatttacgggaaagtggtaaagatttgaaaagtgatagatatgataaatggcaggctgggcatggtggctcatgcccaaaatcccagcactttgggaggccaaggtgggtggatcacttgaggtcaggagtttgagaccagcttggccaaaatggggagaccccatctctactaaaaatatgaaaattagctgggtgtggtggcaggtgctcataatcccagctacttgggaggctgaggcaggagaatcgcttgaacctgggaggcagaggttgcagtgagctgagattgcaccattgtactccagcctgggtaacaagagagagactccatccaaaaaaaaaaaaaagaaaaaagaaatgataaatgacaataagaaaggcataagagaaaaatattcaagacaatagcaatgaagaaaatatttaaatgttctaaaaatattttggaataggtgtttagaaattaaaaaaaatgatttatgcttaaatacaaggctagacttttcatttcagcaaataggataattctactgcccaaacatataggtagataatattcaacctttaccacaaatttagtagccattgtcattgttaagggcaacagtaaagtattttggaaacatttggaatttaaatcgccctttgatagttaaactgtgaaattaacacataatgaatatctatgaaaagttgcaaagctaccttaaaaaacacagaaagcttcccagttaaggctgtattacatctttactgaaggtaccaatataaccaaagaaagaagaaagaaaatgtccatcagaaagaggacttaagtcagacatttaagtttcttaaaagcagaggcttgcagaggaaaccaaacacaacacttctccaaaaattgttaacgggaaatagatccttaacatttactaccaataaggccagttatattgcactctggaggcaaagactaagtactatatttggagaaagacttccagggtttaaatctggctttgccatttaatagccatgggcctttcaaaataatatcccagatatcagtgttttaacttcatctgcaggtggggctgacaatatttcttcttcatagagttcatgtggataaaatacacactatcaataaatgttatctatgattattacatttactgagtgatattgataggctttgtgtcctcacccaaatctcatcttgaattgtaatctccttaattctcatgtgtctgggcagagacctggtggaaggggtactttgccttatggtgttcttgtgatagtgagttctcacaagatctgacatttttacaaggggctcttccccctttgctcctcacacttctctgtcctgccgccatgtaagatgtgcctcttttccttccaacatgattgtaagtttcctgaggcctcctcagccatggggaacttaaagtcaattaaacctctttcctttataaattacgcagtcttgggtggtatctttatagcagtgtgagaacagactgatacattgagccaattccctttgccctgatttcaaattaacattaagcaaccttcagattatgatatggtttcttgtataactcaagaaagcaatggccaatttgagtattggcacgcctggaacaggttttgtatttttattataaattaatggattgaatttctcctgttatattccagtcttatgatcttgattattatgagtctattatgttagcaatgtggcatatgtttgatagcaacccaaaggtcttttgagctaatgtcaagattcaaaaattcaacacaggttgcctcagttaagggtgtaaatttttttttcataagaaattctatttccagggaaataaataatagagaatgcatatagatacatggtagggcatcagtcaaatctaggatgagggggagtatagagagaattatccctgttcttctttcacttatgctgatagaggctaaaatgcaagataatctcctttctattagtaacttggactatttcaatataccctagtttaccaacccatccttagatatgcaaccaaagtgatctcttttttaaaatttattaatttatttattttattatactttaagttctgggatacatgtgcagaatatgtaggtttgttaaataggtatacacaagccatggtggtttgctgcatccatcaacccattgtctacatgaggtacttctcctaatactatccctcccctagtccctcacccccaacagaccctggtgtgtgatgttctccctctgtgtccatgtgttcttattgttcaactcccacttatgactaagaacatgcagtgtttggtattctgttcttgtgttagtttgctgagaatgatggtttccagcttcatccttgtcccagcaaagaacatgaactcatccttttttatggctgcatagtattccgtagtgtgtatgtgccacattctctttatccagtctatcattgatgggcatttgggttggttccaagtcttagctattgtgaatagtgccacaataaacatacgtgtgcatgtgtctttatagtagaatgatttataatcctttgggtatatactcagtagtgggattgctggatcaaatggttatttctgtttcttgatccttgaggaatcaccactctgtcttccaccaacagtgtaaaagcattgctatttcccacatcctctccagcatctgtcatttcctgactttttaatgatctccattctaactggcatgagatggtatctcactgtggttttgatttgcatttctctaatgaacagtgatgatgagctttttttcatatatttgttggctgcaaaaatatcttcttttgagaagtgtctgttcatatcctttgcccattttttgatgaggttgtttgctttttcctgcaaatttgtttaacttccttgtagattctggatattagccctttgtcagatagatagatagcaaaaattttctcccattctataggttgcctgttcactctgattatagtttctgtttctgggcagaagctgtttagtttaattagatcccatttgtcaattttggcttttgttgccattgcttttggtgttttagacatgaagtctttgctctgaatcatattgcctaggttttcttctaaggtttttatggttttaaatcttatgtttaagtctttaatccatcttgagttaattttgtataaagaataaggaagggatccagattcagttttctgcatatgaccagccggttttcccaacaccatttattaaatagggaatcctttccttactgcttgttttttgtcaggtttgtccagatagttgcttgcagatgtgtgatgttatttctgaggcctcgttctgttccattggtctgtatatctgttttggtaccagtaccgtgctcttttggttactgtagccttttagtatagtttgaagtcaggtagcagtatgccatcagctttgttctttttgcttacattttaatattgttatgtgtgaatttgatctcgtcattatgatgttagctggttattttgcccattagttgatgcactttcttcatagtgtcgatggtctttacaatttgttatgttcttgcagtagctggtactagtttttcctttccatatttagtgcttccttcaggagctcttgtaagacaggcctagtggtgacaaaatgtctcagcatttgcttgtctgtaaaggattttatttctcttttgcttatgaagtttagtttggctggatatgaaattctggatgaaaattcttttctttaagaatgctgaatattggcccccactctcttctggcttgtagggcttctgaagagagatacactgttagtctgatgggctttcctttgtgggtaaccagatctttctctctggctgcccttaacattttttccttcatttcaaccttggtgaatctgacgattatgtgtctttggggttgctcttctcgaagagtatctttgtggtgttctctgtgtttcctgaatttgaatgttggcctctcttgctaggttggggaagttctccttgataatatcctgaagaatattttccaacttggttccattctccccatcactttcagacacactaatcaaacataagtttggttttctcacattgttccatatttcttggaggctttgttcattccttttcattcttttttctctaatcttgtcttcacatttttttttattaagttgatcttcaatctctgatatcatttcttccacttgtttgattcagctattgatacttgtgtatgcttcatgaaattctcgtgctgtgtttttcagctccatcaggtcatttatgttcttttctaaactggttattctaattagcaattcctctaacctttttttaaggttcttagtttccttgcattgggttagaacatgctcctttagatcggaggagtttgttattacccaccttctgaagcctacttctgtcaattcatcaaactcattctcttccagttttattcccttgctggtgaggagttgtgatcctttgcgggagaagagacatcctggtatttggaattttcagcatttttgtgctggtttttccttatcttagatgatttatctacctttggtgtctgatgttggtgaccttctgatggagtttttgtgtggacctcctttttgtcaatgttgatgccattcctttctgtttgttagttttccttctaacagtcaggcccctctgctgcaggtcttctggagtttgctggaggtccactccagaccctttttgcttgggtgtcaccagtggaggctgcagaacagtaaagattgctgccagttcattcctctggaagcttcatcccagatgggcatctgccagatgccagctggagctctcctgtatgaggtgtctgttgaccgctgctgggaggtgtctcccagtcaggaggcatggggatcagggacccacttgaggaggcattctgttccttagcagagctcgaatgctatgctgggagatctgctgctctcttcagagccagcaggcaggaatgtttaagtctgctgaatctgtgcccacagctgccccttccctcaggtgctctgtctaggaagacagatgttttatctataagccctgactggggctgctgcctttctttcagagatgccctgctcagagaggaggaatctagaggggcgatctggccactgtggctttgctgagctgcagtgggctccagccagttcaaacttctcagcggctttgtttacactgtgaggggaaaattgcctactcaagcctcagtaatagcagacgctcctcctgcccccaagctcaagcatcccaggttgacttcagatggctgtgctagcagcaagaatttcaagccagtggatcttagcttgctgggctcggtgggggtgagatacgctgagctagaccacttggctccctgacttcagcccccttgccaggggagtgaacggttctgtcttgctggcattgcaggtgtcactgtggtaagaaaaaacactcctgcagctagctcagtgtctgctcaaatggctgcccagttttgtgcttgaaacccagggccctggtggtgtaggaacctgaggaatctcctggtctggtggttgtgaagactgtgggaaaagcatagtatcttggctggaatgcacttttcctcacagcacagtctctcatggcttcccttggctaggggagggagttccccaaccccttgcacttcccgtgtgaggcgatgccccaccatgatttggcttgccctccgtggactgcacccactgtctaactagtcccaatgagatgagctgggtacctcagttggaaatgcagtgccttctgcattgatctctctgggagctgcagaccggagctgttcctattcggccatcttcccagttaccaaagtgatcttataacaagaaaatttgtttatatcattcttaatttcttcagtgatttcacagtgggcagggtaagtatttacctaactcacagaatactccagcttcctcaccctcagaggtaaggcccaggcagtaatgttcatacattaaagtaaatctatgcccctggctgcagttgattataccaagggttaaaacagctgggccaattatattctttcttctagaaatttggaattgtgatgaagaaagattagtctcttccaattgctggactcagtagttgaatgatggctatgtcttctgtgtgaactgtgaagcagagaaagctggtctagttagaaagaaaataatgaaacagaaacactaagaagaacagaagtgaaagaaggtgacatcttcataggctcgcttctccttgtttctgtttctaaggacttactgaattgccacacttgagtttcaagaaactgcctagatttttctgtttaagtcaaattattttttagcttaatcctgaattatgttttaactgattgcaactatgaaactccttctcttggaaagtgcagtctaacatgatacccttcataagtgttttttaccagctactggtcagcctcaccttctactgtcacagcttctgcttgattccccatctctccaccaaacaccacagaagacattttaactttttatgttctcataccatggtgttttctatatgctattttctatttctacagtaatcacccatccttgtccacttgctaaatggttacccattctgaacacttctatcgtgctttggagattctcacattattgtacataagtcattgaagaaaaatgatttgcatatctgtctcaccaccaccaccctataatctcacaggtggtgaacatataccatttatattttttaatttcacttctgtattctcaattcaaaatacacaatatgtgctgtcatgtattcctgatacatttacatcttttaatcattcataagataacatgtatgttcaataagcacaactactaaagactttggggttgatgatattatttctgggacaagaagataaaataaaacctgagattctaaagagttacgttctacttggcattcccaccaggacataaaagttctgataattgttagtcatgagcccagcaacataaaacatcataagctctttcatcaatgtcaacgttaaatcatatttgatgtattaagtgccagtataaaaccaataacagcagcatcctgggacatagccagaataagagctgtgaaggatcatttgccgttcataactgcattgacttgagcacaagtggggattaaagaacagcaggctacctaatcagccactgtctggagagctgaagttgggttatcacaagctgagagggcagtgagagcgacagtaagacaggtgtacatctgaacaggttgtcaggagacaaaagtgcctgtgaagtggccatcagaattgaacaatgaagtgtgttggtcccactgagggtgagtcagtcacaccgccaggatagcagatgatgaagtatggtgaagtaggagaagaaatatacaggagaagaaatatacaggatgctcctggattatgcttgttgtctttgtttaattattaagcaactacctctgtgtcttcttttaaaaagatgcccgtttggtgaaaaataagagtgactgattataaacaaccattaaatcaaaatattaccaaattctgcacacagaccaaagttacaataatcctgttaaagagtttctaaaacattgctgtgatgcatttctgggttgtgtttgtgtaggtgtctgtgtgcccagaatccctttgagggaatcttcgcagtccatgtagttcaggcgaggctgcttcagtcacccactgatgccattcggtaggcatctaacctaactgcaactctctactcccaccaaatcacaccagtctgggacagaggccttcctaggatactgacagaacttttgaggaaaatatctttttatgagtgtgaaattctgattgtcatctgtgttataaaatgggaaaaagggaaggagtaattaaggtaacagaggaaaagagaacagagaaacaaagaattccttgtttcaaccatgcctggagtttattctcagttatgggagacaatgagttacctttttgctcagtgtagtgtgaattgggcctgcacatattaccaagatagtcctgacaaatacaactgctttttcactaaactgtccaactttttatctgccccatctcattataccaaatataagcccatgtgcagcagctgtacaaacaggacaaaaaagaaatagataataggatgggtctaggctttggtcagcaaagaactaagccactgtccatgactggtgctccagcaagcacagctcttatatcagtcgctaatgtgcttatttctctcacgattgagatgcaagcaaattttaatagcaataagcaaagagatagaattaaaatgcaacattaattttactggcttctcacaaactgaaatattctgaagagaaaattgaaattagcatatactgagcttagaccctaaagtgttagaagccaaaaggttttagccttggcatggccaaaagcactgcttactttttgataatggcataattgctttttttcatatcagtgaaagcagaaacagaagcagcatattgactttataagtcataatcaggctggcagcctgtattagtctgttcccacactgctaataaagacatacccaagactgggccatttctaaagagaaagaggtttaatggactcacagatgactggggaggcctcacaatcatggtagaaggttaaggaggagcaaaggcacatcttacatggtggcaggcaagagaggatgctcaagggaacagcccttttataaaaaacaacaacaaaaaatcagttcttgtgagacttactaacatgagaacagtatagaaaaacccacccccatgattcaattacctcccactgggcccctcgcatggcatgtggagatcaggaaagctacaattctggatgagatttgcgtggggacacagctaaatatcttagcccttgccttccttaacatttctctgctggaatcacagatacactccatataacacctcagtttagccctggctatgaccaggtaggtgctccttggcattgttatagggctagtcttgcatattgggcccagcctcaatcatatgatgggagttctggcactctctgtccacttcattttccttaaccctactgcttcccccatccagaacctgaaacttctggttatatctaagacaccacctagtaggactgcattctgttctccatgctgtttactatacaattttctatgaaaagactggttgtttggaatcacagtaactccctccacctggccaagagaagcacagccactgtcatagtgtatgtctgctttggagttcattgtatattgagtcaaatctaaaattttatattctagtagacactgaatatggtttcacctaggtgatttcatgtgtttaatactgcatcaaaacatccttggcaagttcctgccttctttattcccacctttctgtcactaagttctctatattttaaaaataaaccttaaaggttatgaattgctgttggatatacaaatatataggagcaatactagttaggaggcttttgttagaatccatttgagagactatgttagtttagtccagtatgttagaagaggtaagagttggtcattttctaggtatttttgaaggtagatctgatgggattttctaaaatgttggatatgggttgtgccagaaagaatgccatcaaaggtgacacctctattttttatttgagtaactggaaaggtgagttgctgttatcctacttagagatgattgagggaggagcagctttggagggtacagagatggagaactagtttgggaatactgtttgtagtatctattaatcatcaaaatagagacgtagcattatttaggcaccctgaaggccaccctcactttaacaccagctgaaaagttcaagggcctccaaggccaccttcacttctgacaccagttgcaatttcaggggtcccaaagattactctcaagtttgataatttgctagaatgagtcacagagtggactgaaagctgttatactcatggatacaatttatagcagcaaaacaatgtaggttaaaattggccaacggaaggagtgcatagggaagagtccaggagaggtccgtgcccagacttttcagttgttctttcccagtggatttgtggacagtgctcacttcttcaggcaatgacctgtaacaatgtgcatgtagtattgccaactaggcaagctcactagagcttgaatgtcttaagtgtttattagggtttaatcatgtagacatgactggccacccacttggctgacctgtagtctccaacccctccagaacttgagctgatgccacatagctcaaagcctctaccatgaatcacattgtttgactaatcacattgttagcccaaggtgcccaaataaacaaaagcactcttgttagataggacatgccaaaggcttagagagtgtctcccaggagctaatggcaaaggccggatctctctttaggtaaaattaattctttattacacagatgccaaatagaaaagtgaatttaaaagtctagagtttgagaaagtggactggtaagagatatgccagcgtacagacagtgtattagagtcctagcagaaagtaaaattcacttagatggttttaatgaaaacattttgataaagataccccttacaggactgcaggcaagattttgagatcaagtagggcctgttgagacacatatataccatcctgggatccaaaggaaaagcagttaacagaaccgatgaaaagggttaacatgtgccaagcacagtgctaagtgatttgttcatttgatttttcctatatggtaataattattattatcaaatgcttataagggagaaaactaaagtttaaaacatttaaatacctttgtctatatttgttcaggagagagttaatgacctgggattcagcctgaatctgcctgccacgggctgccatgccacttatatgattctaaaatttgacattgttatgccacatataagatcatcctgtgggtttcagccgctctccatgacttacctacaaaagggtgtctagttagtgactctcccacttaggctttcctgagaggcttctgctttgctagatcagggttgtgagcatttctggtatggaagtttacaaatgggagtggagtagaaaaaacaaaaacataatggccgaattctcctgtggaaggaagttagggaagaggtaaactagacttccaggaaaacagaagcaaaggaagtatgtatgtgtatgattctaagtgtgtacacacatacacatgtacatgtattaagtgtcaaagtgtgttttcaggatttgggtgtgtttgagaagagaaaaaaatacaggattttagttgcaactgactataaatttgtacacttttaaaatgttttcatgggattgtaaaggtctgaattcctgctggaattctatttatttgaatgtatcatggttcaaggttatcaagtgtgtcctggcttcgaagagaacatagtgcctagaatgtatcatctatactgtattattattatgatttttgttacaaagcgtggaagggctttgccattaataaaacaatataatggatatgatttaatatcattaaaaataatcaagagattttaatatggggataaccattatataatcccaccatgcctatcccaccacctgggtcagatcccgtattgaaacatgcccctagacacagaactggactcagaaagattcttggcacagtgcttcatttagctacaaataatcaattatccctgacatgcaagttaaaactcatttgccacttggtttataatgtatcaagctaaaatgttttaacatgttctgggtcttcaatttactaggttatatcataattttaaaataaagaaaatttcaaagaaagaaggcaatatctctgtaaaattagcattcagacttgagtatgtcccaaggagactagccctccaattctattttgtatagctttcttttcctcctctgagaaggtgaaaaactctttgaagatttcctttcatttccttttctcttctctcttatttctctaagccccaattatctctgttttcaatgttctctgtacagaaaaaatccgcatcaccacccacctccagaaggagagaatggctgataaaaaattggagattggattttgtttcagtgccaatctactacttgtgtcaaaccattttaaattttctcattatagttagctctcttctctatttttacagcattgccacacattacaaaatccatagctggtacatatgcactatttagttagctttaaaacatttctgtagcccacatacattctaataaaattaattctttgaaaggccatactttggcttctgaataaattattatcttttctcaactgaaaaaaaaagatgatgatgaaacatggaatatagatgaatcatttttgtgtagcttataatacaatgcattttgggttgagtctgagcttgcataaagactgactgaaatgataaataggcctgatgattaagccaggtggcaaatcactagtttgtgtagctgccaaaatggatacctgggtatgggaggaaacctgggactcccttcctggggatagggtagtcgaggcctgccgtagaagtggtgtgattaatctctttagaagagagtgccagctgcagtgtgcataaatgtctcctcctggattctccttaaaagctaaattgatgacagtctcttaaaagagcagctcagccctctgtccctgtaagataaagacaaaccttgatttcagctactactgaaataagtaaaagtagaaaaaggttaaaaaaaaataacagtactgtactcttagtgaaggaattagaggtaatagaatgttactcatctaccaaaatataaggataattgcaatgtggtacccttttttgttagaaggttttgtggagcccatctgtgcagattgtttgttttttactatcattacatcaattaattacattagggaagaaggggacactttaattaaaaggctgttttaaggagttataattctactctgtcattaaataatttaacaatttaaataggcaccaaatttgttagtaaagaataattctgaaaatgtttgtttgtaaattatttatattaaccacattttcagcaaaattaattttgcctttttatttcatcaaatcaaagcgtccattgatttcttcattttgaccaatggactgtaggataggaagacatataaaccatctcaattattttgagagacttattttttcctaaaagagaaaaacctctcattttaccaagtatgcatatttgcttgtgtgtgatatgtctgattagggtaatcttttctgcaattggcatttttagaacatgatgagttgcaaagagaagacatggctggtgaaaagatggatatagacccacagaaataaatatatagccaataatgtaatttaaaaacattgctgctacttaagtccatacttctttggataaaaaccttcatccacataagttatactacaggaatgcctttgtgtatttcacataaaatgggtggataaacatctattttttggatgtcttgaatgcatctttctttttgtcaaccatcttccatttttctagagtgtgctaaataatggaattcagagacttgtatctaaatgtcagggaataaggaaagcaaaggattaagaatgaaaataaatatggaaatatgagaaataatatcatgggacagaacaagagaggcttagaagctaagagaagattctaagcaactcctggtgcaggagttgatggaaagtgagaatttaaaaataatgattctgcattctgtatttaaactgttctctagactgtttctgtctgattgaaatagtaagccattttttttaaaacattgaatgtgaaaagcattatagaaactgcttttgtacttaaaaaaaatgccagagtcaaactgtatctcatgcagttgaagactgaataagtaatattattccagtcattatatttatctaggatcagtgtcttacacatagtggatgtgcaaaaaatatatgtggaatgaatgaatgaagataacattttactcaaatttttaagtaggagacggcaggtcctactagtagtgaggtttttatctttttttcactcttcaatgttattccccagggaaactggcaaactgaaatctgttacattaatgccagcagagatgtatgagtgtgaagagaataagtaaacatttattgtacctgatggctcaatggactatcaacatgagctcttaagagacttgaaaatacttggcagtgtttatccttaggatgaactctacaaaaactatttgtggacattattttcagaaaatttctattttggggtcagctgagctttttcaattcaaaacttatgagctaatatgtaactatataacgcctttcctttggcaatgagttaatttcttaatgttttttaattctaatgttaggttttctatctaaatcagtgtcaaaatatcatccaaaaatagagatagtagctagtacatttttaatacaatattttcccatgttacccaatataaacataatgacaaacagccatttactgagagtctaatatatgccagtttatttttcagagttttacatgttaaaccatagatgattttaccttcttatagagaaaaatatatcaaagctgagagtaacatagtgccttgcacaaagccacacggattgtaaaattttgaactgagattcaaacccaacaccccagctataatagactaaatcccccaaatttacatttgacgctcacaaaatcttgtgaggtaagtagggcaaaagcaatttttattttctttattcacctagggttgttatttgattattctgcatttatggaaataattttgtgagaatgatagaaatttaaaatgggaacaatttaggggtaatctaaattagcaattcttagacattttcgttttagtaccactttacatccttaataattattgaataactctaaaagtatttgaaatatgtgctatattccttgataccatattagcaataaaaattggaacattaaattcattattagttatttaataacaatagtaaactacctcttcacataaatattatatttttatgataagtacctagatgttccaaaacaaaaaaaaagtgagaagggtagcattattttatatacttataagtctctttactatttagtttaatgggaggcagctagattttcacatctgcttcctcattcaatctgttgtaacatcacatgtcctgtaacgtctggaacactccactgcacatgtgtgagagaatggaagttaaaaaaacaaagaagggctgggcacggtggctcacgactgtaatcccagcactttgggaggccaaggcgggtggatcgtgaggtcaggagttcgagaccagtctggccaacagggtgaaaccccatctctactaaaaatacaaaaattatccgggtgtgatggtgggcacctgtaatcccagctactcgggaggctgaggcaggagaattgtttgaacccaggaggcggaggttgtagtgagccaagatcgcgcaattgcactccagcctgggtgagagtctgagactatatcaaaaacaacaacaaaaactacttagtattatttaaaaatagctagacttcagggacccttctgaagggtacaggtgtctgtggagccacttcgagagctgctgatctagataaaactttcatttagaagacatggaaattaaggtgtctcatggatctgctactgatgatcgattagagaggggctgatactttcctacaagggtattagatatggctaggatggatgctcaaactatcttatggaaatatatgaaggtgattttgagtggcggtttgtattttacctccctcccactgatgacacaacaaccaacccgcacaacccttctgaaactacccttgcctggaacagcaatgatcttgttaaattcaataatcattttttaaaaagtgcttactgagatttgtttgttagcaacccttgacatggctgatcactcccttcattttgactcaattgtatggtcctcccatgatctcacactcagtgaaagcaccctctctctccagatgcccaaccagaagtcagaaacttcccagactctgatctcttcctcaccaagtgatctcaatcatcttttcttataaatatctcagtattccatccacattttttctgcctgatattttgccctgactatgcatcttacctctcttacattatcactactatcttctaacgatttgattttattccttatttttatgtgtttttttttccaaattttattttagtttccaggtgtacatgtgcaggtttgttacatgggtaaattttgtgttgtgggggtttggtgtacacataattttgtcacccaagtaatcagcataataccaataggcagtttttcagtcattagttcacttcaaataatgaactccagctctgtctgtgttgttgcaaaggccatggtctcatttttatggctgtgtagcattccatggtgtatatgtaccacattttctggtatctaggttgatttcacatctttactatcatgaatagtgctgcgatgaacatacacatgcatgttttttaatggtagagttatattcctttgggtatatcccattaatgggattgctgagttgaatggtgttttaaattctttaagaaatctccagactgctttccagagtggctgaactaatttacattcccaccttttctccacaacttcaccagcatgttactttttgactttttaataatagtcattctgaatggaaaatatttgcacactatatctctgacaaaggtctcatttccagaatctacaaggaactcaagtccgcaagcaaaaaataatcaacctcatttaaaaatgggcaaaagacatgaaaagacacttccaaaagaagacatatatgtggccaacaaacatatgaaccaatgctcaatatcactaatcattagggaaatgcaaattaaaaccacaatgagataccatctcacactagccagcatgggttttattaaaaatccaactatttctttccccggttcttctcatcggtcctccataatctgagcaattcttttgaactacagattccaagtgggcacttttcacagctcttaggttaaagccccaattctttcaagtattttacaaaagcttctgaagcagccccgtgcttgcatctacagctgggcttgtcactgattcttctttgcttcataagattctctgacctgctccctcacttccatgacagtatataaaaactgtttattcttctatatgcattcctttgactctttctctttttattcatgtattaacttggatgtcacctcctttggaataatttcccctgagtcctcccactctgagttagattatcctgtatatgattcctcaatgatgtgttctttccaaccaaaatattatttgccagtcttcatttgtagttacttgcttaatatcattttcccctgtatacttttagtattgtatgcacagaaacttcatctgattttgtctttctatagtgaaagaataaccccattaaaaaatgggcaaaggacatgaaaagacacttctcagaattgttctacccaatgttgagaacaatgttggacttacagtaagaagattataagtcatacacatttgttagatgcattattaaatgaatattttttctcttttttctgcagttagttgtatttatggttttctgactcacctttatgaagttgagaatcttgctttgaattaattattttattgtcctgctagtataatatagttactatcctgtatgactgctatgccaaagtggttcaaagactggctctcgtatgacacctaaaaccaggtgaaaccaggcctatatttggaaatttgcctcattcttttatgaccaagaaggtcatctgggaagattggttaaaatatgcatgcatgagttctaccctctgaagattctaaattggttgtttagattgtaagcagctccacagattactgccacacctttcaaagtgtaggaactactgacttactgcaagaatactctggtttatttataaaaagtagttaaagagttaccttgtaaaatgtactctaatttagtagcagagcactcccatgttcaaagaaatatatagttttctgaatgtatagttttctgtacatatatgtttggaaggacgtcatagccgaacattaaactctagcaggtattacaagttcaagtacctatttttgtttctttacagctcaatgttaacacctgtactcattaaacacatcttacttctctagaacttattgtagtatgtttaatggatgcatttaatatcaatttttatgtagtatttatttaaatagcattagtaaatatttaactttgcaaaacaaaatgtggtaatactattttaccatgcaatttttgcagctgttatgtgtagaagctgttaggtgtagaagctgtataacttacagtgaagcaactttatggggccatgtgtttttaaaacaaaatataccaagtatatttgtgaattcacattttttattgttaattgatacataataattttgcatatttatggagtataatgtaatgttttgacatatgtatatatgtactgatgacattagagtaattagcatatccattaccttgaacatttatcatttatttgtgataagaacagacaaaatcttctagctattttgaagtaaataaaaccttattgttaactatagtaatccttctaagcaacaggacaccagcatttattcttcctttctaattgtaactttgtacccactgaccatcccctctccatccctctcttccctctaccctccatttatttttatttatatttactcctgttttcaaaaaggttaagtaacaggtatgtatacatacatacagacagtacatgtacgcacacgcgcacgcacacgcagacacacacacaccacacacacacacacacacacacactcgagaaacagagagaaggaaaaagagacagtttctgattatttacaaatattttgctttatcattgtttgtcatactgtattgatgaaggtagtttttcagggaaaatagaaatagatactagtatagagatgagatttttaaaagataagaagaaagagtagaaggagaaaagaaaattgcttcatttgatccaagctgcaatggaattggatgatctttttttcttttcacactcttttatatagtggatcttttgtgtcagctctttaatgtgtttcattacttgaagactgtataaaggaatacattcaataatttttctcttattttaaaatgcatcacagttatatgacttattggaaatatattcattaatgtgatatatttttaatttaattatcaggtacttctctaggagaatgcttactttacaaatgtgtgcaggtatatttactttttaatttaatgttgttaactagaaaacaatacaaaaattgttagcattattttttaaaataattatggttcaggctatttaaaatctattttattaaggaaagttatttcactgttacatatacaccaacttgagtttccaggttattcaccagaacattacatgttactgacgatgaaaaccaagtaaccaaagtttctaataatagggaatagttacataaattaggtgcgtgataaaacacagtgttcattaaaggcaatctagaataataatcactgacttacaaggccctctaaggcattatcacaaaacaattattaatgtaaaatacaatacaaacaaagctatgtgtgtacacgtgtaaacgcacagaacgtgttatggaaaaacagtatttcaagcctttaatagtgacagcctgcaggggagtagaactggggtataaagggaaactattttactctatgtctttttatacatttaagttatttatattaacttttagtcatgtgtttcttttataacttgaaaaatgtcttaaagaatttgagaaatgtttattttaacaaaaataacagaggatatggaattgttttgaaacaggaatttcaagttgcaccattaaatacacttatacatggtcaagaaaattatgcgttcttggccgtatcaaactatctcatgtagtttataatatacaaacctatgtaaccacaaaaattaaaatgaaataagaagaaaattatacattctaatgagtgttttctgattctttgccctactctattttttatctctaatattcttttttttttttccattttaattaaaggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggtaacctttaaattacttcaattcttgttttcttcataaacttgcacttacaatatgatcttcttttaaatcaaaatattattgttatgcaatcagttataataaccttgatgtaattttatgatagaaagtctgacaattgcttttaattaattgtcttaaaagaaaagtaatgtaaacattgatgatcttcaaaacgggttgttggaagtttggaggttattttcaaatgactgcaatgctgttggttaatgagatagttgattaatgagatagttatttctttttgttttgaaatgagggaaggaactaagagtcaaccagttgagcagctcactcattacaatcagccagtaggaaaaagatgtaatagatttaccatttacctgatatttactgtaagagactttatatatttgatcttatttcatcatcactacaacaaaaagaagtagggactatctctactttacagacaaactgagtcccaaaatgaacaagtaacttgaccaatgtcaagtagcaagaacatagcagagggattgatatccaacctaatgatgttaacaagtattcattccagaataaagcattgcctgacaaaaaccaaccaaccaaccaaacaaacaaacaaaaccttctaaatcaatcaaacaaaacaatttgtagctgtgaaatcttttagtattatgtcagcattattcagacctaacagcaaactggaaaacagaaattattatcagtccatatcttacagatgaaggaactgaagttgggagttaaatggccagaacaaggccctacacttactatgtagtagagcctggatttgaacacaaatttttggattttgtttcttaaactcttttatgcacactgagctgacacctttgtagcttggaactagtcagtcatttagaaacctctcatgtataggacaaaatatttctactggagagttacgcagattcagatgtcaaattatatcccattaaatataactgccaatagtaaatgcctgttatagcatggttaatttattaaacagatgtttatccaatattccaatataaatgttgattttcacagtaaaatatttactttgatttgaaaaattgctatagttttatctttggataatgaagcatatgagagtttttgggtttttttggcaacaaataaaacaacgcactaagattactactgaactctagagtcaagatttatttcacataattcccaaacaattcctgatcatggtttgaatacacaggcttggaaaagagacctttcctttactcctggagtgagtggcactaagctatttcagtgacagagctttggctgctttctctaggcttctagtaagtatgtaaatgatcagctgtcttttctctaaagaactaactctcactattttgctatctggaaggtgagaagcctgtcacctttaaatttgaacttgctttctgacttctattagatatatttattattttatacttgttttcttatgtgttctttgcaaacatgctttgtttgcaaaaggaaaacagaaataatagaatatttaaatacatataacagaaaaatgtaattttaacaaggtcagtagatgaaaaattagaaaataggtaaaatgagaatatgaaagttgagatgaatccagagcgacattattatacagtatgcatcctctgaggtcctataccagaagaccacaaatatggtggtgttatttttaactttgtctcacatttgaattttccagttattctagtaaccaagaagaaagtgaatagcttctaggaaattcagcagtgcatttaatagggtcctattttgtgatttgtgaaatttttctgagattcctgaacattcactgatgttggaactcctaagacatggtataggagttgaagagcaaaaatagatgagctttcagctagtctggcttcatccaagaatgaataataggactatgcagaaaaataaatggccttaatcagtttactcttgtgcgtttgtttgtgtaatttatttaatttatttatttaaactgattgagcttttactagttattgaacaacagtgaatttgaagttttcctgctagaaagctttaaaagtgagtggagcttgcggttgagtagatttcctctgaggcaagttgagtacactaattggcatgcatgcctccatagcagatgattctacctccatccagatttatcaaagaaaataccctagggcagagccaagatcctctgaagtaaaacctcacaaggacattctatcacagggaaaaaatagtaatcaggaacttcaaagtttagatcagagagtgtgaaataaaaacttttagcctggaaaaaatgtaaaagaaaatgctaataaaatcctacagtggtgtgaagtaaaataaagtaaaaattgaagaaatgtgtataggcccccctcatattgttgaccttgagcaatatgatttctggatcttacctgaaaaataaactggttgcatattatctgcctagataactgcatgtgttaattcatcatatagcatagcactacaccagcttaatgttggggtttctaataatattttgactttagaaaatttaatctgtagtatttcttttaggagagatgatatgacaaccgcttttatgttgaggcaattattatattatttgtgcataaaaacatactgattttattctctctaatatgtttgaagtgtgcatacaattcactcaaaagtagcagtaagacatgctataattaaaaccagatccagagcaagttatttaaaaaaaaattctactggaaattattaactaatcttttaagagagtattcctgttgttcattctttttgagtaaggttacaatgtaggtacttaatcaaaaataactactatttctacctccaattttgtttgtttgtttgtttgatggagtctggctctgtcgcccaggctaaagtgcaatggtgcgatctcggctcactgcaacctctaccttctgggttcaagcaattctctgcctcggcctcctgagtagccggtattacaggcagctgccaccacgcccagcgtattttttgtatttttagtagagacaggctttcaccatcttggccaggctggtcttgaaatcctgacctcgtgatccacctgccttggcctcccaaagtgctgggattacaggcatgagccaccgcgcctggcctcccagcgttttctacgtcatatatcacagcacattaactgatccttgttttcaaaatcaaaagctgagagaaggtcaatgaaagccagaaacagactccaattaccctcatagatttcttctcaaggtgatgaagaaaaacctgtagccattggaaatacatatgtcagaacaaatcatcttcttctccaccatctcctcaacaacttcccctacaccaaagcagaatttgatgcacttgcctgagacgtccatgttttcaaattttcaaggaaggaacaggcaaaaattttagaatgcatggagtcaaaaattgttctacaactttgagaatatgaaatataccactttagaaaatgacatagattccaaactccacattagagacctggagtccatgtttactcactgtctcactttgttggacagtttattcattcttttcatgtcctagtttccttacccataaaatgaacataatagtaggactgacttctagggtttttatgaggcttaaatatgtaatgtgcttagaatagtatctgacaaattttaagcattatataagtattatttttagttatacatctgaatcgttatttctttcaattacctttatctctagttctatacctacagagttgataaagtaaaaaaaattgccaagcataatattgagctgtcattgaatggtactggagatagggagccatctgaacatatccatcaggagcaatgaatgccttctacaaatatgatcttgtaaatttgtatttaataagggaaattctgtcttattttgcttgagatgaaattttaatccgaatattattggtttatataagtattacccactgaagaaatattatttggtaatttgatacctaaatttcctgtgctcaattctttgatgccacctttcattaaccaatgtttctccctttttaaatatatttgatacattccaaatttttcacaaatatctattccttcttaaagaattcatgttgcagaactacaaattctatcctacctaactggttaatgctgatttatgagcatgatgcttttcttatttttattttttatttttaattgttgtgggtacatagtaggtgtacatatttatgaggtatatgggatattttgatacaggcatacaacgtgtaataattacatcagggtaaatgggatatccatcacctcaagtatttatccctgttttttgtttgtttgttttgtaatggggtgttgctctgtcactgcagcctcgactttgggagctcacgtgaccctctcaacctcagcttctcgagtagttgggactaaaggcatgtgccaccatgcctggctatttttcttttctatttttttttttttttttgtagagatggggtcttgttatgttaccaaggctggtcttgggctcaaccagtcctcctgccttggtttcccgaagtccagggattacaggtgtgagacactgcacccagccagcatttatcctttatgttacaaacaatccatttatactcttttggttattttaaaatatacaattaaattattattgactatagtcaacctattgtgctatcaaatactagatcttattccttctattttttaacccattaatttctatatgcagaatgtagttgaggcagctacttcataaatgagtttttgtagttagtggcttttggaaggctattagatgtacctgagaataattgtttcctactaagaactcttcattcaactaaaaatgcattgttttttaattatccttgccaactgctgttcattgataagcagttatttcaaaagcattctcttatttttggagagaaaatgacatggacacttgttataactaaaagttctaacccaaaagtccttgtttttaagattgacagtctaaaattgatgaggactgtagaagagtgaaataaaacacagtaatttgtgactagtttattaataacaacaaaaacatttctttaattatatgtaatttttaaataagagtggtaatttacatttccttcattaatgctatggaaatgtctctaaagagctaaaataaatgcctgttggcattgtgttttgcagcacttttttcctaattcagtaatattgttcattaaaataaaatggtgttcctcattggagtatttgtagtgaagacgttacgaatgtaacaaattaagatgtgctaatttcaggttttgtgtcaaatttaatgccttctttaatgtgttaagccatagctttacaattgcaaacattcagctaatagcttttctatctagagaattgcttcagaaattccttcagtaaccactaatctttaactactgggaaaagatttagtttaacctaattgtatgtaacatgaatattgtaggttgattctttatcacatcctactatattttgttctcacttgaattactgacatactgtctttcctgaaatatgtaccttcagtaatttttttttttccttaggcattagctatgggaatgatgacagaatactatcattatatctttaccactctggtaagtacttcattaaaacaaaatgttctgaattttattattatgactttttcagatgaaaaataggttttttagtaagaagtattatgactgattcctttgtagttatattttaatttgataagactccaccaaaattattatcagagaggacaactcttaatagaagctgatgattttgaaataatatcatttcagatatcaattcaaaatattgcatatcttatttttatgttgctttagagaactttcagaatataatggatcttgaaattagtttcctgagaaatcagtgctttagaaaagcgcaaattcagccgggcacagtggctcatttctgtaatcccagcactttggtaggccggggcagaaggatcacctgaggtcaggaattcaagaacagcatgaccaatatggtgaaacccatctctactaaaaatacaaaaattagccgggcatggtggtgggtgcctgtagtcacagctactcgggagcctgagacaggagaattgcttggacctgggaggcggaggttgcagtgagccaacagtgccactgcactccagcctgggcgacagagctagactccatctagaaaaaaaaaaaaagaaaagaataagacaagaaaagcacaaattcttatgttatctcagctgtattcactttttgaaaatcagatgtattgaagctgtcctttcagtagattacattttctattctgcttttgcctgtatttagttagattttttaaaaagtcaatatactttaatttgccatcagcaaattgaatgttacctttatattttgttttcacatacccatcacacaattttcccttataatgtatgaaaatctgactttaacctgtatcaaacttactgttagctccattttgttatcaattcattatcctgacctttctttctctgtaaaacagctgtctctttactaattctttcttccacatgtcccaaatatgagtatctccaagtttggacttcatccaatcttattttctcttcaattattttcttcagaactggtttgtatttagagcctcagttaacatcttcgttcgaatgaggtctaaatgttctatgtaatatttatgaattactgtatactgtaaaacacttttaattgttgtgccattagataatttcaaaatatttaaactttagtgtcctctgaattgacgtctcttctgattatcttaaaaatttcaacttttgttgactcctgtatcaccaacaaaattttactgatttttcctttgtagtgtctctagcatctatcttctccattcccataacaaccagtctaaccaaagttttcttcattaacttgaaattcttccagttagtctccttgcttctagaagtcttgaagctgccagatcagattattaaaatttaattgattgcaatagcttcctgtgatgacaactcttacctccaaaggagattattcatgcagtaggatgtattttacttaaaaatagcaaagctggctctggcatatctctatattatttcctagcagacaactttttgcagcttgtaagaaacttagtggtgggggtggagaaggaagtgagagcattccctcatcagcaaattatatttcagtgctgttacaactcagcataagcgtaagattttggggaaatcaaaagtatctctcaatagggaaaataaatgaaacaactagtttaggatacatagaactcataggcctacatttgaaggccttttatactttgatcctaatcaaactttcccatttccttttgctactattctcctttaggaattctcatttatagctgaactgatgtggatcagtctcctgaataggttttatatcttctaatttttgtgtctccactcacactttgaattctctttttgtcaatcatcagcccggtctttctttaatggcagctgtaggggagaaaagatttcttttcctcacacttcatgaggttcaaggctgagatctctataacaaaagagaggttgacaagagaaacacctaaaaatgtatttaatataaattttatgtgacacaaaagccatcagaaatgaagactcaaagaaatgggaaaatctggattttttttttttttttgctttggtttgataaagagtagatagttatgtaggaaaattattggacaaagggaggttatgatctaatggcaataaatccagaaaacttagcaaggccaaattgttcagattcttcttgacctccaggtatagggctggatccctctggaatgagagtcttatgacctcctttctgtgggggtaggtcagagaattcttttatggtccacttcaggggagaaaggtgggataaggtcacagagtgaccttcctgcttctgtgtcttctcaatttcctatagccaagtaccatatttgggggtagcatgttctgagcctcatcacagctaagatcccatctgctctgtgaagtttttcttgaccatacaaattgaaaataacttgtcttgcttctgacttcttttgcatttatgatttctactcttttaccacttggcatatattgccatcctttatttattcacctctttcctatctccttggctagattgtaaacattaaaaaataaaaacctaaagattcctatgtttttcatagcacagactagagctcaggccaatgccagctgctttccactgaattgtattcttattatctagcctgtgtagctgtatgagtctgaggcaagctgttcacagaaccaatggcattaatcttgccttgattctcaatattgtccataagttcgagggttagctatgccaactagaaagagggcaaaactccacatgctggatgttttcatggtggcatccatttccatgatagctttggcctcatatctcctgggacaactaaagggcagagcaagaaagttcactatatacagactagaaagggcaacaggcataaagtgtttattggaaacttatagtgaagttcctaggtgtgagacatgagatgaaggaactgtattgtttctgcaaccaaaaaggctagtcttggccttagcatttttttcacacctttcatacagttttcattagttagaagctgtattttgtgacttgctttctaaaaacaacaatcaaacaaagaaacactgacaaaaaaaaaattaaaaacagcaataaccaggcgaggaagcaggacacagaaaaaattaaagcaaaatatgaacacataaaataagggcaagctatcctaaacagagagaagaaagctattgcaaatcttagatgtgagttgtagaagagcccattgtttcactggcggatttagaataaaatatatacatagatttttacatacggagcatgtatctctgcaatgccaaagcatgaggacagtctatttgaatcttggtgatttgtgatgtttaacgtcacttgacacaaaggtgttaagtgacctaaaaaaaacaaaaaaagtgactatttcagtaatacatgcctgtgaagatactctgtccataataacaacacaataacatttgtctttcaggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacggtatgaatacccacttaaagatcagtttgtgtgtttctaaatagtattgcatacatatgaacttctgggtttatatgcatacatataaacttcagtttaattgtttgacattaaaagcaaaatatcagagctacaatgcaaatacttgtattaacaatttttttaaatcaattttatatgaaaagcttatgcttccatccaagtatctcaaaaggcattacaactatcaccagggtactacaacataggaatttctgtaaagttaattagtgccctacatgggagaaatgagagactgaaagaagacatacatctggtagttatccttctgatcttacctatcaatatacgaatactcttcaacatgatgatttctggtatctggtgttatataaatgacttatgtcacacaaaacacacaaaattctcgcatgagcttactcactctttaaggctgaagactaatcaataatcacatttgtcattttcaagtcccagtttaaacccagaagcggcactattgcataaactatgaaagaagggtatattcttatataacttagttgtttatgccaaacaactttagttgtttataccaatgcttacaataaaaatctaatggcaaggcatacataattttaagttttcttatactgtgtcctccaaaagataggtaaaaatcagtgtttgtttaagctactatgtaaaaatattatttttaaataagtaatcaatataaaaattatgacttcagacattttatattttttatactaaatccttgaaagatggtatgtatttgacatcatgcatattaattcagagtagtcacatttcagtcatatttactctgtagtagccaaatgtggctagtgtctaccttgtcagacctggtaggtatgtgtcatgttatttttgaaaattataaatgcctgatgttttcttattaaatcatttttctacagactaaagtatcactataattaaggaaatagcttagcagtggggtgatatttacatttcataggaaattaccacctgcttttaatgagtattagtctaaatgcagaatttataaacaaaaacatcctctatccttacatgtatgtagaaaagctttttctattatgcttgtaatttttccattaattacttcaatagcttcaaagcttgtttttgatactgtagggataaaaggaaaatttgatttttttatccttagaaggttttgtaatacaaattgagtgccttcatagagactatgaagaagaaatggttagcctaaaggcatcaactttctgatggaacaaaaaatacatttgttttcagtttgtgagaaaaatcacctactagaatttcaaaatatatccgtatgaatttgttttaaaagaaacactatagggaaattgtacttcgttgcataaagagatagttgaacagttctagtagtttagttttaacttatgtttgagaatttttattgagaggaaaatacctaaataacttaaaaattaaaatattttccttcaaagtggagccagatttaaaataaaatgcaaactagaaaaaattataaatgttatattttattaccagtttaaagatggtgaatcaaacttttgaaacttaagacaatgtgattttttaatattataatgtatgctatcctttaaattgttgttatgatcatgtgaatatttttatataatatataaaaatatttattatataaaaatatatattatataaaaatatttaaatattatataaaaatatttatatattataatagctttctttacaattctttgatttcaggatgaatgtcttattatttattttcaatagcactattaaatggttttaagaaaagtaaatcagtagatatcagcacaattttacacttttatatatttacttccacagataaataagtccaatgactaatgtgccccttcatgtatcagaatcataaaaattattcaattttactttggtacactctgtatagctatgtgagtccctctgtgactttacacatcatctcccgaaatgaagtaatccctaatttgtggcaacttatgtaaactattgaaagacagataagtacaaagaatgatgtattaatttccaaggtagaagctcttggagagaattaacctctacaatatggaaaaagagagaggatattaggagaattacaaatttgcattctctctttctagcacgagtctattcctcttctgcttttccctgttgaactggcagatgatttcttggaaggggaaaaatgttaaaatgaaaatggactgatgaaaaaatgtgtctattaaaaatcctgggcattatatataaaccatggattctgagttatttagaagaattttccatgcaattctctttcctttggtatagttcttaaatataaagtagatatgaagtttgtcattaaaataaaggtttctttcaaaatagatgcagattgattttgtttttacaatttcccttttggaaaattaatatattttaaaatcctttcatcatataacattgtaccaaaattttaaaaaaatacataaaatattttcattatgtaacattaattcttaattataaaatagcatatggttattaaaataaaaccaattgagttctgtattaaaatgtgggcatatttatgtcttacataagtattctttttcttttcaatttaaaattgtaagcattttcacaagtcattaaatgtttaggaaaagaaattaataagctgtttccaccatgaatatagtcagcaaattaagaggattctagttagaaaaaagagaaaaaagaattatagcctggcattgtggcattggcaacattcccttcagtcaattcatgagatctcagtgtttatgtatctctttttctttttatcccctatagtcccataaagaaatgggattatcagcaaagtttctagtgcttggagcaagacctattattatcagtatcataatcatttgccattgtgtaagatcatagtgctcagactttgacatcctttcttcatgtttgagctataaaaggaaacagtaaattggattcataagagtttttctagttgagttaggattttaattggcctttgagatgactgtttatcagttaaatgactactgaatacaaaaccacttcgcttgccattgtagtttctttctctgcagtctagggtcatcatattaaagatgttaatgttagtaactcagtaaaatttttagtttcacttggtataaacccaaccaaggaaccaactcacacagtacttccaagcctgatctagttaaggaggaagaaataaagctcaacactcttcttttacacatgagggttttcttttaacatatgatatcccacttttctccattcccacacaatgccatccagttagtgctctgaacttcccagacataaaccccttattgtaaaactctttccatactctgcattctgtattgtgttcccatcttttcatgctcctagaggtgtgcaaatacctttcaatgagcgttactactgttctttattgcaaaatcagataacatcttccccagtcctctgaccagacattgtctgcctttatgtagcacatttactataggatgagaattcacttttgaaccagtgccaatcagagcccgacaatggtgatacttgttattgatttattgagtttacagcaatttcaggtaaagacaaacacctcagagtacattttaaacagtctagctatatcccagaaatccttcccagtggttctaatatacatatgcatattaataccaatgtacctgtaatccattcagtagcttaatttaattatcagtattttttttcttgtgctgatagataataccacatatttccttgataatataaatgtattacacaaatcaataataatcatattgatagactatatcatttgggtttctatagggatattactgttttagaagtttaaaccctggacaccaaccgctatctccatttcctttcacctcaaaaatcattaagcactgtcaattttactgtatcaatatttttcttaactacattcatcttttcaacccagaactttatcttagttatgatcgttccctggctttcctaataatcccctcactgaagtcctactcctaacatctctctcctacattcaccttctttctagtatgatttttttcagaactttgctcatggctcctcatcatttactaggtgtaacttgagctcatttgccaagcctaaaaagccttctatggtctggctctttccaatttgtccagcctcatatttgcttgctccctgttccaccaagccaccctctcatctcacctttgatgtgttgtcactcatcatgtatcacctattccagcataggatacttcattatttaaaccacttacctttttttgaatgtttggcatattcctactcatactctaattttcaggttttctgttaccttttagattgaatgtgctgagtcctccagatattttatatgtgtggtcctttatttatgcactttatgtataactccatgttgaaagttaactctagtgctttagtttctttttacatcactttttcaatagactgttagctcttttgaagcaagaagtagatattgtaatctttgaagtccctatacctagtttaatgcctggtgtaaaacaggagctcataatgagagagtgactgcctgattgaataaatgcatttgttaatttattttaatcatattacatctgtgttctaatcattagttcctctaatttccccaaatatatgttggagagcattttatttgccctcttgtactttattatcaatatatctaatcatttagaagatgtaattaggctagtctcaatgacagaagcttagaaatacttttttttcttttttttttttttgagacagagtctcgctctgccacccaggctggagtgcaatgacagtctctgctcactgcaacctctgcctccccagattgcagagattcttgcgcctcagcctccgagtagctgggattacaggcgcacaccaccacgcctggctaatttttgtatttttgctaaagatgggttttcaccatgttggccaggctggtctccaactcctgacctcaagtgatccacccaccttggcctcccaaagtgctgggattatttataggtatgagccactgcgctcggccattagaaatacttttgattaaatagtgaaagtatagtaagttagaagagtagttcccattctttttacaaaggaagagataatgtttatgagaggtgagtctttatgtgttttaattctaaagccctaacagttatttctttataataacagaccacagaccccagactttataatttccttttttatttgagtatcttaaaataaaaatgagcatcttgtatatacatcttacagcaggaatttagctcatccactaaggtgacacaagtaatcatttgttactgtataaagatttacttgtatagctgggtgtggtggggcaggcctgtagtcagctatgtgggaggctgaggtgggaggatcacttgagcctgggaagttgaggctgcagtgaacagtgttcacccagctaaactccaacgtaacaccccgtctcaaaaaaaaaaaaaaaaaaagcaatggaaatagaaccatagagaaataaagtatgaacagaacagacaggctttttcatttactgctagaacaactgcaagcccacctttgctgctatttgcttgtcttaattaattttagctgtttttctttaattcatttgaaatgaatataaatataaggttttggcaagtaatggatcaaaccaactcaacattttttaaattggtgaagcattttgaaaaagttggcttcatcttatattgcactaaatcaccaaaataaaagaataaagagtagcaacataatgaattgatgaattaactttttaaaaatcaattttaatactgtgtattgtatgcagcacacaggatttgataccaggcactcaggatttggtaatcaagacaatacctctatttcatcaaataactaagggaattgataaaatcagaagatagtaactgtttttctgatcacttcacaatctttgttgatataacaattatgttcaaaatgtgatgttgattgcttcttaattttgtatttttggatcttctttcctgtcttcctgaaaattcttgttaaaatttcctgttttccgtaatcatttatgatagcaagagacacacatatatttaccaagaatttaacataacttcttagtattttgtcgaaaaatgtgtaacatttcacaaaatttattaacataaatgttataactactagccttattcttgttgttaccacagaaaaaacattttggggtccataatataataaaatatggcagaaatacttgtatatttcagagtatgtaatgaagtcataagtacaacatttgttacatttatatatgcttgatttaatgaatggtaaaaggacatggagcatggaatgtgaataacagaatggcactatatttctttattttatgtacatattaatcttctaagatgcactaagctacaagttaaatctaaatacaaataattgagatgacctaaaaacctccattgttttattaacatagaacatttcgtctaattgccttttctcatccacagattaaataagcagcatttaagcatctaaaattgatggatatggaatttctattttaagtaattgttttttacatgaaaaatggcagttgcagtgaagcattatctttatggtcatattatttttataggtcaattttcaaacttttcacttgggaaaagtaagggtaaatcaagagagattttttccccttcaccctgaagagcaaaatttatcttcaaagcattgatataatattatgtgacaccaacttataaaggataaatacatttctgcacacaattttcttcagtctcttattttatatttaaaaatgtaggggagaaaaaaaaaaaactttacctgtcttaggtttgttcattgtctgggacctctgacagaagacagactaacatgaaaaaataactgaagttcattgttgtatgcagcacctactcacactgaagaactcagatgggaatagctcaaggggtggttagaacgtggacttattagcctcttaacaaagaaagatatctttttagaaaagtgccaatacaaaggaaaagtgatttaggcttttaggggtggcaaattgtgagcagatagatatatacatataacattatataaaaataaaaaattatatatatctaatatggcacttgtaggatcatatgcatatatatgtgactatatcatatatatgtatatgatcatgtacagatatcatgtgatatgattatatcatatgtatatgtatatgatccaacaagtggcatattttggggtggcatatcctgaactccttcaacagctatatggttttacgtggatatgacgaatcaccaatgatatgaggaagtctagctagacagaaatttgtgacgttcaggaaggagggcccctcaaggacagtcaatgtcaaggacacccagaagaggtgatgcccaatgccctgacaagagcatgaagtccaactttgcagagtctgagaactgacaacattctgagatttaagactccacatctgcatctggactgtggcatcaaggtagaattaataaaagcaatgaatgtgaccttgaaaaacaaaaatgccaagctggttattgaggtaacaaggcattgaacttgagaaagcaagtacagggcacaaagtaaaggaaatacaacatggtcaagaaaatagagaatggattatttcactggggtcggcactcagattctaacctgagaatgaagttaacagcaagtttgacataatgttcaatgctgtaagttaaaggagtggattgggaaacagtgggatataaatctgggataatgttttttcacgctaattaattaaaagataattataaatattctacatttaacatagaaaatcaaaataattaaaaagcatcaaatactggttgaaattattaaagaagagagagtaagagatggaattgaggcctacaaataagaaatcttattattcaaatattcataatatcctacagcaaagttctggctaaggaagtttattactgtaactatagtgcactctcatcatagaaggaagagtggatctatttttaaaatgtatagaatatgttttctggctactagtttgcattcagggtaaaaatacaccaaactaaactatatgttgtatttgggatgaactaagatggagtagactggtggtaattatcaaagctataggttttcccatattatttcagttttatgaataatctttggaatttgtttttggctcctccccccaaaaatttaaaaccaatgccatataaaaaaataccttggcctcatcccagtctttaaaatttgcatttagttgaatacttacatttatatatgattttatataaatataaataatataaaataagagggaaatatataaaaatatataattcttatttatatctaaattcatattatcatattatcttaggtaatatcttaatacgtttgtgctgctctgacagaatacctaagactagataattaataaaaaacagaaatttatctcacaattctggtggccaaaaagcccagatcaaggtattggcaggattggtgtctggtgaaagcaactgtctgcttccaagacggcaccctcttatattctccagaggggaggaacactgtgtcctcacatggtgggagaaaccaaagggcaagagagtggtcctttcagcctggagctcttttataatgttgctaatctctttcatgagtgcttaatgcagtgatgatgacttaatcatctctcaaaagccacaccttttaattctgttttattggggattaagtttcaacatgaattttggaagggggcacagtcaaaccatagcacgcacttttgtgaatagtaagcaatattcatatttatctatttaatcatattcatacctatatttatctatgtactaaactatactatttatacatatctatatctatttactagaaagacagtgtcactggtcacagtattaataggataagcatttataatacatggacttggtacactcagtatatgcaaatgctctttgacttatgacaggattgcatgtttataaacccatcataagttgaaaatatcataagtcagaaatgcacttaatacacctaacctacctaacatgatagcttagcctcacctaccttaaacatgttcagaatacttacattaagtaagtattacttacctacatttggacaaaatcatttaacacaaagcctattttaaaacaaattgttgaatctctaatggaatttattgaatgctgtactgaaagtgaaacacagaattgttgtatgggtacttgaagtacaatttctactttttgcatatggcttttgcaacatcataaaataaaaaaaatcacaagctgcaccatcgttaagtaggggatcaattgtgtgtatcagattttggtatatttttgttattaaatattagctataaactattaaaatattaaaaaacaaatgacacacgtaactgtagattgcatcaattttagaatcaatatgtctgtaagaaatttaacaattttccctgctgtgatttataatgaacacattgcagctttttttagtcatgttcaattttagaggaattttatttaaaaatagagattctaaaaactatcataaatatagaacttggcatataataaaatttatattatatataatgcacaataatcctacctctgatgttttaatataaatatatacctcagtagatatttccatttcttttgttttaaattacctacctctggatcccaccagtgtagaatttctcctgcctaattgatccaaaaaagtactcaactctgttattagaaataagagtatatgcatatataaagaatatgaattttaaggatgttaggatgtatacagtggccctaggaatagtgacccaaacaatgactttatacaaattctgagtctagctaccagcgaatgttactatttgtatttgacatctaatataaataacctaaattgtgaattgtatttaatgcttactgcattttactgctgtttctgccttattaactcaagacatcatggggcagttatcatcttcattttatagattcagaaacatagaataggcaggttatatatagaaagaaagatccctaaactattgtcagaagcaaatataaaagaatccttaagcatctaaaggaaaaagttgagcatgatgaattagaaaccaggaaaaaaaaattactttagatgtgcagccagattttttgcttcatttttaaccttatagaatttcacaccagttttgggtaaggtggtagctagttggtctactaaaccctgttatttctttccttacagactaaactcatacatagaggtcacaagccatatctgaatctcattcccaaacctctctaatgctattactttaggcaagttacctaatctctttgagcctcactcgtcaaatagaaataataaattttagtgggttgtcataaggatcaaaagggataatgaattcacatataagatgatgaaaacctacctggctttttataattatgagttatattattgtctcctcttaaaggccctgtgacttataacatagaatttgacagagtgcttgtggtttaattaactgattcattatttcagcattaattatcatctgttgtatgcaaaatcactgtagtagatacttagggtgtacgtgtgtgtgtgtgtgtgtgtgtgtgtgtgttggatacaatcataagaagctttcatacagaatctgcttaaaacttgaatccagtagtcttctttttaaaatgagcccaattacaatgatttaaaatgtgctattacaatacatatccctatttaacagatatttaagtctaggtagaagtttatgaaaatgatatgtgtcattttttctcaatgtcagatcatttcgtttttaagttaaaaagatggcttgttggacacagaattaaaggatggatttttggttaggtttttcatgcctgtagtagaagactattaaatatattctatttccatctgagagcaagagttttgtaatctaaatcacctaactcttgaaaacagtctgcttattccttcctttgtaaactcctgctaacagtataatatttctgagcctcagttgccttagctattcgatgaaaccagcctacatcacagtgtcactctaaagattgaatacataactctggcaccacttgaagacagtgtctggccagtagttgatcctccataagtgatatccatttgtttcaagataaatgccctttcttcactttagtgcagatgctactatgttctgagtacagttcatcattctcaaaggatcttttgatccctgtctatacaaaagcgacaactgaataagaatgcaactgtgtaaatatttacttactttcaaatttaagagtaggtagttgcttattttaatgctctgggtgagattaactaaatgaatgaacatgacatagctagtttaatatcaaattgttgatgctttttttcgtgacactatctgagtaattatatttacattagaaaggcaaattttaaaaaatgtagcctatgcagttttgtgatataaaggcctaagaaatggtcaagaatctactctgatgcactaatttccaagatatgcttggccaatactttttaaatccacattaataaatcagaagaatgtttcagacaaaaatgaaatgaagagttttagggtgaattttcctaacggatattaggaattctcctgctttattatgcagaggaaatattatgttgatctttcatttgcctttctaaaagaactcatacatattttattcattaatcttcagaatgccctgtgaccaaattgaaccagaaggggaaagtgaagttagtaaacagacacagatgttgaaatggtaccaaatcgatccttcataaaaaacctcctatgtattgctattcattcattcattctccaaatatttactgaacatctactctatgcaatgtatggtattatatcatgtgaaggataagaaaaatataaataaatagatagattacatgatgtttgcacttgaagaattatcagtttaataagacaagtgaaacgtagccttaaatcattggaaaaaatatgctggcatgcagtgagaaatgtatatagaaaacagtgcatttagatgagcatttatctactttttgtttaggatataactataactttacataaagacacaacttgagaatgttatgtgcccaattaacatgaagaatggttcactccctttgtagttacctcactggacttggataaaattctacattcctgtgataagtcaaagaaactcagaaacttgatcaggttgagcagactggttgatggaaccacaggtttcattgtaagatgctcagcacatatgtactctattcaagctagagaatttcatagctgctgccaggtttgaagtactccagaaagtgctaccacagtgctagagttactgccagacctggggtcctggtatttctgctgaaaatatggcagtcaaatggttatctctgtttatcctttcttccattgccttgagtgttgaaggccatttttgccaattgtctcctcacatcctgtctggtcactcatcactagtactagagctcaaatttactctcaaattgacctggactcccactattccagctgtttagttatctggttctttatgcaacaaaaggcacctctgagtctgcccatagtggctgagttaggacccccatatcagtcaaaagctatttccagatccagctcttctctgagactatcaggccttgtctacactgtacttactttcagctgagaatgtgttctctcacctaactccacttgagcatcctcagtccctcaaaggtaccctggattgtggtcttgattgtttttctcctaggagtttctttgattctttgtaaatttttccactttctttctagcaactttcaagccctgggtactactaaggagtgaaggacagagcagtgtctataaatccatgtatatagttgcaatgtaagaaacagaggagagagtagtctcagtaaagccaaatatacatggctaccagagagaaggtgcaaagttgactttaatctatttaaaagaaaaaagtcactaaatgaatccattcacaatatgaaaacctacaccaaagccgggcttggtggctcctgcctgtaatcccagcactttgggaggccaaggtgagaggactgcttgatctcaggagttcacgaccagcatagacaacatactgagactccgtttctacaaacaaaatggaaaaaattagcctggcatagtttcacacgcatgtagtcccagctctttggcagtctgaggtgggaagatcacttgatcctgagaggtcgaagctgcagtgagccgtgatcatgcaactgcactccagcctcagtgacagagagagactctgtctcacaaaacaaacaaacaaacaaaaatccctatacaaagagaatttgatatttctatcttttcacatagaactaaattaataataataataataattgttattgttattattttagcatcactaagtacaggacacccctgctataaacgttataaaaatttgacagtttgatgttattggaaaaggaatttgggggaagatagggctcaaactgaatctcaagtataaatataaacataaaatagcattttgataaaaatagatgagagtaggaaggccatttaggaagaagataatggaaagccattaaagatgttagaacaggagagtgcaataaaagtaatatcatttaccatgccttgctaaatatcatgcaatttgtggtgattatataaagatatgtttgccttacactaactctaagtctcacaaaaatgctgtaggatgagcattatttctcacttacagatgatgggactgaggtgccaatatatttagcatgttgctcaaggacatttgattagtaaggttaaggctgagcgtttaagatcagtcccttctaacttgataacttgtgcttttcctgccctatcctgcttccaggaaggcatatctggtggctctgtgtgaatgcataagacacactccagcaggtagcaggcttcctgcaattcaagcctgagttaataaggactggtatagagcccagggggctcaaaggaatgattgaatgggaagatctttttgagatagggaaggatagtacggagacaaaagaggccttagagctttgcagcttaggtgactaggaagactctagtgcttttcaccgaagtggggctattgcaaaagcagggagcttgaaaaggagatggtattgattgcaaacaggaaaatttgagatgatggtaataccttaaaggaagagaggtccaacaaaaagctggaagctgaaaaattgtttctcatttctataatgactcagttttctgtttgtttcagaaatggagaaaaaaatttcagacttttgggagcatatgtttacaatccttcagagaaaaagacttagtcaacctatttggccacctagactaagtgactccagaagctgagagaatttaagtagtgttgaatgtcaaagaattactgcatactttagtgcccttgtttctcagtagtcatgccggaacagcctgtgccttcgtagtacctgtgtcaggggtcttacgaataatgccttgggagaagagatgttaatttgaattctggttccggctttcaagcaaaatattactcttgctaatgttgtctatcaaataaacttctcagatttcattcgcagccttcaaatatttattcctatttccaatttttttactaaatcaaaaggaaaagggaagtgaataagtgataaattaaagactgtgagatgtctttaaaatatgaacttctctagcccctaaggcaggtgcacatgaatttaactgacaaaaattatgcacagttttcttgatttgaaagtctcacttaagtgttattttaactaaaatttgaaacaatcaaaatctcaaggtaaatatagatattactcacttttaaaacatcataatttgaacatttactattacatagatattatgtactgtagcaaatttgtaagctataaaaatatgtggaagacaattacaattttccatttattaacataccaagcaaagaaaatgacaattatcattttaaggaccagtagaagttctcttaacccaccttcccctaaccgatttgtaagagtaaccaaagctctgtatccactggttaaaatatactgattgacatccacagaagtgagaaaactcaccatcaggaggctactatcatgtttctgtattttgactccgtggtttggtattcttagaaaaggtcagtagtattttttctataaccagtttatgcttgttgtacctactaattcataattcaattaaacattacataaaatagttaaataaaagtgcaagcataacattgtttctatgaaaactcaaatgactgcatgaaaaaaattgataaaggtactttgcaagtatctctttattcttgtttcacttaaaagaaacaagttgaaaatcatggataatccattatgtttggagcttatgcaaaacagaagaggaaattcaatcagcagacccatgaaaaaggtcttggctctacattaatacatttaggaatacatttacagttagatgttgtacattaacatagaaattttgaagtatatatgccttaactgtttaactggccaaatgttagctttgattactttggaaaattatttataataaattttctgtgcccttgtacatatttcattaaaagtaggatcttatggtatacacagcttgcttaatgttttcttaagttaatttaacatttatttaaaatttgctatgtctcaagcactgtttttggaatagagctatagtggtgacttagatggagttcaccttctatgtggtacatagaaaatataaacaatgaaagaaaacaaattaggataagaagatggagagtgatttaggtgtggggaaggccctttagctagggttatgggagaaaaatatatgtggagtaagtcctaaaggataagaaataggtagccatacaaatattgatcagaaaagcatcctaggcagaaggaacaattgcaaacttcttgagatggaaacaagcaaggtgcatctgagggaaagaaaaggtaacccagcacactgataggttgcctttctttcataatttgtgatgagaaaaatcaagggtatccttttgatgcattatatttgaattgcctattagatatccaagcaggaatatgcagttttgtttactagtgtattatttgagcctctaacagtatttggcacattaataggcattcaatcaatatttgttgagtgaaggaaggaattattttgggaaggaataattttgagatgggtaatgttttacgagtttgaaactcaggtgaaaggattgtagaataaatttgtgagtcattagcacatagataatatttacagctaagaaactggttaagattatccaagggtatagtgtgaatagaggagtgccaaagagtgatcttagaagtcaagaagagaaagagaagcaaaggtgattgaagatgtgcagtaaggtagaagaaaaacaaaaagagtctaatttcaggaagactagagaagaaagtgttttgagaaggacatggtcaattgtgtcaaatcaagctatgagaattgcttaattatggtaagcttgaagaactaatcattttgatttgacacgaaagcattgttagcgacctcaatactattgtctgcttggaatgttggggacaaaagctaagctggactgtattgagggaatgtgaggtgagagagaagaggtatcaagtctaactagttatttcaatggggtttcaatttaggataccatagaaatgaacctgaagagatacataaagtcacataaattttttttaaacattgaattaaggcatgtttatataggtataaatattccagtagagaaggaaaaaataatgttgcaggaaagagtgaagatacttgcaaagctgaaatctaaggaagggacacttagagggagttagtcttagatagaagcagggattgtttattgcattataaaaaaaaaaagaagacagagtgtggaaattcagatgcaggtgggtggatgaatttgggcaggacagcagagtagttcttgactcattttctccattttattagtgaaaaatgaagtgagtataccagcagaaatggaattgaattggaagagaaatttagaaggtttaagaaggggcaataggagcaaaattatctttttggaaagtgggaaagtgaatattctggggaaatatggaacattttctgggtttatggcccacttgagattaggggccataaatgttaagtgatttcagttaactgcatcctactaaacccagaaggacagttaagtcagcaaatagttaaatttaatgagtttaatttctctaagagaccatgatggagaataagacctaaaagagttgccagtatttataaacaaataattataataccaaatcatagaagttagaatggaagtaagggaatgtgtgaggtgctggacagtgaaaatgtggattgaagttctccaagggggtgaaaattaggtggaatagggtcatttgagtcactgggctgggaggataggggatttgttaaaattaaaagatgcatgcaaaaattaaaagatacaattaaattttattaagcaattctaaattgtcttctaaaattgctgaactaatttatacactctccaatgtgtaccatactattattcattatgtttttaaatcaataataattcttagaaagttatttagacttatttgtttaacaatttaaatagaattgaatctcgccattattttgtgggctagtcttttttcagaatatgtagcctcctcccttctccccaccccccgaaaaaaacccatgtaacagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttcttcttcttttttttaactgtagcctatttggtagttcctttttcctgtgaaacatgtataaagttctacaaaaataccaaaagtttaccatatttattgctaagatgcaggtatactacattacttatcctcacatcattagacgaaatgcatatgaactctccttacaactgggtattgaacttcactggtcattggttattagaacattttcttttaatgactgtatctttttgtaagatacaagtgttactttggagagaggtaggaatagctctatggaaaatgtacatgtacatgtggtggaatttttcctgaaattaaaggaaacatgcagtttggtcaaatgcatcaaataaattaaaatagtgacggttactgcaaccgaatctgctgtcttaatatgctatcaatgtaaaacagcaatcatttataattgtcatcaaatgacaaagttaagtgtgataagaatattttgcacaccaattaatttttctatcagttttgatactttaaaatgttgaacatacagttctttaaactgcattgtttcttttttagctgtttaaaataaattctttaagaagtgcaacaataaaaaaacaaatcagcaatgttaaaaaatatgtaaggagacatgcagattttaatcttcttgttgctactgtattaaatattttgtccttatcaaaatgtatgcacaaaaactggacagaatatgcttctgtgatctttagcagctctgtattgccccataaatgactcagctacaaatcagtgaatgtgcttcaggctttgatttttgttattagttcaaagatgaacatcatgaggacatcactcagagacagatttatcatgttttgtttcagatctcatagtgaaagctgaattttcttgtctttgttctaccaaatacattgctatatacatgatagtttaaaaaaattaaacctttttgaatatgctagagaatattaaccaatgcataataaaattaaatcaagtaggtgccatcacagtctaaaaatataacacccgatatatgtctgttgacatatttgttattcaaattcaaattttctttctcatattgttgtatatttacaaatgtgtatctatactatgcaaacattgatggctttttaaaatttattttatattatgagtatataataggtgtatatatcatcaaatattgtatctgtttttctccttcatgaaacaaatgacaagatgagattagatgcacaacagatttattggcagatatgcctgtgaaagataaacaggcaggaggttagaatagacagttttcagaccgtgctataggtctgaaacctgtaaaaggagagagggaagacaggattggatagaaaaagtctcagacaactatgccaaaattcttagccaggccaatggggattcctagagccacagcttttcattagaggaattttgtacaggaatggtcttgttctagcaaggctgccaagctcaatcactggctggaagcagcctatctgaagagcagcctgctgaacacagtggtgtatgcaaaggtgcagatgctagaggctgtccttcagttatgttcctagtagcagtttcagcagagcttcttcatagtcatcaaatatatgtattttgggcctttcagtgaagttgttgctaagaagatatggattttctttcttaattttcttagttaatatgttcaccctaataggccatgtcctataagtgtataagtgttattaggtaagagaatgaagatggattctgtggctgcatcataggctctgaatttaaaaagcaacaacaaaaaccttactaaatcaaatctcaaaacatatatcctgattgtggggcagtgtgggcttatagatgtttgcaaatgaataagcacatattctaatttgactcataatgctgttaagaaacaaattcataaatgtaagatagttattgcatttcaatgaggcatgccagcaatgttcaacaaaataggggaagaaacttataagcaagtatggaaaataatacagtcagtcagcaaggtacataggtttaataactgagttaagaatatccatatgacttatgtgtgcagtatacatatataaatatattcttttatatacattatcacaattcttttatatatattatatataatatataaatatatatataaattcttttatatatgtaatagaattgtgaaaatatatatgtgtgtatatatgtatatatgtgtatatatatgtatatatgtgtatgtgtgtgtgtgtgtgtgtatatatgtgtgtatatatatatatatatatatgaattgtgataatagtcccccagaaagtaaaattctgcaagcgggaaaagagtgacaaggcactcatactcagtgagctctggaaaggtgctcaacttactttacctgaattaatagatcataatttagcatttgatgtatagtctttgattctcaccaaaaaaatcagaaagattgcaagatctctcagtagttctagatgagaattcattgttatttttcgttatcattgatcagtaatatagatgaaagctcaataacgggttacagtgaatgttcattgaatgccaagcactgtgtttggtactgctgatacaaaggcaagtaaatcaagtgttacctcttcccttgttaattagttaaaattgcattcattcactccttaagcaaaaataatatatggttcccaattgcttttctgggcattggggatacaacagtaaataaatgttacagacaaaataaatgaatgaaaaaataaacaagtcccaaaatacaactggatagcagctgtggaatttttcttagtagatggaatcttttattccgtatttaacactattaaattccttaatagactacaccataaactctacaatatagagctcaacttgagatacagaatgtttaaaagagaataaaaacttctctgaagaattccattgtttaaagaaatggaaatcagcattattcaacatttcttactttatatatttaaaattatcttagttgctttttgtgatactacattattattttaataaaatatataaagttggatgatgataatataactcttcaaagatacttctgttagtggtttgatatatattttttcataatttttagtgagtaaatccatctacacatacatttttacataaatttaatttcatgcccattgtcactctttaaaatttaccttcttttaaaattactacaatatatgggcatatgctaatttactgataaatatgttgattgtcttccgttacttaataaacaattttaagaagaatctgtttttatatatatgaatctccataagagtatttatattttcttaggatagattcttagcaagggtacacttgatcaaaatttctacatattttaatttttgacatatattttcaaatggctattcaaaccttgtctaacagttttccagtttttcctctgctataggttgaattatgtcaccaacaaagatatgttgaaatccttacccccaggtacctatgaatgtgatttcaattggaaatagggtctttgaagatgtaatcatgtcaagatcagctcattagggtcggccctaatccaatataattgatttccttgtatatattattacattactttgtaccccataaatatattgaccaccatagttagtcaatttaaaatttaaaaataaatattaacgataatttaaaaataatttttaaaacagaagagggaaattggaacacaggcacacacacaaggagagcaccctgtgaagaacagacaaacagggagaacacaaggtaaaatggaggcagagattccattttcactgcaagccaatgagtagtagctggcaaaacaccagaaactatgagaaagatataaaacagatagaccgtggccctgcaggaaccttagtttggacttcttgcctccagacctgagaaaataaatgtctgtgttttaagccatcctagtttgtagtaatttgttaaggcagtccaggaaaactaaaacccacctctaacattttagagtgcttctttaccctcatagtcaccaaattgagcattctcactactttattactctgtctattagaaaagtaaaattacaaagatacctaatacatttaaaactaaatgaatctcattagataaaaggcagagaagtttcacatttgtcatatatatgcatgtttgtctatttaccaacatacttacctgttatcctttactttgttttataaaaggatttaagcagctattctctagttaatatagaaaaaaaatgctttaaaatggaaggaaaagaatcttccattaaagaaatagataggtgtcatcctcccagccaaataactgggctttgcgcggggtaggtatttaagtttatggctatagcagtatctggattgcagggttcaaatcatatgtttctattttctggctaacctcttatctctcagcttcagggtttggcatagacctaggatggcacagaatcatctaccatttctatgagatagaagcctgagaattcttgccattaacgttcagcctttctctcataggggtttgccgtgctgctgaaatacgcagttggtctagatggaaaatagctttctgacagtgtcaattcaaggatgttctgagtttattattaactctgggaattatatcataagaggcaaatactcctacaaaacattgatcaatgccactgttagagatacttggtcttaggttgatttgatcagaattacatttactatgttttaagtacaagaagagccctctgatgttcctcattgtggagttcttttcaaatagaatgcattgtaaatgtcatctcctgtgatgacaaggcagttgtagagtgtaaggcagtaaaggtgagatggaagaacaggggattggcagtcagaagcctgcattctagttgtggctttgctgcttactggctgtgggcctttggaatggtgagttgaacttctgtgttctcatcagtcaaatgggctttgaagtatacctcaaaaggtgattgtgaagatcaaatgtgaccatgtttatgcaagtattttggaaacatctagcgttaaatatatgtaaaatgttttcagttgcagaaattttagtttgaatcaagagtggtgggactttgaaacctctattctctcttttgtaaatatttttgtcatatttaatctaaagataaaaacaaaacactttataataactaaaggtttgtttatttggggctggctgtaagcaagagagtattatcactgagggttgttcatagccactcctgtagctcatccactgtttcaatcctacagtttccttcctttccgcgtaggctgtcttcacctggggtcacaagacgtcctcatgctcagcaccatgctttgttgaagcaccagggtggaaatattattatattttctgtggaaaaagtgagggaaattgagataaaaaggggaaaagttatttaaataagtatgttcatatctggtttataagccttaagataatttttatgaagagctatcttgttttactcagattatttttattttggttgactttggcacctatctgcagtattagtagcattgaagttgttattcagtggatgaaaccttgctgaagtggctgtgtggataccctaaaatagccacttctcccttgatgagtgtcgcattaagattccatggaagttcacaagggaaaaacaccttttctgtgttggcttttgttattgcacccctctatcccaattaacatttactgttttttacattggtaacttaattggctgctaaattttagaagataaactctgaatgtttatgactaaaattagaaatacttaaaaacattatttaaaacaaatgcaatgtaatgatgaaattcactgactgtatagtaaatatgttgccaaatatatagaaatgcccacaaaataatattttaaaaatattctaagtttactcttcatctgtattctaaatttgattccataatttgagatacaaaaattcatgattttaatataaaatctgaagagtaatattcatgaccatatacttacatatgatctctctaaatatatagtagtaatattaactattaataaactctataatgcaatacttcgtattaaagaggatgattgagtttaaatagctttgttcttacttatactttacttccttgggaaacaagtgaccttatatccaaaccctctgaagcaaagcattgaaataaaatgtttttaatgctgtgatgagaatttaaatgtcacagagtgctattgacatacatgtaagatcaaaagaggaagtgtgttatgacagataaatcaagatagtagaaaattctgttaaggtctaaactgaaagtatcataactaaaaacatgtagtggcattttcatgtattctgggcacacaaatcagctacaattggccaaaatgttacataatgaaagccagtaaataacatttttttcctcaaaaatagtagactgtggcattatacgtgacatttagaaaaggttcttattgtagctgtttctatcaatattcctataacaattgatttaaagattgtatttattttgtacttcaaacttccttcaactggtaaaatagaaactataaaagatcccctacctatgggtcaaattacttaccccaaatgattgagtaaatttgcaaccaagctgaaattagaacttttaattataatttaaaagatatttgaaattgaatggaaccaatcatagaaaattttatatttagctcctcaacacactaaagttccctttttgggccataggatcatagctgactgctatcttttagaaccttgctaccctgtgtgtggtccactgagcagcagcatcaacatccatgcagaaatacagaatctcaggctctagcccatacttactgaatcagtttgccttctaacaagatcctcagtgatttatatgcccattggaattggagaagcacgatttcaaacatcattatatatttcctcagttttttttcttacaggcaataggtgtgaactacttactaaggtggactgcaataaaaaatattaactttgtcataaaatgtcgaatattcattagtgtatttatacatgtatgagtctgagaaagccagactccaaagagtgaactatgcaatacgtattttatttttttctaataaggtattgatttttgttacagataaagatttaaaactatccaaatactgcattaaagtggcaaagtgcttatgagaaataagatatcagagctgaatttctacttttatcaccattgagggatacagcattctcaaatgcatccagtatcattatctgactagaaaattcttgctcaaatcattgttcaacagaatactgtttagatcttatttacagtttccaattggactttaggcaagaagctcttgtaggctttaaattccacacaaaggcacaatcacataatcatgactcttcttcctcaaatattttacatgcttcctcataaaaagtagagctcttcaaaaggttaggcctatctccctaccagtattggattgagtgtacagacaaaaacatacctcaaatatgtttggtaaagatcagaaaaaaactctaatttttcattttacaatgtagacttgtcacaaagaataaagaataagagaatagctggaagcagtacctctttcaaagcgtaggagggcaggctgtcagcaaaccaatgggactatgacgaaaggccagcatccactgtcttttagtttgtggaaaccatttattattttaaaaaattataccattaataaacttagaggcatggtatctgtcatcattactgatttgtatgcatgaaaaaacctcctgaccttttcttttttaaattttataactcatgtgaattcggtttccttaaggacttgttaaacagtactatggctttcttggtcatcctgaatgctaattttcttcaggtaattcggttcgtgaagactgaaagtcattatttgtttatgacctaatgtcattcattagttctgtttcattaaaaaaatggatattactgaagaaatatgtttatcaaagaaaagattcaaggtgggctttattatcttcaagcatgtggtctattaagcaaaataagatattcagcaaaagactatgataaatcagtttctctttattgaagaagctactttgacatttccattccagctcagtctaagtctgcatgacaaacaactgtttcttgctagcttctgtattaatgtttaaactctctttggtaatcaggacttttaaacattttttataatgatttggatagaaatagtcaaatttataattacatttgtgacagaaaggtgaaccttctaacagtagtatttttaaacatatctctatactgaagcaaaaagaacaacctagcatcctttgccttatcatcttctattctataaaatatgaaaatgggataaaagtgaagtatacactgtgttttcaccctacgcttgaattaagaattgctttctttccttcatattagagtaagttaaaattagaacactttttatttaaattgtcaggtaaaatgtgttgctttcaaaatatgctttctttttagtaaaataaagatccacctttctttcttatattaaaatgcaaagaaatgtatattttagagtaacatatgcatttattatttgcaggggtcatacagaatagaggtaggctaccagagtgcttctccagagctgatcaagcacgttagcatttgtaaagttcttttttttgtcaggagaaccaaaaagacatacttccaaaattaaaatgtaaatcatatgttcaaaactaaaatgaattaatgagttaagtcttacaatacctgttggaaacactttccacaagacttttgtgatcttttatttgatgggccatgagcaaccagaaatgagtatgtttttagattcctggactgccatgcttcaaatatattgatgtatcttactttacatctctttctctaagaggattattcagttaccacttttgagcttaaaaaaaatagactttaatgttgtattccagataaattcttttaaaattctggtatcaacttttaaaatattatcttctgaattatccactggatttttctccctggaggctcactttagagatgttcacacacaactgctggtttgctttagataaagcacttgttctcacgttctcatgtaagttttatcacaaacaatgtctaacttcacttttatcatttcgcttcttaattcctttctctttgtcacaagtcctgtgctttgtagctgttttccttatttttgtttttaatgtggcttacctttgcagttaaaattcttagaaattattgttactttgaatttcaaatcagaggaattaatttttttaaagtctataatgcaaacaaattattatgatattgaatacactaaaaatctgaagcatttttccagtttaaatgataattataatataaacaaatacactcttataaaatgtgagtaaaattaatattaagagagaatttgaatagcttcaatattaactctaatattatttcatatacaaacgttttacaatttatttccaggatcagaaaaggaaccatataaaataccacaaaaaaaaatataggctttgcctgaagtgttataagtaaaatttagaaatgttcataaagattataaagtttcttctcaatttgtttaagttcagaaacgtcattaaaatgtttatatttgctcacctttttggtaggcacaggctaattcaagataaaataatgtaatgtttttctgggtgctatgaccccacataaacagtcctgaagacaaataatgtcattcaggatgctaagtgcttacctagatacaggacatgatagggacagatcccccacctgaactgaagcaagtcaaagaggacttgaggctaacctgagacttggaagatgaagagttccctggcagacaggaggaaagaaagacaagactaatggggagtgttgtagggaaagaaactggcttatccaaagtcatggggacacataacagcacagacacataaactgtcagtattttagtttggtctacgtctagggacttaaagatcaaaccaacatctttaactataccaagaatataatatagtccaaacaacggcccataaatgttctaggtatgtgggagtttttatggcagtcttcattaatcccatgttatgaaaaagaattatttctgatgttcctgacaaatcagcagagttgcaagtgaaggaaggaaagtggaagaagtttggaaataaatgaccgtgatttaatatggaagaatcacagcaagagaaccctgatattttggttctaactccagtttagtttataaacctgcttcgtattctaaacaagtcatcactgaccctatattttctaaatacaggataatgtttggcctaaatatgttgtttgtgttttaacaaaactctgttagtcaagagacaaaaacacagtgtcattgttggaaatgctgaaagaaatcttgaaattcaacctccttcatcctatagcttcctccacttccaccttctacctgcttccccttctatcttccttttcctgtttctacattttctaccttcctatgttagctcctgagcgtctatgaataaacctaaagcttcataaaatactgtggaaattagtgtccagataacttcttatgttctttcagaccatatttctccatctctgaatggtgtttaattaataatcaattaatagtcaaagggaaaaggggaaatctgagggcctgtgataataaataataaatatagttaggttaattggtggaatctaatgaagaggaaaggtatactataatgaaagaaggcaataaataaaatctggaactaaaatagtaattgtaaatactatctatgaattccttagtgtcagatattttaaatatttagtcttgtttaaatttccaaccatcctggagtagctatactgtttcctgtttatacagaaaagtacatgagttaaacaggttaaaagaatagtttcttatggactccactgacaacctatggagagacaatgcttttgtactgggcccttataggtgttgagcttaatcttcagagcctcctgtcctggggtggggggaggggggagggatagcattaggtgaaatacctaatgtaaatgaccagttaatgggtgcagcacaccaacatggcacatgtatacatatgtaacaaacctgcatgttgtgcacacgtacccaagaacttaaagaataataataaaacaaagcaaaacaaaacaaataacaaccacaaccacaacaaaaggtttaaagtaagcatattcccattttatagctaaaaacctgagattccaaaaggttaaattaattgctcaacctgaggccatctggctcctcttccagtgcccattcctctacatactttattgcttccttaatctccacaggaatcatttccccttttctatcagccttcaaaagcttgttgattgctctctaattacaaatacttggagaaaagtgtgtaaattgatatgcaaatgatcttttccccttagcaaattagcactttacttccatctaattaagtagctttgtgaaggaaatggatttctgaaagaagaatggaaagtgtttggatttgttctgggggtgtttctggtttagcaagccttgtaaatgaggtatataaaaaggagtcaagagtaggagcaaacaatgaaagcagagaaaaaacgaagggggttggatgaaaaaatttaagtataatgactgacaaaccttcaggagaaagtaaactgcctttcatctttcattctttctccaataataacacttttttttaaagtaaaataaaactttaagaaagttctgatttctctcagacatcggtgttaacgctgacaatatatttatcaaaaatggatatattcaagcctaaactactaatttttgttgtatctagaatttacaggacattctcttaattgggaagaaattaattccttgagtatgttacaagaattttccttaggaaagagtcacttgttgcaataggaattaagatatggctttgccattatatatatttagtggaattaggggcaagacatgtatgtactagcttcttccataataggactgaagcagttgcctgaatgttatctttaattattgccagtgaatagtaattcggtactgaatatgtactgaattgaacatgtaactacctgaagtaaaaggtgtcaatttaaatttttcattgaaaatatggcaactgagattcacaataatatattaaatctttatcctctagcaatctgtttttatgaatttaacaaaatgtctgtatgtaagcagtttagttgtatgtgcttggggaaagcctttagtctttattaaattatactacccaggtccataaatagctagttcctataagttacacaatgccatattaagttatattagccattcttcttaataatgaaaacatatttaataataaaatattatttacccttctacctatgtttctttgccaggtattatactcttgtctataccaccaaattattttttggatttacaatgtttatttttatattttattcattaaaatgtaataaaaaataattgaaaactgatgctaattgaataccttaggaaggatcaactctgctgttggcaatttcacttatcttattctagttgccctttaagaaaaataaagagaaatcatattggctgttttccaggagattataacacattggagaagggagaatctttgtagcaaaaaataactagaaaaccattgggtgccagatacaaattatgatgtaaattataagaaccattttattataaacacttctatggaaaaagtgacaaatatcacatatcagagaaaaggtcagacattcagatcttaatttgtatacaaaaaatctttttactgttactgaatactgatatcccaagagtaattgaagaagtatgcaagtactataaattgcctccaagctacaatattcttttgaaggagaaaagattaaaagattataaattccatattcccaaccaccatcatccctccattatctagactgtgtcccttccagtgtattgtgaaaaatcttcgagagatcatgctgccaatatgtcaaggattctacttttttgtaacaggtgagggcctttgatatcaaacagttcaccacctttattcttacaggaagacactgaggcccagagaggtcacttgggtttgtcctgttgtgttcttagaggtgaagatttgataccaagtctgacatgtgatcctcaaccaagcaagggtttcaaccttgacttggtatcttcatgctctgaatagtcatcactttattgtgcaatttatctaataacacaattgtgtctgtaaagaaaatacaaatggagaaaagtttctgcaattattaagcagaatataaacctaaggatatataaagcatatatttatctcaatatttccatcttctctttctcaaatccaaggttttcttactctactttcaaagaacaatatatatgatgttttaaatttgaatataaagaagccatttaaatgtattttctgaaatgtgcaacaggctgcaagggtttttttttttttttttgatgaatacataattgtcctaggcatttttaatttgttgcatggcagatttcctgaatcaaatagcagctgtttggggaaagtagcaagcacattttctgcaggcccattggttgctgttttgctttcatattctctcaccattaactatacagcaactagagcagaggagttgttaacaaaatatactttcactgctagccaaactatatacatgacttagtggtaatatttgattttatatcatttacttatgtctctgtatgtcttacaccaagggactaacacccaatgggagaaagaaaaaaagggaaaattaactaagtatctgtgaaccatcaaataggctcagataaaataatgagccttcaacaagctggaatataataacattaggactttggagttcagtgggcagttagatgcactaatggcactgctgtgctgggaaaacatatattttatttggaatttttgtgtggaggtgattgcacattatatgaatagctgtgctaaatgcatgaaggttttctgccagcataggaggcgattaaggccccctctgccagataacagctcactggagggaagtaatggtggcaaagtaaaatctgaaaacagatgatttcccatttaatagtccattgactctcctcctacagccactgtggtgatggtgctgctctttattttcatttcacaaagaagcacaaggtattctgagattttttaggtcatacattttctttcaaaaagaaagagagagaaaaaagatgagagagaaagagaaaaggagagaaaaaacaccaagtattgcattaaagaaaaatgcaattgattcactcattcattttaagaaaaaaagatacttatttttgtgtttattgaatgttcattgtagttcaggatgatttcgtttttttttctttctcccctgcaccccctcgtttgtgtcactcatcctctagggagctgtatcaaacttacaaaaaagggtactgcattttgaatgtatatccaacatgattatgagacagacccagcccacactgtcagaaaaaaataaaaaatgtgtttgtccgttcaaactgtgatttggatataaaatagccaatatacttttaccatttaaaacattttcccattaattattttttctcttctttatcttttatgtgttctatattctcataccatatatgttgaatatgcttatctcatttcaccatttgtttaagcatagcagttaatttgtttcttcttaaatattcatcaaacagaattttgattaatttagatttaaattaaaatgtgtaagtgtagtattgtctattaataattcctggtatttctgccataggtcttgaaagtaccttggtccattctggactatttgtctttatttactaacatcattttctgtcataccacatctatttttatgtacttttgaaaataagacaaataatgattcagtcatccaagatttgcttaggtatggaaatatcaattttcaaatagtcttacagtaaaacaaatttaaaaggtcctagaaggaaaaaaaaagttttagttaaactcacttatttgcaaactactaaaaaaataaaataaaatgcaaaactgtacttcacctttattttattgctggatgaaattttttgttttcagaattattttcagacaatactgtaaatttttatggccagaatcttagcatttgcattttttatgccagatatgcattattttgatgtctaggttccttcatcttaaaaatacagttcatgccaagttttgggagattgatcattaagcaagctggcgattaagcatagcaacactgaatgtatggatgtaaccattcagataggtggttctatctaatatgtccatttgttttttagaatgataaatttttaataatttttacaattcctttaatcaggcagcttcttctataggtactcaggacagtttagtttattgattgttgcttcactttttgctgtcagaacttgtggatgtctcttttctattctaaaaggcagtttttacagcaacaaatagcatgcaagtaaactataaaaatgtattcagcaaggtagggtgactcagcctgcaatcccaacattttgggaggccgagatgggcagatcacttgaacccaggagttcgaaaccagactgggcaacatagagagactctgttctctacaaaaataaaaataaaaattagctgggagtggtggtgtgttcctgtagtcccagctacttgggaggctgagatgggaggatcacctgagcccagggaggtagaggctacaatgagccatgattgtacccctgcactccagggatacataataccctgcagtgcactccaagtgcaccctgcagcctgggcaacagagtaagatcttgtctgaaaaatacataaataaataataaatatgtttttatttttactgcatattctcttctttaataagttgttctacatttcatttttctttattacctcttttaaaactataccactttctctggtctttctgttgtttgcatttcatgcctttgacttttcttaaccctatggaattctgacatacttacatggaacacatatattatttaattcactacatgtatatatcatttattttacttgcctttaagaaattacttctcacaaaaaaaagaaattacttcttaatttcaatatgtttcatgcttttcaaggaactcaatattttcacttaggcctttttttccgatttatttttgtaagaaagttaaatctatgtcaactctaaaaatactttaatccatttgtgctttaataacctcattaaagggggaaggagtaatgaagtgatgtttctacttcattaaatatactagtagtgagaactacatatggtggttttataattgttattattcacaactacatcctgaacatttctgaaagatttatagtgattagcaatattcttcttttcaagagagaaaaattatggtatgaagagattagtaattacctaaagattttattggttacttataccaggagtaggctagaactgatatctactaaatctttctattaggtagtccattaaaaacaaacaaacaacaacaaaaaaatttctgtaatttgaccttatagtgctatattgaattgtactaattatgatggctttatcttcctttgactttcagatccaagtaatacctgtgcatttgaatctacatgatctaattgtgtttatacttacgtctttcacaatttttactactattgaggttgtttgtataaatacggtaaatagatctgataacaactcatagctcaggaatttatatatggtgttaatgagcacaagattagtgattcaaactacattttagttccattttataaggcttcaccttcttctcaaccagacagtgtatctggactgtatacaaagagggatggatgccaactgtgaaacccagttttgaaatgtgtttttgttaggcaagatgaggaccaaaggaataaaatattatgagatggtggggaggagataaatgtctaattcctagtctaaggaaatatgtaagatggtggaaccagagtcagaatccaaggaagtctggggccaaagctgacagaagaaacaaataagatgcaaaagcaaaggatttaagatgtgatcagcatggaataatctgggagaggatgctgtcatttttactgccagtccttttaagggtccaatccttcttatcagggatacatctgcccattttaaaaacatcatatttagaaattgcattctgataccagacatcttatagaaagttgtgcttagtcatgcctggagtaggtgagacagaaagaatgagtagttagagtccatgctcacttttagaaaaaagaattcaaagcatatgcactactttgagtgagtcagtattgtcgtcttcaaatgcaaaggataacaagtaatttctccatggccagggttgataaaaagtgactcatgtcaaagatttatcttttttttctccaggcatagtgtttcacaaaaaataaatctatataaactgcaaaagtaaaatgttcatatatggacaactaaaagacagtgtttatccattccattatagacattgtacaactatgagtcatagtggcaaaatgacaagttttccactgtagcatctaagatttaaaaataaaagaaaattagaaatctcaaaaataatagtagattgcaaaataccttgcaacattttttgagtcagccaattactagaaactggaacatatgtttatctgagaaatacctttcagctgccttcctccatggctgtaagatacattttgcactacactgcaatacctataattataggactataattttaggattggaaggaaccttattgatcagttagttaatcccttcttttcacagctgaagaatctaacaactaaactggttaatgaataaatagtaagtgaagtctaataaaacatgtttgaaggctaatagcatctatataataaagactaaatagatacacattcaaaatatgacttcactgttgggcaacataagacagctagtggagaatttagatttctctctttctaactgattgtcatgtcttatggaggaaattctcaaagataatgttaacatatgttgggataaaccctttctgctttacctcttcttgttatctttttcttattttagattgtgtagtgttacagatatatttgtataaccagtggtatattttatgtactctatgaaatttctcttctctcaagaaagttgtagactagccatatttatcttaggttgaagatcatatgttctgttttgccctggacatttctggttgtcatagggtagtagttaataataccctctttcacttttcaaaatacctcagtttgaatgataagttatatgtccacccttgccttaggtatagtctttataaaaaaaaaaatttaacttttattttagattcagggggtacatggacaggtttgttatatgggaatattgtgtgatgctaaggtgtggagtttacgttatcccatcacccagatagtaaacatagtatccaataggtagtttttcagcccttgtgtccctccctctcttccccttctggtagtttcctgtatcgatcgtgcccatttttatgcccacgtgtacccaatgcttaactcccacttataagtgagaacatgtggtactcggttttctgtttttgagtaaatttgcttaggataatgacctctagctgcatcctgttgctccaaaggacatgattttgtcctttttcatggctatctaggattccatggtgtacatgtaacacattttgtttactccatccactattgatagacacctatgtacagtctttattcactatttaaaatagatttatgggattcatcaactgtgcataagagcatttgggtaggtgaggaggcattaatgaaagatggtccagacacaattccaatatttagaaattggtatctggttggggagagaataaatactttaaatgattaagacaacacctaattcagtgacagaataagtgatatgcctgaaaaatctaagagttctgagaaataggaggtttgagggctgaaatgatgagcattttccatcttctctccactctgtttaacatttccttaccccatgggtatctcactgaaggactcctgtgacctgaacctgccttttctgtctctttttcactttattgctctctgtaagttagtgtgtctgctatgttcccattgcctccaacattaaactctcataaaagttttattttcttttactttgtgaattcaataaatctactagttactttgccacagtgatccgggcttatggctttacacgggtaataatcattcatatattaagtggctgcccttatactcagcaaatctgttccttcaaagtgaacttttgcagctattgatttctttccctagttcttgtaccttttaccaaaaagttggatttcccaagagcaacaccattgggaaaacattttagtaattgattgcgatatattttgaaggctatgtgatcttagttctgtgggattccaaaaatgttaattatagagtcctctctattgtaatttctgaagtatcttctctaaactacctccactgaatctgaattcacattgtcttatagtagaagaagatattattcaaatgtttaggaaatttctcaggaaacgataatttaaccatctgtatttgccttgtatatctgtgggacaatagacacattgatttagtatttttcactgttttttgtatagaagacatttttcttttatgttcttgagtaaatcatctcagaaaagatgtaatatttttatgttacaggtagcatcaccataagaatggctcactgattagttttgacttaaatacatgtttaccttagctatgctaagattaagtgtacaattttaatcttcaatatctgtaggcttccaggtttctggacagaattcaagagagtatcattttgtactggtcactgacagtccaaagactgtcgttaactctgatgtttttcaaatgacatattgtgttcacctgaatgtttgacccaacaaggaaaatgaatatttattccatacatccttaaagaagggaatttttcttttgcttttcataatgtaaattacatgatgattgcataaagttttcattgagattagtttataacaatttttttctataaatttaattaataaaaatatctaaatcttaaagtcaaacaattaattttaaatacagccattgacttttcaggacttttaaaacctcataaagattaaaaactgcacttatatatataacagtgctaagataggtcttaggtaattgtaattttctctttataggagatttgaagaataatcttcctatgttggataacgctttatgcaaacagtgtccagagaaaagatataatcctcattaaaagtggttgtgcttgcttagcctctatgtttaatagaaaatcaagacttgctagtgcaaagatagtgtctgttgattcagaagattatagcagtgattttccagaagctaatgaaaggtactaaaatgaattgataatctaactggtgcattttaaaacgcttaaagagaacttaatatataatgtcttcatgaattgcttctagttctgttttaataataaactcgtaactcagatatgcatacaaacaggaatcaattgggacagcaatgagcataaacatttataatcacttgcttttataggaactaaacctatgacagttatatcgatgattagagtacctacacatgaagacaggtagaaagtagaacatacatccaaagtaacatactgtcaaaaatatccaagcaatgattgcatatttgaacaatgtatattaaaagattataaaattatgtgagcagtatgtatttttagcattttatatgcacaactatcttctgtttggtcaaattacgtgtcttttatacacgctaaaaactgaaaacaacatggacaatgcaaaagaataagtttatgtttctaaataaaaacctgtacttgttaatcattttgttttttataacatctccacaacataggaatcaagtcatgaaagcagacaaagtgatactatattctgaagttattatgctgttggcctgactgacatctgtagacataaactctctacctgtttgaaagtattacagatattaatttttaacaatatttgccctaacttgcatttttctctttgtttttagtatctgacattttatatgtctcagattaaatattattttgtggtggtaaaatgtaaacattatttttatgaattcattctcatatatatacaatcacttaaatatgtattgaataccaggaaataagctatatttaacaagtgaacacattaatttcccaggatatgtttattgaaccttatgagactattaattctgatttatgtgctccttatgtttgatacacagaaataggcaaccctttggagaacaaaaaattagaagaaaatagatgctataattcatatttcaagtagtactgtccccagtaatacagagctagtgaaaatagcgcaggatgcttgatactggagtgtactttaaacaataaattattggagggcatagaaacctcatcaagacagcaagtctgcaaagactccatgtgggcaacctggccttgctctcctgtgctgctggtcaacttcctacagctcagctggcattgctcaccagacaagtacatgataggcatatcacttgttgtacattatctttcaactttttatcttttaataattttctggctcattgttacatttcctgtgagaaaaatggagttatttgaaagtttagtttcagtggtttttcttgtggctataattagggtgcagtccacttcccattgatctgtgcacagaatacaaaatacataagagaagaggtgataatgtgaagtgagaagttaaggggaaaatggccatgcggcttctattatagaaatgagggcttaaacacatacaatgacatagcctatatataattgagagttatctatgtgcatgagaagcaatgtgtatgtatgcatatatattagcggtgggaactgtacacaggctaatgtttagcacaaaaaatgataaaataattatttttattaattaaatgcatcaaagcctaattaaggaatgactcatgtgcagatgattatgaataaattgccaaatagaacctgtccaaatgcagaaaaaattgattttaaaataattcatataattattttattgagataatcaaaaatatctaatttgaaagcaaaatgaagatatttgaaataatttggttaacttatcacatataattattttattgaggtaatagcaagtatttaatttggaagcaaaatgaagacatttgaaactagtttggttaacttatcacagctatggtataatttgagtcagaaaactgacatcaactaagtaacaatagtatatcaaaccattgagtatatactatgtgctaaataaaacatgtatgttatgtcattaaattctatcagtaacactgcatggtagatacttgcatttccgtttgatacaagagaaaacacaacttacccacatcacagtagagtgccacagccaaaatttgcagctgtatctctgacatcgtgacatttattttaaaaagagaaaatgaaattagttatttatttaacttaatagagtggttgaaagcatgggctctaaagaaaaccagatggttttaaattctgacaggcactcatatactagctgtgtagtcttggttacttaccttattggagcctggattatctaatttataacatggagataacaatacacagagtaagcactcagtgttgttattattaagatatacatgttgccttaattgactgaaatatctatgacaagtgtaattctgttgatatttatctggatattttaaggtatgttttatttgtcttccaatcaggaacatggtaaccataacctgcccaaccccaaactaataactgaggctataaaaagtaagagtcacttaccatttcattctatgcagtttcctgccttgaaataggtgtcttatggctttggttggcaatactgttaatggaatatagttgtattaaaagcaatttttttttgacaattctttgttagcagtcagcaactaaatatattaagaagccttgttttgcacactcttccaaccacagaacactaaagatgtatatgttataattacaattatcctttctcttcattgtcctgctgaggaatgcactgtaattctggcagctagagtagagttggcttgctttccttggattgcagatgtctaattgcaggcaaccatttcatttaaaatggctcattaaagtaaaaaccatttagcatcagtaacatggatcagcatccatgattatgcatttaattagagagaagtatgttttctcctcttttctaatttttctatctatagatctacctatgtatcaatctatgcatctacccacacacatacacatagatgcacacatgcagatttatacaaagcttgccttagacattaattttatcattttgccatcattgcaactccttggctaattgttccatggagtatgtatagaacgtactaattatgaaattatagaatatattgttactcaatattagtaaattgcatattgcacatataggaattttctgttttgtaggcttttctagatatgttatattttaccttagtaaatgtccttatttactaactgaaatattacttgtttattatcattccaaagaagcgtcatatcctgaacgctttagtttactgatcactgaaataagaccgtggtgtgggaagagagagagagagagagaattccaatttttctcattctcatgcataaaagatcaatcatagaagcatagttttgatgtgatgatatgtcctgttatttgtattgtgaaaatagatttgtctaacaatatttgttcggaaatagaacatttggactttttaagcattacttttaacaatatttttaaaaatagtcaaaaaccacaggcattatctatatcataattctactaaacagcagtgatgagtggcaattagttgtttattgagtcactgtttacataattatttgtaagttatttgtaaatggccttaggttttttagatctataaatttcagtgaataaaatataatttaaaggctttcataatattaaataagaatgaaccaggctgtcttttattagcttatttttcatttcattagagaaaaacacagtttactttggcagaatctagatatgttgatgtactttatcatgtccaaattcgaggcagtaaataattttctgtagagagcccctagtccttaaagagtagactaaatcaacaaaggatccagaagtaaaagtcagaagctaaagtatatttgtgcatttctgtgtcagtaagaaagaagttaagactgagatataaattaagaatacattatataaaacctgctccagtcctgtcctgtaagacagccaggggatagcctcaagagttcaaggttaatgggtctctatgggaagtatttactttctcactggatttttaaattacattcccttttttccccaccagtactactgaagtaaaaagagaaacaaatgaacaaaaacagtgctggcaggtatgctatttattgcccaatggaaaagttataaaatcattgttattactgctgtataataattgatacatactgcttgatatgtgccattgttttatgctggtcacctttcacccttttttgtttttttttgtcacattcttgatatagatcataagcaagaaaagagacaagtgaaagtggaaggggaggaaatagagaaaagataaagagataatagagaaaagaaagagagaggaacttcaagaagagagaaacatacttcacagctgggcaagattcagatttttttttaaaaatgagaggatcaaccatgatttgagagaataaggatacaaagttagtgtttaaaaagagtgaagagagaggggaaagagttgttttgagtttgaagtgttagtaaactatgcttctcacacactgcgatttacttgaatgttagtcgtcaaagtgatatcaaatcttatcactgcattgaaatgcaaaatagatgattgattactattcatagttcttcaactttctttctaagcaaattttcaagtacttctatgcagttgcagtccaagtagctaagtcttagaaattatctgagcagtgaagaaagtattactcatctttaggaaggaatacatttaaactgaaagtgaaattgtgtctctttgatcaatggacaattccaccctaacccagttgctaaagaaactgttttgatgcctttatttttcatgcctgccctcagttactctattgtttttatgctgagtgctacaaagggaacgaccatcaaaatctctttgtactaagaactttaggaaggagtgaaaataatgtataaacaaagcttctgccctagttcattataattgggaaaataaggtaaatgcgattatacaatttcaaagactatataatgaaatagagtgtaagttttagaataaaaacctggagaatcaaatgacaaaaacatttgcacatagggtttcttttagggagtttggaggcaaataacctataccatacctattatataaggcacagaatagataatagtgtttaaataaaaagctataaattgttactcttatacagatataaaaatgaacacattttaaatgttttatttaactcacatgggaaccaggaaaatgttgtaatctattcaaaaaagaatctaaggaacagacacatgtatagactaggaatatgcaaatggcatcaaaatattttccacaaaaaagagtatgaaagtcacttaaaacctctaacagacaagacagaattcataggtatgtcagttacctacaatttacagaatcttaaactgtatcccatagaaccataatcttggcctgccaagaccaagagtgctataaataatacatagttttcctaggaattacaaatcttttctcaaaaatagtaagggcaaaaacctagagaaccataataacactcatttcatcattttcaaatgagtagtgaacagcgtatcttgaacattacaaaagatagaaatcctaaacacaaaaattattatataatacatttgtcagttctttgtgtttatatgcacacacacacacaccttttttttcctagtgtgataattgctttatattttggttattccttttacatcaaacttaatatttcacataatctaatcaattgatctagtcctttgggatgatgtcttgtctttgttctacagatgagacaatcaacttcctatttggattttaaagaaatacgtaagggtttgattaatgatagagttcctgggtagaggaaatgatatttttaaaaaattaattagattatatttttaggaaacattactttattgagatttttacattaagtgataacaatcatattttttttagttttcaaaagagaaaagacttggttgttttctactactattttaagggttagttttttcatcaaagcaatatatatctttatttcatggttcatttttataaaactcgattacaaataatgcgctgtggaatttttcccaaggcaaaagatcaaatatagagaactggccaaatatttatactttgcctctgtgttttcattaatggaatttttattagaacttaatatttgtttatttttgcattttggaaagaagcgtgtctaaatccaaacctttctcttacattacccttttaaaaagccaagtaaatctgagcattcactttcctgctcaaaaccttgcaatcatctcctttactgaagtccaccagcctctgcttgatctgccctatgcagactcatcctccctatctcctcaccccactccttgctttcttcttggcttgcaaacagctgcctcttgctgggttctcccatactggagagaaagagagagcaaggtctctagaattgcctcttatgaggataataatcctatcatgagagtcccactctcaggatcatatataataaatcaaatgactttccaaagtccctaactctacatactaccacattgggaaattaaggcttcaacatatgaattttgagaagactcaagtcagtcaatagcattctgcccctgacaccccaaaattcatgtcctcacatacaaaatacgttcatttcacccaaatacccaaagtattaacttgttccagcagcaactctaaagttcagagtctcatctaaatactatctaaatcagatatgggtgagactcaaagtattactctttcctgagaaaaatttcctttttatatgaacctgtgaagtcagacaaattatatgctttcagaatacaatggtggaacaggtataggataaacatccccattccaaatagaaaaatagaaaagaataaaggggtgggagtcccaaacaagcccaaatcctaacaaggcaaatttaggcctccttcattctgtcttttttactatgttccttttagttcaaaactggcagtgttgctggcataatcctgtctttattcctggactctgctggaatggctgattaacttcatcacagtcattcatgatttctttattaaagttttagccacatctttaatgttctcttcagaacaagctttctctctctctctggtaatatgaataggctgagaattttccaaatcttcaaggtctggttcttttttgcttgacaaattcctgatttaattcctctttcttttttttttttttttttttttttgtattttattataagcagtcaggaggaatcaaattagctgcttcttcaatactttgcttagaaatctcctcagctaattatctagtttcattgttcgtagtccttccttccacaagacactaaaacatagttcagccaaatcccttgctaatttgtaacaagaatcacatttcctccagtttctgatatgtcctcatttccatctgacacatcaccagaattgcccttaacactcatatttttatgtttctttaaaatttgttttaacttcctattatcaccacttaattaatgcccatatttttagtatgcacttcaaattcctacagcctccacccactactgagttccaaagctgcttccacatatgcaggtatttgttacagcagcaccacactcttgttaccaaaatctgtattagtcaaagttccccaaagaaacagtaccaacagataatatagtacaagaaactgactcaagcaattatggagactaagaagttccaagatctgaagttggtatgctggagacccagaagagttaatgttatagttccagtctaaaagccagcagactcaaaacctaaaaagagacaatattgtagcttgagtcagaaagcaggaaaacattaatgtctaacctcagggcagtcaggcaggagaagttctctgttcagcacatgagggtcagccctttttctctatccaggccttcaaatgattggataaggcccacctataatacattagggaggacaattactcagtccactaattcaagtgttaatctcatataaagacatacccacagacacaccaagaatcatgtttgtcaaagtatttgggtacccatgaccctgtcaagttgacacatataattaaccatcacagggagcctagaggtaaagaccttgggtggggggaattatagaaagaggctggagcagatcctacagggccctgaaggacacattaaagaattgggaacttgtcctaaggaaaatgacaacccattggtgatttttaaggaggtaaataaggtaatctgattactattattattttttaaaaggacatgaggaagtttgggttgttgagaggaaaggcagagagaaaggtggtactgtagttagaaattgtggtttgatctcaacttgtcttcatggagaagaaagtggagttccagcttgatccagcttgtcttcattgagaatgggagagttttgaaatatagtgagagattgatttgatatgaggagagaataaaagggagggatcaataatggtggccagtggctagatttagcaaatatatttgtagtgtgtgatttaccacaaatgaagaaagaaggaagttttataggaagaggatgactttagttttaggtttatgaagtttaagtggtgcaggtctgaggtccagaggtgtagtctgggatagacttacatgttgtaacaggccaagatttcctaggtagagaatgtaaaaaatgtagcgataaaggatctgatgaaaaggcacccagtatttgatggatagaggaagggaagccctggaggtaccatcaacttttttttggctcctattgtattcaatatgttgacatttatacaatatctcagaaataacagggtttagaaaacatactgtattagtccgctttcaggctgctgataaaggcatatccaaaagtgggcaatttacaaaagaaagaagtgtaatggacttacagctctgcatggctggagaggcctcacaatcatggcagaaggcaaggaggagcaagtcacatcttaggtggatggcagcaggcagagagagagagcttgtgtagggaaacttccatttttaaaaacatcagacctcgtgagacttattcactatcatgaaaacaatatgtgaaagacccatccctattattcagttatctcccaccagattcctcctataacacatgggaattatgagagctataagatgagatttgagtgaggacacagagccaaaccatatcattcctccccaggcccctcctaaatctcatgccctcacatttcaaaaccaatcatgccttcccaacagtccctcaaagtcttaactcatttcagcactaactcaaaagttcacaatcgaaagtctcatctgagataaggcaagttctttaggcctatgagcctgtaacatcaaaagcaagtttgttacttcatagataaaatggtggtacaggcattgggtaaatacagtcattccaaaagggagaaatcggcccaaaacaaaggggctacaggccccatgcaagtccaaaatctggtggggcagtcaaagctccaaaatgatctttttttactccatgtctcacatccaggtcatgttgatgtaagatgtgggttcccatggtcttaggtagctctgcccctgtggctttgcagagtacagcctccctcatgactgctttcatgggctggtgttgaatgtctgcagcttttctaagtgcacagtacaaactgtcagtggatctatcattctggggtctggaggatggtggcccttttctcacagctccactaggcagtgccccagtaggggctctgtgtggatgttccgacccaacatctccctttcacactgccctagcagagtttctccacgagggccccatccctgcagcaaacttctgcttgggcatccaggtgtttccatacatcttctgaaatctaggcagaggttcccaaaccgcatttcctgacttctgtgcactcacaggcttaacaccacatggaagctgccaaggcttggggcttgcaccctctgaagccacagcctgagctctacattggcccctttcagccgtggctagagcagctgggatgcagggcacaatgtccctagactacacacagcatggggaccctgggcccggcccacaaaaccagtttttcttcctaggcctctgggcctgtgatgggagggactgctgcaaagacctctgacatgccctggaaacattttccccattgtcttggggattaatattcagctccttgttacttattcaaatttctgtagtcagcttgaatttatgctcagaatatggaattttcttttctattgcattgtcagactggctgcaaatttttcagacttttatgctctgcttcccttattaacagcaccccagtcacctcttgaatgctttgctgcttagaaatgtcttccaccagataccctaaatcatctctctcaagttcaaagttccacatatctttaggtcaggggcaaaatgccaccagtctctttgctaaaagaatcaccttttctccagttcccaacaagttccttatctccacccgagaccacctcagccttgatttcattgtccatatcattatcaggattttggttaaagccattcaacaagtctctagggagttccaaactttcccacattttcctgtcttcttctgagccctccaatctgttccaccctctgtctgttaccaagttccaaagttgcttccacattttcagtattttttcagcagcaccccactctactagttccaatttacagtattagtttgttttcatgttgctgataaagacatacctaaggctggtcaatttacaaaagaaagaagtgtaatggacttatagttccacatggctggggagcctcacaatcatggcagaaggcaaggaggagcaaatcatatcttatgtggatggtggcaggcaaaaagagagagcttgtgtagggaaacttaatttttgaagtcatcagatcttatgagacctattcactatcacaagaacagcaggagagagactcgccccaatgatttgatgatctctcaccaggtccctccacaacatgtggcaattatgggagctacaagatgagatttgggtggggacacagatccaaacaatatcacatggtatcatggtgaaaaatgtaatgaaaccatgactacatttgatctttaggtttgcactatgttttaatgagcgtttcaacttttattgcttttatgttgatttttacatctgtctacaaagtgattttttataggcttttggtttttttggctgtagatgtgaaagagaatggtgcattgtgaaagaaaaggttgaacaaaaatcaattcatgtcagaattgattaaaatcaggaaacattttcaatgtcaacaggatatttaggatgagaataattaaatgagctctggaggcaaatgaattattgactacttacaaatatcaggcctaagaagatagagattgagacatatgtcttcttttttttcttagtgaagagaaacagacaaaactcttctaatatgtaacttggtattaaaccattgtgaggaataattaggaaattatcctaacataggaaaaaatatacaattgacacattaaatgtcaattgtaattgacaattgtcaaatgtcaattgtaattgacaattgtcaaatgtcaattgtaattgacaattgtcaaatgtcaattgtaattgacaattgtcaaatgtcaattgtaattgtaattgtcaattgtaattgtaattgtcaactacatgtatatatgtatatatactcctgaaaataatctctctctttaattcttttcagaagcagcttaaagttacatggagaaaattcttaagtagttgatattacaatgtcaacttttgcctattttcagactttgtacttagatactatatgcaaattgcagttttgtatttttcccctgaggattgttctagtgttcccacctgccctatcttcacagctttttttatcccattcctactttatcctttgagacactggtctcattcattcactcatccattcattcatttatatggtaaatattaagcaagagtccctattttcacaaatctgacattgttgaccagggtttctcaaccttggcactactgacaatttggctagataactctttgctgtgggggactgtcctatgtaatgttggatgtttagtgacatccctgttctctacctaatatacgctgatagggcccaaataaatgtctcttgggtggcaaaatcaccctgtgtaaagaaccacagtttgagagagaagaaagacaataaagaaaaataacataacacaatattagtgatgataagtgctgtgaagtaaaatagaaaacgggactgtggtaagagtggcagcaggagcaagggttctaaagctttctcaaggacagcagtctgcatagcgcacagatgtagaagccttgtttctcttttaacagatgtctatcattcactctaaacctgtctatggaattgctaattaaggcaagagcctgatgtattacttacatgattaaattatttctggttcttgactatttacaaaatgtcacagtcacagtaagatttttttgaatatgtcaagtttctcaactgaatagaacattaataacttcaaatggactatcgcatgctattgattttactctcttgtttctgccactggagaacacgaacatcaataaatcacataggccctcagtgggtgattggagggtatatttatttaaaactcttccattaatttttgtttattacattattcaatctatcttatagctggtctgccatttttgtgggtttcagaattgtgaggactcttaatgggaaatgctgtgacactgtgataaatgaaagagcagtggacggtgagtagcacacttgggttctcgttcaggctctgttattgactggctcaaggaccctgggcaaagtacttcacctctgggcagcttctcttaaataaggactagtctaccttcttaatttatttcattgtttttaatgaagaaatgatatagcaaatgtaagataatcttttaaaatgttatattttttctttaaaaaattaggtaattataaggaagatttatatttctcagatattcttgaagttgaggagccacaattgtgactgtttccatcacttgatgtttcttctcctctaacctacttaaaaattgcaggcccctgtgctatcctggtaaatctccctccagtttgccagtatgtgtcatgtttcactgcaaacctcacacaattttctgtaagacatggcctaacccgaaaagtataaggaggctgttaaatctgtggttttggagcagggattttttttttcatgatcatcccccaccctcaaagagcctttatagacattgttttcgtagttgctcacctatgaaatgctaacatcacagatttatcccctgccctccgcagaatcaactttgctctctgggaatgatatggtggagaaagggaaagcgattgcctgagttgagaattcatgtttgactcaaagttaagttggagtctaaattcccagcagctttttggcagatccaacccagtccaaatctgctgtggctgtatagtgtgggacactggctcagctggccggatctggtgttaaatccctgctctctgcactggcttatccttcccaaatactccatgtttctgagtggttctttggctataaaatagcattgtatttcctgttcctgaggttgttgtgaggactaattgaagtaacatataggaaggttgttaacagtgcatggcagatgaaaaacagaaatgttcattattatttatacccaataacagcaatttttaaaaggaaaagggggagaggagaactaatgcttttaagtccacaactgcattctacatttgtgtagtggttattttcactttatttttaagctatgttcagaacgtaacttttgctcttgtttttctttgttaggtttgaccccatgtttaaacatacgtattagtctgttttgtgtttttataaaggaataccttaggctaggtaatttataaagaaaagaggcttctttggttcacagttctgcaggctgtacaagaagcttggctccagccagcctctgcttcttgtgaggacctctggaaactttcaatcatggcagaaaaggaaggggagccggctggcaagaaaggaagcaagagggggtggtgccaggttctttttaacctctagctctcctgttaactaatagagcaagaacttactcattagcatgggtaaagcacgaagccattcatgagggttctgcccactgacccaaacacctcccactagatcccactccaacattagggatcacatttcaccatgagatttttgaggggacaattatccaatctatatcagcctgacatctgcaaatttaattggcttttatgcttctcactcaaggtaaaaaacagaaacaataaacaaataaaatacaaccactactttgaggaggacaaggtcagggaaagccacaagcatgcaagtatgcaactaggaaatttccctgaggacactggttgtcaaccttgactgtataatttggactgaggtatggcctaagtgttggaattttaaataattcaccaaatgattctaatgggaaatagggtcaagaactaccaaatattcaataataaggaatccactcaaatagaccaactattactagagttttcttaagttctctgttgaaatccagatacacttgtctgcagaattcatctgttaggaagaaacttttcctctatgatcttaggttcaaatggttggggtcctgagagttaactgacgatagatagattagcagaataaaagacagtgtttatgtatatgtacattgcaaaccctcaggagtactcagtgatgagtaactcactgaatcctcaaaattaacattttatataccattttaacaaaatgtatttttttaaaagggcatcagtggaaacgtatggaaagtttattgggctttttgatgctaatgagaataggaagcctgtctccatggcagctgaattcacaggaaattccttgcaggggagttaatgggagctatattttcaggacattctgctttaatcagataagggatgttcagataagatttctttttcattttctgtagctcaaatgttttcacttgaaaataatctttatgctaaaccgtgatctctttacatgtgataactcttaaaatgagaaaatgacacacaactacaccaaaaaagcaaataatttaagcatggcattactgagtgctcattatgtcccagttttatttaccagggccaagtaatgtgtccaaagttaacagctaataaatagcaaagctgggagtatgcccaggtttacctgactccaaggtcaacactctgttataccacactgttcttaatatgccctagtggtaacagcctctctttagacttctactgaggttaataagctatcatacaattctgcttaagaagattatcagaatatacttttttctatttttggaaaaagcaaatgtatatctttttaatagtttttagcttcctagcagtgacagtgaaccaggcctggtgtgcctgttacgcagtatgccaatcactaaggtgacaagtttgcagcagagaaagagtttattcatgaggcagccaggtgaggaggtgagaggacaggtctcaaatctgcctcctgaagatgtggtttagggatatttgtgggataaagaatcagggtggactaaggtgtggggtaagatgattgaggtgtcaacaaaaagagtcagactctgtaaaatatttgcagagatttactctgagccaaatatgagtgactgtggcccatgacacagcccttaagaggtcctgagaacacgtcctcaaggtggtcggggtgcagcttggttttatacattttaaggaggcatgagacattaatcaaatacatttaagaaatgcattggtttggtccagaaaggcgggacaatttgaggcaagggcttccaggctatagataaattgaaacattttttagttgacaattggctgagtttgtctaaagacctgggatcaatagaaatgaatatctgggttaagataagtggttgtagagaccaaagttttaccatgcagatgaagcttttagctagcaggtttcaaagagaataggctgtaaaatgttttttatcatacttaaagtctgtgttgatgttaatgccggagaggtataatgaggcatgctagaccccccacttcccatcatggcctaaaaccgtctctcaggttaaattttaagagccctggctgaggacgaagtccattcacatggttgacagggggagattagaattttatttttggtttagagagattaaggaaaagtgaggtaactggcgatctatacgagcatagtcaagcttcgtggctctttacgggaatcatgtttacaaaatggtatttgttagcatgattttagggtggagtttttagtccctggacaacaaaaggtcacctattggacatttacaccagcccaactggagggttagtggtttcaaccagcttgcattggacaagagctgaccaagttcctgaaaaacaacttaaacaatcgttaccatggtgacctacacctcagcgatgttataagaaagttaggaaaagtttagtttatatcgcttagctatgtgacttttagctatataagttttaaaatcaactagaagcaagcagctaaaagcaagccagatgggttaagtttggtgggcctaatcaggtcagcccttgttttaagcagggtttaatccatcttatatgaaaaatttcttaacacgttgggatgcaattcacttctatatggaaacttatttagaccagctaatagctgtcttcctaatgcttctttatcttggcctttagaggcttccttccatagttttttccatagtcttttatctacaccttgttctccttaccacagagaaagtaatcaaaatggagttgtgtggtcttgtattctccttctggtctttaaaaataacatcaaccctcaatttcattcatgataacaagtgccctatgtagtatgtcctatcacttccatattttttcttactttaaaaataattaaaaatttcagatacttaaagcaagtgttaggtagccattatatttgcttaatatgagtattattaatttttaaaaaacgttaataggttttttgggaacaggtggtatttagttaaatgaacaagttctttagtggtgatttctgagattttggtgcatccattacctgagaagtgtacactgtagcaatatgtagtctttttttattttgagatggagtctcactctgttgcccaggctggagtgcagtggcatgatctcggctcactgaaagctccacctcccaggttcacaccattctcctgcttcagcctcctgagtagctgggactataggcgcccgccaccacgcccggctaattttttgtgtttttagtagagacggggtttcaacatgttggccaggatgttctcgatctcctgacctcatgatccgcccgcctcggcctcccaaagttctgggattacagacatgagccgtcgtgcccagccagcaatatgtagtcttttatcccttgccaaccgctatcctttcctctgagtctccaaagtccaatgtgtcattcttatgcctttggctcttcatagcttagctctcacatattagtgagaatatacgatgtttggttttccatttctgagttacttcacttaaaataatggtctccaattccacgattccatccaggttgctatgaatgccattatttcattctttattatggctgagtagtattccatggtgtgtgtgtgtgtgtgtgtgtgcgtgcgcgcatatatatatatatatatatatatatatatatatatcacaatttctttttctttttctttttttttttttttaagatggagtttcactcttgttgcccaggctggagtgcaatggcacgatctcagctcactgcaacctctgcctcctgggttcaagcgattcttctgcctcagcctcccgagtagctgagattacaggcacacaccactatgcctggctaatttttttgtatttttagtagagatggggtttctctatgttggtcaggatggtctcgaactcctgacctcaggtaatccgcccaccttggcctcccaaagtgctgggattacaggcaagagccactgcacctggcccacagtttcttaatccatttgttgattgatgggcatatgggctggttccatatgtttgcaactgcaaattgtgagcactgtttaattctaagcttccttgtaggtaaggcaaaaagcaagcaaagtattttaggcaattcccataactaaagggaaattatttattatatttgtccatttgaaaagatattttttcatgttgtaaaaaatttattaaatgaatgctaacataaggattaataaacaacatgatcttaacattcttcatggagtaatttagtttttttcaatttttgataaaaagctgaaggtatatcaacttgttattcagtgaaaggataactattggtagcgaaatataaacctgatctagatttggagatcaaaattttggatttatacactttagggaatatatcagaatgaataaccttcacatcacattgagtactctatgaagaatcagttacatgggctggacttttgatcagaccctcatagaaaacagctgagcatgatgggcctggcattctattgatgattaccaatacagtcatgtattgcttaaaaagcacctggccaagttatacatattataaaggctttttggtattctcgttgagatggattgagaaatattttatatatattttttgagaaacgttttatgtatgaataatagatgggcaatatgaaatcacagtataaaatttagttttctttcaactagtctcaaaatttcatgcccattacaaaattaaaactaagaaaaaaaattagccatgtttattttttctttttctgttgtcagtgttcttttaacaccttagctcttcagggtgctctccctgcagctatatttttagatgtttcccagtttctctcctcatcaggatcatttaatattgtaacacttcaatttttaaataactccattttaatattttgtgattgagctatttcaccatatgagaatcttaggtctttctgttttctgaaagttttgaaatatgacttaaagcttgaactaaatgtatggttatatcccacaattctcgtctcctaaccacccttccccaagattattcagaatgtcaagataacaaattatatttcgcggagtctcatcattccaacttcaccacgagtttttccttattgacccaaagtaactttactgctttctctgttgtctgaggcattaaattgccagccagctaggcaagtgaagaaattaatttatttagttgaataataattctaggagaattgagtactgttttttctgtctcctttctatcatttgtctaactaatctctctagcatttggtggtataaatacagaatagtcatctattttaatcatctaaccaggtagtgtatatcatcctcacaaatagtgcaacttagattccagtcttattgttaacatcctgctaccttcaaatattttatttatttattgagacagagtcttactttttgcccaggctggagtgcagtggcatgatctcggctcactgcaacctctgcctcctgggttcaattgattcttctgcctcagcctcctgagtagctgggataacaggcatgttccaccatgcctggctaatttttgtatttttagtagaggcagggtttcaccatgttggccaggctggtcttgaactcctgacctcaactaatcagctcacctcagcctcccaaagtgctgggattacaggagttagccactgcgcctggcctaccttcaaatttttgtctcagtggataagacagattttgttacccattttcttcttcaaattgacttgtttgttctattaagatatacattttcacttccactttctaatattgaatccctcagtttccctttgtaaatacatatgtgcatatgtgtatgcacacacacacacatatatactcccaaacacacccatatattctttattgtaataccccgcttgttgatatatagttatgggaggacaaaggtattttctgtaatatggttgtgttctcctatgaatgctttgggaaattccctaatgtttttctatctgtgtcatatctattatatttttataacccttgttaacattttaatattatttttattttcccataaattttatgtttaaatcttctgaattagatcagcagttcaccagagaaataagtcttccgtgtccctttgaaaatactttctaagtcacaaatccccaccaagtttggtatcttaaatcatgattctgccaccatctatataaccagctgctcagcatttttcctttcctaaatcacacattgaatgggaggaagaattttaacacttggaaccctttaaaggaaccctttagctttctgcctaggatgtcatgaattctaaaaatggtttgcatgtgtattatgatggcatcattcatacccacatgaatcagcaggcatggatagttgtcagcaggtgtgataaggcttggcagtttttccattatgtcctggatacatgctgcagaaaggcaatggcttttctgtttggccatgtcaagtctacataaaatttactcattctccttggtgaatgactagctttgttcaattagatagccttcattcttttctgaaaataaactgttatttcatcctaagtaattaatatctgaatttttgtatgttttggaatttctatgttttatatctgtaataaaattaagatatatgtacatcttaatttattgagtcaatattaatatatttctgaaataattcaaagattaatagcactattttataacaacattatagacaatattggtagatgcatcattcattgttatttggatgacttaaattatatcagaattactaaataagaattaaatattgataaaaatagagggaaagagtatcccatactgtgccatctttgaggtcacagctcatgaaagagagaaaactgcaaaacagactttatctttgggtattatttcacaacaatcttatcttactttgttctgtggttggcaggccgtgtgctatagaggccaacagccagagtctctgcaggaggatttcaaatagtgccaaatcagaaagagatagcagccaaagggaactgacattgcaattgctagaatttctcctgaaaatgttcatattttaggtaaaaataagcaaaattatgttactgcagtcactaccatgtaaaacaaggggcaatcttggttgggttaagttataacatgatgttaaaaatggaaagtacatatctgaaagatattcatgcagtcaaattaataaaaatgtcagaataagctatttcttattctggaggttgttagaaatgaagtagactaagatgcattctctgttagggaaagtcatgaaatacagtcataatttggttctataattcctttcatcaatttagcacaaaacagataattaaataaaaattatttagtagtgataaaatttgtattctgggagttaatcatccttgttaaattaaaggacaaattaatgttgggaaattctgggacagctaaaagacattaaaaaggacattaagtatattaattaaaccatatcaaattgccattttttggtaaaaaatggttgatatttataattacatatggttcaatttaggtagtatttaattcattatttacattataaatatttatataaatttatctttttccaccagactctgagtcctgctagtgcaggcttattgatttatgtatcaccagtatatatcacagtatctgatactctacagctgttgaaaaaatgttgaataagaaactgagactattcgccaggacaattgtctccagcagtttgattgactatcactcaaaatatatgtacatgtattgacttacaaattatgttctgattcattatacatgttacatcataaaacatatatatacatatattaaacatttttaaagataattttattttgtctaggaagaagacattggcttagaaaaactccaacattttagcctgacagtaaatactaaatttgcaattgcttggaaagaacaagtgcagtaatttaaatctggcttttcatctttcttattttaaaggaattgaattagggcaaagaaaaggaactaacttttattaagcacctggaataagaaaacaaatttatgtacattattaaatttacacttaacaaaggaagtattattttatttatatattgatttattttttgagacagagtctgcctctgtcacccaggttgaagtgcagtggtgcgatctcggctcactgcaacctctgccttctgggttcaagcgattctccggcctcagcctcccgagtaactgggattacaagtgcccaccactatgcctagataatttttgtatttttaatagacacaagatttcaccatgttggccaggctggtcttgaactcctgaccttgagtgatccatctgtctcggccccccagattgatggaattacaggcatgaaccaccacgcctggccagaagtattatttttgctaagcagaatttaaagctgaaaatctgagaagttagataaattgtccacagccattatccagttcctagttccagagcctggcctaaaacctggtctgaggtctggtaataaagcctgacatgtgcgtttccttcctaaaaatgatgatagtagtctatcaatgagggttaaaaaatggacatttttcataaatttatgcattttacttctgtatgacctgtatggagaaaagtgattttctctttttggtaaataagcaagactcctaaatcaaggcaactattcaatatttctaacttcttggtttcttttaatagcaacagcagtagcaacacaagctaactattgcttactgaaaacttgtgtgtgccagtttctttttttttttttttttttttttgtgtgagacagggtcttactctgatgcccaggctggagttcagtggctcaatctcggctcacctcaacctccgcctcccaggttcaactgattctcctgcctcagcctcccaagtagctgggattacagatgttcgccaccatgcctggctaatttttacttttttttggtagggacagggtttcaccatgttggccaggctggtcttgaattcctgaccttgagtgatccttctgcctaggcctcccaaggtgctaggattataggcatgagccactgcacccagcagtgtgtgccagtttctatgataaatatcgtacctaaagttgcctcatgtagccttcataattacccggttgaggtattatttttaccattttgctcttgtgaatactgaggcttaaagggaccaagttggccagtgttacacagaaggtaagtgacagggctaggatttgaacataagtttcttagactccaaagtcccttctctgtaatcacaataaatactgctgcccttctgaagagccagattttgtgatgtgtccatgatgcttcctttattttacccttctcaccgaggcccagataaatgtgtttgaaaaccattcaatcatactcattgggaatagtaaggtaaataaaagcatcaaaccttgtagaggaatcctttgtcctctcagtggcatagctagtatttcttccatggctagctgattaatggcagacaaagcagcatgcctattgcacatatctatagcacaagctatagtaacaagacttatcaatatctcaatgctatagcaagaaaaagcattcagggagaattatgcaattatttttctgtagtttctgactccttgatttgggaaagttagtagctgaatgctcagagagagagagaaagagaagggttgtaactatatagagggttaggttaagccttgtggattagctgcagttggacaggagcttggtagaggaataatagactttccatgttctttcattcaggcccactggctatttcattcaccgctttttaacttacatttcatgacttttctagaattaacagggcaaatggttcaaaatactgccagttaatttgtagataattttaaattctctcatcattgtgagatattgtggtacagtgaaaaaagtactatattttgaagcaaaacattgagaccctcttttaccatgtactaactgtaaatttgtaaggtcacctctattttctaaatttcttttttcttatttatgtatctatttcttctaaattttttgtagagatgggggtcccactatgttatccaggctggtctcaaacttgcgggctcaagtgattctctcaccttggcttccaaaagtgctgggatttcaggcatgagccaccacacctagctattttctaaatttcttttttttttatttttactttttattatggggaattttaaatatgtacaaaagtagacacaatagtaataacaaaccctcatgtattctacctagtttcaaaaattatgaactcactatggcatcttatttctttgtccttctcactttacttttccattttatatcatagtaaatccgagacatcacatcattttattgatacatattatgttttgtattactaaaaatatgggctttaaaaaccatatataaccaaaataccagaatactacctaaaataaactaataactttttaacatcatcaaatatacaatgatctaatttccaattgccttacaaacttcattttttcccccctaccattgggtttttggaatagggattcaaataaagtccatccattacaataggttgacattattttaccatctggattttgctgattgcaaccccatgataatcttcaacatgttcatctgtcctctatattttctgtaaattggtggttggttctagaggcttaatcacacttaacgttggatatgtttgtttgttctcgtgcaaaattacttcatagatgatactgtcttcttccctcagaaggttgttaatgtttgtgtctcttgtgatgttaggaaccagtgatgatcactatctagctttattaattcattaggggctaaatgaggagattctatttctttcactttctcctcacttattagctggaatatttctaaaagaaaaaccttccctatgtactatttagtttcccattcatacaatttcatgtagaaaagaaaaaaataaatgcttattttcctttatttaccacttttcaaaatgataaattggttctttatcatcttacaacaccttatatgttaatttttgtatcattacaaactataaataaatatatttattgtgcttcaattcttttccatgattgttctttttgagttttaattattttattttggtcattgtgaacctcctcaacgagcctcaaaataattttgactctgacctgtttctcattgatagtgtcttttgttgagtattaacacgattttccagaattatcttgtatatatttttgccccagccctaaattagcagtttatcaaagtagcttggtttctttcggtgggaattgttacatcaaaactgtaatacaggcactgtggtactcattgctttcgacttagtcacagttcataggcttctctgtagacaaagctggaaaatattttatttcatttcattttaaattataaaacccattaagagtttattttgataattccaactcaaatttagaactacaataatttaatcttctattttatgtctgtatctcctttccctgacagtgaaaaatctaggtttttagtgataacagaagtggtagaattagaatattatgtagtcatttgcgttattccaaaaacaaacataagagtctcagaataccaatactaacatgaacatatgttgtaactgtaataaatatgagcaataatattgcatatgtaagagtacacagtaaattcaaagctttgtacaaagttaagtagttttaaaatatcatcctgaaaatactgtagatgtatttccacaaatctccgaaagagaaaatattgttagacgtatgatacaaactgacaaaagaacttatattagaaggtaaactttgaattattggtctgcaatatggtaaaactgaatattttaaatcaagacaaaataagacgggctgggcgcggtggctcacgcttgtaatcccagcactttgggaggccgaggcgggaggatcacgaggtcaggaaatcgagaccacggtgaaacccagtctctactaaaaatacaaaaaattagcctggcgtggtggcgggcgcctgtagtcccagctacttggagaggctgaggcaggagaatggcgtgaacctgggaggcggagcttgcagtaagccgagatcttgccactgcactccagcctgggcggcagagcgagactccgtctcaaaaaaaaaaaaaaaaaaaagaaaataacacgatcaccatgtccaacttccaaaacacttttgctgcaatattcctatgaatataataagatttcctaagaagcaagggcattttaaaggaagaaatcattttgttctttcttaagatctagaatttaaactcacaatataatctgatgcattgtaagttatggagagtatgaagtctttgtggggaaaatgaactagatacgtaattatgaatacaatccatgaaaggtaactaactgtttccagatatacttaagaacactcattttatttctatgtctttacttttaaaggactctttgaacatcaataattactaaccagttaggttttatattaatattaatatgacaaaaaaagaaaaaaaaggaacagaatattagtgaaaatgtgggtcttctatttttgctgcatgataattgatagttttccaacatattaataaggcattgctggggttttctactgtgtatagtaatataaaatatttgtagcatagaatatattaaaataatagtacaaataaaatcaattgaaatacagtcttatgttactggatacaataatttgttaattaaaattatattaatttttaagactgttccacatattacatttaaaacttttaattaatgtttttgaattaattgaagctatccaatattgtaatttacatagatttagctatgggatgaagtataaagataaattactttttttaataaaaatggaagaaaatatccaattaatagttgctggagaagaaatatcacaatatttcttagataacttcttctcctataagtatatagtattgattacataaaatttatgttggtaaagtgattgatttatcttcttttattatgtattttcagaattcaagacttagttgtaaaagtattcatatgatgtaattagcttttacaaatgttaaacacaatcttattccaaaaggtatcttaatttgtatcaaagtaaatctcttttgaaaggcaatatgtgcctgagatatgtttgtgcataattagattgttctatctcaaagttgcttaaggaaacaaagctattatgttgtaggagacagtaaaatgatttaggatatgggttctggattctagttcagattttctgtcttacgtagctgtctgatttggggcatttcaattatctacttaatattttgtaagtgtttaccctacagtagacctatgctaaccaatcataatgtaaatgtaaccaaaagagctataatccttttccccacagaacattcagtctcacgagggaaatagacacacatgcaattactatccataaaatgtgatgagtgctatgtgaaggaggacagggtactaggttagcacatagctgaggctccttactcaaatcctggatgatcagggaggtgcagcctatgctaactaggaactggattatgggaacgagggatgagtgatccagatagcagaaacgatatgtgcaatggctcagaggtaagaaaacctggctcctgtgaggaaatgaaatgttactcggtatggatggatcatgggaatcagaggagtaagggatagcggaatgtaaacaaagacagatgaaaagaggctggactatgaagggcctcataatccacatgggagaatatgaacttgatcctttcagcgatgtaggcactcttgaagccttttaaaattaactctgcttgaattgtggccaatggccgacaccaacaggttgatcctgaaagcaaggaacaagaagaaaagacatgaaaacaagtcacttaaactcactgtcccttatgacaggattagcataaatcatttcttttcttttttctttttggtttttttttttttttttttttttgagacggagtcttgctctgtcatccagtctggagtgcagtggcacgatctcgactcactgcaagctccgcttcccgggttcacgccattctcctgcatcagcctcccgagtggctgggactacaggcgcccgccaccacgcccagctgattttttgtatttttagtagagatggggtttcaccatgttaagccaggatggtcttgatctcctgaccttgtgatccgcctgcctcggcctcccaaagtgctgggattataggcatgagccaccgtgcccggccgcataaatcatttctaaattcactcctagccatattatatgagttcaaaatcttttctacctagtctagactctagagagttttcgagaagatttttcctcatggagatataatgggagaaaatgagttccatcttccagataaactagtgtgttatctgccttagctcgtcagatacatgagaaatcagaccacacactaataaaaacctaatttaaaagtgtatctactaagtgtgtatgataagtttttgacatttggaacagagcagtatcagatgcagcactatagtaacattaatacaatatgacaaagtggtaactaaatattgtgaaatatattattctcttacagatgtgtctagtttattgacagaactgatttatatagtgcatttcatcctaggaaagcaattttatgaaacattattataatggaaattgtgttttttcaattagttgttgaacgccaagactttaactcctgggggaaaatgtttataaggaatactttctgttaagagtgggcatgtgggcacttcattagaaaggttttatactagaggacttttataggtggtataaaactccctcccccccaggttttgtgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttatctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctctctgaaaataatttctttaaatgaccatttgaaattaaaaataagatttatttttggtgttgaattaactgcaaatacaagagtactacaacttcttagacaagtaggctttaatgtactagtttaaaatacagagttgtcttgtctgccagtcaatatttatgaatttattcaattttcatgaagtttgataaaaaatttggcattttttgctattgcacttactaagaattaatcctcacacttcctaaatcaaatggatattcttaaaagcaaagacatcttattagatatgcatttaattttgaaaagcgaccttctgaaacttgtaagtaattactttgtaaaaactctagtggttgagattcacgttccagaaaaatcttgctttaaatagctttaaatgggacatatatggttagcatggaatgagaaaagaaaatatatgccctctcattgatattatattattggattattatgctttgtggcctttgaactggtgaatattagagccacttgttacattatctatcaaaagaaaaatatttttaaacatgaggattggggtttaggcaaccattttacaaataaatcaattaatatttatacagtacctaatgtatttaaatttttaagttcagtttaaatttaaaagttcagttcttcatggaaaacaatatagtaaggaagaaaaatcatgaatatgttaaattattaaaatgtaaacaaaattggacaattatacatagtgataataataactatgttttcctggatgtttagtctagtgaagcactctacatgcattatttcatttaaaagtttacagtgggaatacatttaacttcttttctcaacatgcagatgagataaatacaattatcattctatttcatagattggtatactgaggttcaaaggggatgagcgattcgcctaaggacatagagtccagcttcaaacaataaagtctggcttcctacatgagtaatttcacaaactgagttactaaggcctctctttcataaatccaggcatggagatcctgtgttaatggaattgagatccttccaggtacagtttgaaaagtctaccctagtggtctgcaaatggaaaataacattttcttcatttcttttaaaaaagcaatttctctaatgttttgtcttttacttacttcagtctgtccattttagtagtttttttctgcttagaattgatatctgaattataaatgctagctttatttttggcattaagaaataatcacaactgggtgcaatggcacaagcctacaataccagcactttgggaggctgaggcaggaagattgcttgagtccaggaattttgagaccagcatggacaacatggtgaaatcccaactttacaaaaaatactagcctggtgtgatggtgagcacctctagtcccagctacttgggaggctgaggtgggagggttgcttgagcctgggagagggaggttgcattgagccaagattgtaccactgcactctagcctgggcaacagaatgaggccctgccttaaaataaattaaaaattaaataaataaatgaatgaaggtaggttgagtataaagtatagtgtataaatgatgagttaaagcattttaatatttttttcagtgtatttcagtacttatcttgctataactaagccagaatgcatgatgtggggattattatccatttgatatattatcctccttaaaatatagtttatgtaattcaaagcatatgtggattattaagtgcacattgtttatagttaaataacttgctggtgttcatccattgctccctgttggaagatactccaatgttgaaagcaaaatctctgctgtttgtttaattgtgccccagggtacagttgggaatgtgtctatgagtgaaagaacaccagttttaataagaatacaatgtaatttaacagttcataaaacagtaaaatttaatcctgaactgagagatttattaaatttcactcagcagaatagagcatgggatataagagcaagtgagaattaagtgaaatgatttcaggggtaatagattttattacgtgataaactgggggaatcattctttttttgaaaagctatttattcttaattcattctttggaaataattgtcttacataggaaagctttttggagacaaaataaataaacttgaaactattaaaagcttttgtttaactttatttgtttaatttcaaaagagtaaaactatactactaaaatcatatcaccattatggctaaaatattttaaactgtaagtgaaagtattttgcattcagggaaaaaggaccagtcttctttttgtaatattcatttaaagtcctcccaaactaaatgatgcttgacaacatgctgtctcagagagtttcatttttgcatatcaagtagcatattaaaaaattcttaggcatattctctgcatctgtaatgattgattccattggagctttacctaaaatgggaaatattttaaaatttattttgtttttccctttcttttaaattatgtaaagaagtattaaacagtttgaacatgctattgaagattataatgagttacattagtaaaattttctcaactgtaagacctacaattgctattttttattttcctttttttgtaggggttgtaaaacaattttctgagtaaaagaaggaggctcccccaaagctagatgtctctttatttgcataacaaaacagcagcaactattgagtgtatagagatttagctgtgttttaatacacattgtatctattgagcttcattacacctagtggagaaagtagggcagatattattgcacctactttataccttggacaaatgaggtttggagaggttactgtttaccaggggacatatggctgttaagtgcagaacagattcagcaatggtcatttgagttcaagtcataaagacaccattaaggccctttgttgtgtattaaccagccaacatttaatattagtttttaatgatataaataattttattacagtcacaattgtgtttgtaattattcaaaatccatgaataatttcaataattgactgttttaaaataagattttaaaaaataaaaaaaggtttctttaataatcactagctagataaatgcagcattttattttttttatttttttatttatttttatttttatttttttttgagacggagtctcgctctgtcgcccaggccggactgcggactgcagtggcgcaatctcggctcacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagcattttattttttaaacaaaaatatgtatatgtaaaatgtttaacattgttgagtgatgaaatacctgtgaaagtttttataaactacctaaatatgaattcagtgatatttaattaaatgactgtgagattatggaattaaatatatatatttaattatatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagttgatggacatgacatgaagtctcagtgattcttcagaaatgaatctgaacagaactatccaaagacagttaaatggttcaaagaactctaatattgagtgtcctcttttgactccatctagaaagatcatagcattcagggagaagaggactgctggatcacacattagtcttttcaagcatacctgtacacagaaatagtctctagggccactatctttgaattccatggctacaaatggaaacaatgtgaattgctgggtggcctttgtggtatgtctggtgctgagcaataataaaggaaaatgaagggaaagcaagaacacttaagtctgtgtgactctaatgatttttagtcatttcttctttttttttccccatgcagctattttaagttaatacaggttcccctaaaggcaaatataactgactcattaggaaatcagttgggaaaacaatattttgcaattgtggccccaccccttcatttctccagagctcatgatagcacacatgctctatctctgttggctatatttttagctttcccacattattttgcaatattcctttccagactaaaaaattaacaaaactccacactgaagcaacaaatcactatcttacacaataattcactaaaataggaccttaaggtattttgcctttcttcaaactcagactgaaagcttttctggtcacgatttttcaaggttatacttttataacaaaaccagatgcaaagattttacctaatcagattttacaataatgcccccatttccctccctccctccctccctcccttcctttcttccttccttccttcttttcttttcttcctttgtttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcctttccttccttcctcccttcctttccttcctccctcccttcctcttcctctgtctctgtctctgtctctctctctctctcttctttctcagacagggtgtcactctgttgcccaggctagagtagagtggcactatcataactcattgcagcctcaaactcctgtgctcgaatgatcctcccatctcagcctcccaagtagctgggactacaggtgggcatcatgaagcctggctaatttttttattttattattttttttaaagacagggtcttgctatgctgcccaagttggtttcaaacaatcctgcctgagcctcccaaaatgctgggttttgctttcctgacaccggtatctcctggttcaaataatcctgcctgagcctccccaagtgcagggattacacgtgtgagccaccatccagccccaatttctttctttcttttttaaaattaggttcttcctaattacttctgaatgacagtgaatgacttaggctcttaatttgcctttgaatccaggtattcagggtgacaagaccaacatttgcctggtctagtttgataaatgactctgtctaaaatggtgtcattaagtacgtgccttgacaggatttgaagtttttttctaattcaagatgctaattacagctttcttgtccagttaatattcagctaaaaagtacacatgtcaggcaggtcagtttcagatacccatgaggttaatctagaagcaaactaaagtgaccatcaaagtataatattttcagtacattttggatttttaaaaatgtatttgttttgctgagacacttctttgtgactgaatcatcagacttaagagctggcttttgattgtagatctcctagagtcagcccagacagactcaacagcaggtatagattccagggctgtctacaagaggccacagtgccaggacaaatcatgctgggcgttccttggagacgctcatgtacaaatgaaataatgtttcaaagaacatcaaggccatcctccagaggaacaagaaatgacaaaaggacaatgtacagattgagggtcttggcagaaaatcaaagtggctgtccctactgctttgatttgatgacaatgtggtaagaacattcgagtagcaggatttgtttttaacaactgagtgatttcctgggtgccaaagctctgggtcagtgtaatgtcctaatttattcaatcctgaaaaccactctgaatgtgaggtttctagaaatggcatataagtcttatttagtcactctttgttagttgctgatatctgattaaacaacacaaattaactagctgtttgaatgtgttatgaatgtctatgtctcccagaagacacacatttcttgtctgatttttcttactatgtggaagttagcatcttattcaatttattagccaatcaaaatcatctgtattttctactaaaatcaatccccttttgaattcatctcatgccattaaataagtaaccaggggaaattcttcttctttgttcactcaaggtttaagaaatttggccagatgaaatagtataaatcttttatgaaaaataacatattcctgttaattcatctaaacttagttgaaatttaaaatatgttagatatttttctggactagtttcataggtgtgtgatctatatagtcacatgggaccttatttaattcttaatattatttggaaaagaggccatgcgtttttttgtttttttgtttttttttcctgggccctgcaaattatgaagccagccttgtttgcttccagtatttaaatagtaccggtgtttgcacaaataagtctaagaacaaaaaccacttgaatgtattatctgatttgacaagaaaagagataaacgtttgtccttaaggaaggtgatcccaagatcagaaacttaaataaggttttaaatcctgtattttggcttccctgacaccagtatctcctggttctctgtattcactgtctctctctctcatgcttctcttccttcatcacttatatgtcagagaatctcagggctatcttctctcaatttacctttattcctgagtgtcatttgctcttgtggttccaatccttctcataaatttatgatttccaaatttataacccaggtccatacctctcctttgagccatgaactcatgtaccagacgcctccacttgcaagtttggaaactcaatatcatcttccgtgacatcttcctgaaacctcttgattactgatggggatacagcagtcaaatgaagtctctatacacatagagattatgttttagaagagggaaaagataaccagcactctgtgtgtgtgtatgtgtgagagagagagagatgagaaagtgaaaagtgctctgaagaaaagcaaggtgagagaatgaagaaatatgtgaaagtgtatttctaatagcatttatctgcattactttttatctcagtgaatattatgaccatcttccctttggcccaaacactaataaacctgggagttattgtagcctcccttctcttcattatcatcattgttattattttaaagttgaggtctcaccctgttacccaggctgaagtcactaggattatttttaatgagtttcctgaaggatctcctgcctctagtattataccaatgtgtctgtcattctccccactcaggaagtgctctttcctaaaagtaaatctgatcatttctgtcctctgaaaacactttaatatcttccactcatcctacagataaaatctacgctcctagccatggctgacgaaatcttcatttttctgtgtgtgtgtgtgttttgttgttaattattacttattaccttctccagcctcatccattatcactgcaaatccacaccttcactggtgcttcatctatgaggaacatttttcagcttctcaacactgtcttgttgtctctcatttctgagctgtcacatctttctccttctccacctaactcttagacttctttagtgtcaacatcactttcttctgaaagccttctctgagtcccccaagttaatttcagttagtgttttttgtatgtgcatgctatagcaccctgttcctcatttcagttttagcatttattcaccttaatttgtactgcatcttcaattgcctacattttactgggcgtgaactccataaaggcagaccctacatatatcttgcttatgtttatctctctagcattagcttagtgcctagcatagggcagctgagtactgaatgcgtgtgtgcttttttaatgtgtgtttcactctgaattccttctgaatctaaatgacattatgtatatgttaatgtagtaatatataaataacaatgataatggctattggacacatcatttttttttctaggaagaatagtggaatgattcaattatttcagattgcatttcagctttggagactgcatttattttgcaaaagctacttgtgttagtcccaaaattaatctgcctagcctggaggcaggtacctgctatgctgtctggagaagtcacatgaaaatagtcaagatatttttttccttcaaggagtgttttcttatgaaaccaatgcctctctctccctctccacgaagcggaaattaattttataactggtattcttgaaagtctgtataaatggaaggcactattttaaagtagggtttcatctgagtgcatgtgattaaaactactcttcatctagaaattagaaacatggcagatagcaaatttggattttcttatacatctacttaaacttaatttctccaaaaaagctatgagtcatttatttttgtggaatcctttttttattgtatcacaaagcctaaatttaaaaaatgttgcatatgagtttaatatcattaacatttaaactgttcttgattaaagtatgttaaaatgtctttgttttgcaagatgcattaattagaataaggatccaaacatcaagctaaagcattctctaatttgaagagattattttaagaaaatgatgaacaaagtccagcatcattggaacatatttgcctgatatattttatgcacttattccacttatgtttataataactattcggtatgtttgggcttttgttcaggttgcttttagagcaacctgaaaaaaaaaattgtaatatttactagaattttgtttaaagtgaagtagctatattattaagtgtatgtttctaatcatgacctcaatttttaaagaatcttgtgtttaaagatttaataattgaggatataaaaatgatatcctgaagagttcctgaaatatttgaagcattaaagtaatgtttgatataaatgagcacctgttgaagttctatagtattcaattggaagaataatatcttctacacttacctcaaattcttttttatgataaagttggatataaaacctaaaacaactattctagtttacaacatctagtcatgacagataattgtcaaactgtgttttagtttactacagcatgtctttatggccaaatgacttctgggagtgttgtcctctgaagttgagcttcctactcacaactctgctcaagacagaaagaaagcatattagtcctgttccaaatgagccccattcttagcaagtgctgctgtaatttaatttaggtttgggccttcacttgcaggaaatagacatgatgttaattaacagaacaatgcttgtggaaaagctttatgatactacttgattaaccacattccttttgatgttcatttttggaaaataattgtttatgtctcctgacacagtagataagatggcatgcatggctggtgtttgtaggtgtccaaagggattgtctttagactgatgtggcttttaggcaattctttttatgtaacctagcaatcttggtgcctaactcctacttctggttgactttacatatgaaaagaggggaaatttgtaaacttctgagaaattagaagtaactcaggtaaacattgaatactatctagaattcagaagaaataactgctacttttaattgaaattttaatttgcttttggtccattaattctgcggtttatcagcacaatacttttataattcttacatatcaatcatgagtaaaattgtgctttagttatttaattttcttccaaacagtaatcaattcacctttttttctccttaagagagtattcttctcacagaatgtagaaatataaaaaagaaaggtaaacttttctgtaatcccattaccattataaacattttggatttattatgatctctctttctttctttatgtatttatggagatagatggataagatatacttaatatgacagtcataagctatattttgttttacacctaaataatgtacattttaagaatatgcatagttgaaatacatttatttgttaaaataatgaggtatatctattaattctaacttggaaaaatatattcttagatttttttaaagcaaattattgtatatttgacttttgattaaaataataaaaataaacacaatatgtgtgtgactgggtctatgtaggcccacactgttgagaataattacctctgaggaagtcaggagcatgggtggtgggatctgaaatgttttactagatataattctgtactattacaatgcattataataggaatatattattttatgagtatggaaatgttaacatccatccttatgtcataaatataggtctagataattattttatttttatttttatttttttttgaaacagggtctgcctctgtcacccaggccggagtgcagtggtgcaatctcagctcactgttaacttgtaccacacaggctcaagtgatcctcacacctcagccttccaagtagctgggaccacaggcatgcgctaccatgcctggctaatttttgtatttttagtagaaatggggttttaccatgttgctctggctagtctcaaactcctgggctcaagtgatctacccatcttggcctcccaaagtgctgggattacaggcatgagccactacactcaccctgtataattttaatagtgttatttatttatagaaacacaacataaattgcttaaccttgttgagaaacattaaggctgctgcattttcaagtaatataagccatgttgtcatgcacacatctgtaaatgcatccatgtacatttttccttttttgttccatggaataagtttctcaagtcaaactacaatgtcccaactggtgtttgacatgcattttcagactgttctccccagtgatattaccacctttttctagcacctaatcatagctgctagcacatcattattcatctgtgtctggtgagcaaattatggtttctctcacctagaaatgttatggattctctctcacctctagatgaggaaagtaaatttttatcatcaagagaggacatagaatgaaagctgtcttccataatctttgtttcataatgcacattgtattatgttaatatgagggacactgaactctaaaatagatgcctaaatcatattgtttaggcacacagctatatatcacagtaatttctattatctaaacctcatggtttagatagaaaaaacccacaatctttggaatttaatagcctgggtttagattttaggtgtgcccattactcagtgctttgagccttggctccttggcatgtattgtttatatcatgagattgttaaagaaaattaagttaaataatatcttaaagtgcctactgcagtgccatgtggtaggtattatagaaagtaaccttgtggctaaataacttctttgtgaaatatttactatttttctgatttaaaaaaagacagattatcatttaggatatatagttaaaaactgacctaagaggctaaaattatagctgatatgcttattattgctctgatttttttatatctgtactaaacttcatgcttttaacttttggttaagggtattccttctggtttggttaatttcaaaagtataagaaaataaaagtaaactttaatcttctaccttgcatgatggatatgtgtaatatctttgtactgttttccttggaaaaaaaagtagatacaaatgcccaagtatacagtatgttgaattttgctcaccatttgacataaatgaaagtatctttgtagtaatttttctttcaaaatgcaatagaatgtgtatattcattgggtagcctttaagaggtcagaaagaaaagacactaaaggatatacaattgcagaagagggaagtggaggagtttagagtcaggaatgcagaggaagagaagaaatattatctgatgctgtgaaccctggaaatacagaagtctactcaatagttaagagccctttgctgagcttcattggacatactcaggtgctatgatagctatttgagtaaatgtatgctttataggagtctcttctcctggattctcaaatctagcccacaagataaactcaaggttaagattaaacaaattatgagtatctttttgagtttctttctaaataaatgtatatacttgtttgttccaaataacgaggaaagaatattttatgctatagcctgtcaacctaagtaacagtgagagaggccctctaaaagaaaaggtatttatttgaaaataaagcattgtaatgggaatatgcacgtcaaagtaaactatgcacatagttagggaggtaaaggaagacagaggttttcaaagagaaaaagcaggaagattatataattcttctgaaataattacctttggctacagagaccaataacaaggttatcgccagtccgaggttagacaggcagttgctgggcaaatgcccttgtagaaatatgtttttgtgtaaggttctgatggcctttgtgcaagattgtggattttgtatttttttgttatcagacatacaagaatggtaaccttctctttacagtgttctctggttctgccagggctttttgtttgttcattttttaacattagtgactcatttgattttgacacctttcacaagtctatcgttactgccttgttttttctgaaatgtcttttttgttttttctagtgatgattcttatgcttttaaaaacatttctaacatcctcctgttgcttatttatctgtggagttgctgttcattctggttttcctctgagtccttgcccatacgtcaccaccctgtcttaccttggctgcagctgttgctagtcatcagatgaagcaggtgaaggttatcaaactgttatttttcctgagtaaagtgtcatcacctcacctactgctctttgtcttctttgaattaatttcctaaatggcatacgattcagtgcaaaaaaattgttgttgtaatgaaagtcttttatgtcctggttggtgatttataattggtttcatcaagtataaaactcagaagtataaatgtcaagagttaactgatacagcttaattggtcatttccaattttgatgtcagtctattgacctaccggctaaaagggcattgtagagtattagttggcatttgtttttggagtcctttatgatttctttcttattagtgttcacagcagtgtaccattaaagtttttggcttcagtacacattctgattattcctgaacctgcatagtcacaataggaagggtagtgttgattcaaacaaaattcagatccatgtatttttggcaggtatagtgtgttcttctgcaccaactcacatattccattttgtgcctttacaaaactataggaatagtttagtgattgcctaaaattttcctagtaaattgaatgtttttctacaaaaatgtcttaaaaatcagaagataatatattcagtaaatttattttatgtacctattatattgtctagtactttaatatgtataattatttatggtttgattttatacacatctcattttccttaaatgtatattccaacttatatggagataaaagtaatgatatcactttgccttgaagaaactaaactctaagactgttatcatttgattctttcattttgagctgtctaaaattttataaaattagttaagagcaaaaagaagcatattagttatctttcttttttttcttttttcattaaaaatttttattcagtgcaacgggttgtataacttttatagacaaaaagtacaaatagctagtgtggtttgatttaaatttctatttgaattaaacatttgaatactttttcacttgcaatttatccttttagacaaatttctggaaccttcatttaaatgaacacagatgtaagaaataaagcggttatggaagcccagttctggactcattattaacccatttatgcctgaggttgcaattttttgaatttttattttgttttattttatttttatttattattattttttattattattatactttaagttttagggtacatgtgcacaatatgcaggtttgttacatatgtatacatgtgccatgttggtgtgctgcatccattaacttgtcatttacattaggtatatctcctaatgctatccctcccccctccccccaccccacaacagtccctgttgtgtgatgttccccttcctgtgtccatgtgttctcattgttcaattcccacctatgattgagaacatgcggtgtttggtttttttgtccttgcgatagtttgctgagaatgatggtttccagcttcatccatgtccctacaaaggacatgaactcatcattttttatggctgcatagtattccatgatgtatatgtgccacattttcttaatcccgtctatcattgttggacatttgggttggttccaagtctttgctattgtgaatagtgtcgcaataaacatacgtgtgcatgtgtgtttatagttatctttcttttaaagtacaggataatttgtcttcaaacatagctggatccaggtgcccaaagaaagtccttatcaacaggttcctcttctcccacttcctctcttttctctactggcttcattctcagagggagatataaaggtggcatcaaggtttataatccaccagtctgggaccccacaagaaagaaagtacctctttcctaatggcttcctcaaaaagcttgggtttaactaatgagctgagcttgtttcacttggccatgcctgaagcaatagctgtgacaaggcctgaaatatatgtttatacctggagctaggagattaaagcaggaaatggactgaagtggaagaggattctgctgcagtaagaagagatgttgagaaggcagaacaacagttcccactgaagatgccactgagttactaggaccatactcctggtcttctgagttccatattctactctttgagtctttcacatggatcagttctaagatgaagtaagaataaacttaaataaatcctttaatgtttatcctctaaaaggacaagaatattttaatagcctgaaagcagatgttgggaatctcagaaaatgaataaagtataatcttgaaaaaaactagtgaaacttctggtttgatctcttccctaatgccaccattcctctcaacttttgattctttagcttttttccactccttttattttttgaagctattgatgttgctagaaaaatctttgaagcaaagactactctctaacattaatagataggaactactccagatgaaattaagtacccttctattaccctgcatatggcattgcattaaaattttggtttacttgtttgtcccactcacatactgtaagtactccaaagaactaaatcatctttgatttccaagttttattgcccaaccacataattgtatttgttgtcagtaacacattaataacataagtgttgttgaatgaccaaatcaaactgtaatgcacttacagacacaggaaacaacacaatgagaaagtgtatgttcatatggggcagggatattcaagagaactaagaatgagcaagcagaggcatttcctcatggcaataaaacaataattagttaaagcaatatattttcaaaataggaaacatttatgttaattaaaatagtgaagagggccaggtgctgtggctcatgcctgtaatcccagcactttgggaggccgaggcgggcggatcacgaggtgaggagatcgagaccatcctggctaacatggtgaaaccccatctctactaaaaacacaaaaaattagccaggcaaggtggcacgcgcctatagtctcagctactcgggaggctcaggcaggagaatcgcttgaacccgggaggaggaggttgcagtgagccgagatcgtgccattgcactccagcctggcaacagagcaagactttgtctcaaaaaaaaaaaaaaaggaaaaaaaaaactagtgaagagatggaaggtcttcaagttaaggatctgaggtacactataaatatgagtgtagaaatcaattcttatttaaaaaacaaaaccaaaaactctgtcccatctaaattgatattatcagttgttaacatacttgagattttcagttaagttgttttataattatgacatatttaaaaagctttataattcatacttttataaatttatctaactttattcttacaacaactctgtgaggtagcttaccatattacttaaaggtgaggaaaatgaagctaagaaagataacatgacttcccattgccactaagaaattaaaaagctaaaactctaaatctcatattctttctatgaaaattgtactttttcaaaattttatgacaagttgctactacaattattgtagagtaatgagcacaagatagaaagctaaacacaataagaacataaaaagtcataaaagatgcatattgatatgttttgtttgcatatgtattgtttcatttttttcagaatatctctctaactttttaagtctttttcaaatcatgcttacagatggcctttgctataatttaatttttaggttatcagtttttattggcatttggaattaatacttacgtgaatatttgaactcatggacctaaatttctagtgtatttttggtttgcatacacctaggtcccaaatttagaaaaaaatcacagtctgttaacaccgtaaaaatctattttaattcatcatattgaaaaaggtaaatataaacaacattgatgaatataaatttttaaatgcaagtacctaatctgagctgcaaatatcaagataattggatgtattggagaccagctggaagtgcaaagaatacttccccttggtattgactcttctctaaatcaatagcggttccaaatgtagtaaaaagcggacaagatttaacaggttctaaattattaaggccagtgcattgttgctagagagttcattaacaatctcatcaatacaatgtggttcatggacattagtaagagctttgtgtaacattttaaaacagaatgagatatctcaatggactgatcttagtaaaaaaaatttaattaggtaagaataattacattagttaaatggaacttttaattgaaaacttgttggcattttcttacctgcttcacagctgtcctttaatcatttatatttaaaaagtgaagagtttctgtacatgatgtttgaaaattatctaaacatcttggactttttgtataaacgtttaaaggagtttagataatgtggcagtaaaaacaaataggattttctgcttgcggaatggtacatttaaaagatatatatatcagaaagaaaagttatagagaaaatatgtatggtaagtatatactattcttgggaaaaaggcaaagtagtcattttctgaagctttaacatttataactttaaaacttcatgtattgaacatcattccttatgaagctttaaaatcttacagggaaataatactgtttataaaattatcttgttaaagaaaatggtatccaacaagagtttttgaaagaatgaaagcccgtatttgtgtaagataaacataaagggccaatggaaactcttattgttaaaattagtgtcagccacattttaggctgtatttactggttgttgttcaaaataagctaattggcaatcactattttttggtagctttcagcttaagccagagagcactggtttggagagacatagacatttattcaaattcacaggaacactaaacaaatggatttgttaattattcatgacattaattctggccaagacagtttcttatctgaatctcagcaaccactatcactcagtgctgcctactttacttgatcttcagaacattgctgaatttgaatattcttcctaattcatcaatttgtctcttcctttcagccctcatgggtactcaatgacacacatgtagagacaaaaatctttatatatatatgtgtgtatatatatgtatatatatgtgtgtgagatatatatatacacacacacacattactgtatagtttatttataataaactataaattcatttagaaacaagacagaggctgtactcacattccccgccccggtctgagctgctgacagatttggctcattgtatttctaggaggtaatacattctagctgtatggcaaagtgtgaagatacagatttcttcatatatatatggaaacaatatatatatgtgtgtatatggaaattatatatgtgtatatatatggaatatagatatatatatatggagagagagagagagagatgtggtcttactttgccacccaggctggagtgcagtggcactatcttggctcactaaaaattcatatatttttaaaggtatttcatcatgcagtttctgaaattttctttaatgcatttaatttgtaataaaatctctctggtagttcaaaaacataagtcataagcagatttgtgttttcactgtgtaagaggaggcaaaaggaggtaaaatgctgtaatattggagaatgactttgggtaggaaagaaagaattttagttttcttcttcgaagaatgaggaggccaggctgagatttaatgtacatgagaagtttaacagcaatgaaggtgaaacaacaaagaaaagaccataatataaatattggcaggttttatttgttcaggcagtaatttgctaggatatgaacacagtcaatggcctaagaataattacttttgattacccttattaatttgtatgaaatgttcatacaatagtttgttaagcaagcacacaacattataaagaattatggagagagacagacatatgtagaatgtaaagagtaaataattatgcagagaagacagacaaataagggttatggttatattacaaaaccggtataaaatcagagtaaaatgtggattttctagtaatatgaatgttagccacaggatgccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatattttaccactcatctttattcttgaattctaaatttgtcagtaacttatatgtactcaattttttattttttggcattctgagttcaactgaattgtagcgtcatgtacataacacattgtgtagggatcaggttattatatgttaatttcctccatgctcctttgccatctagaacctgatctgctgttttaaacagcatgaggcctgttctcccatttaggctaacagtgggtgcagaagggttgaagcattatactttctaaactggttccttgttctggagagtatccatctgaagagattaccgctcttctggtgatcatcgccatcatcgtccaacacctgcctatgcaccatgtgccaggaattgtgcgaactgctttaatgtattatctcatgcagtctgtgtagtccacgcagctgctggtaaagaactctgtttcagagtaatacaaagagccagcaacagagaaagcataatggcagctgcagtgtaactgggagaattgtctctgacaattggctcccgactgggtctgagggcatttcttcatcagtccctcagttcagctagcagccaccgcacacctgctctgtgctgggcagagtgctcagtgcagtgtgccagctgaatgagtgagcaccagcctgttctccatgtgtgaccccctccttcttgctcagaggggtgggcgattgtctgtcccatttaggcttgtgctgactgtgcaagggagatcccaaggtcaggatctacctctttgcccatcactgttaatatctgtattatctaactaaagaactaacatttgtattttttttcctgaaactatctgatttttaaagtaatttttcaagcaagaaaatctttagatcatcatatttaattttcaatgataaaatgaggaaacaaggcaatagggatttttttttattattttctttagtaaaaaggtcaagtcagtgaaagatccagaattcataaacttctattctatttattagaccatgcagctctttctgctatgcactgtacctcaaatgggaattcagaaatgagcaaaatctgagatgtaggagttccagaatggatctgccacctgccagctagcattcggatctcaaaggggacctgcctgcacttacttaatggaaagataaatgtgttcaaggaactgttactataaattcatttagaaacgggacagaggctttactcacattcctctccagtctgagctgctgacagatttggttcactgtacctctggggggtaatacattctagctaaatggcaaagtgtgattgttattcagagctcccaaatacctatttcttttattgtttaaatgaactttatggttgaattcatccatttattgaaaagtacttttatacacttactacaggcaaggcagtgtatggaatactatgtgaggtattaaaaagatagacattgttcttatccaaaagatgattgtgttataaaaggaaaaacaaaaggcaagaaaaatataaacagttttattaaaactagaatgtaaaaggaagaaagaagatacaaattagtgatgtttaatttgctaggattctagatagttctagaataaaatgaaatcaatggaccatcttccaagaaaaatggtgaatcactctttaacttctaatagatgtatgagagtaaaatgtacacattataaactacacatatttaaattactcttaagagtaattatatttagatataaattattgcattcaacattgaaagcatttgtagcccaggccacgagtgctaataaacaacaagtcttgagcaaagagtgaaatattatcacaaatataaccgtgcttggtacaacagacagaataacctggaaaatactaggttctaagttctcccagtcaaaattcaatggaggtatccaaaagtcattccaaaagaatgacttctcaccagaagaaaaaaataaacatttttgatggatttttgctgagaaaaatttttagtacatctgagaaatttgatatactaacgttctgttctgtatttgtacatagtttggaattgtttgtttctattgtcttcatacttttttcaaagaaaagctatgttttaatttttgtgtaactcttgaagcacctattttagacctttacaaaggaaatgtataatgtgataggaatcagaaacagaaataacatatgcattaaacctggacattggtagcttggtaattactgcttagtatcagattattttgtaaatgaaatctaagcacatataaatattttaactattcatagaatctattatttctgttttttatatttggagatattttaattatatatataagatcaaaatattaatgtcaatttttatttgaaactttttagaacatctaatttcttaaattcttcaattatttaaaaatatgtagtgaatttttccaaagtataaggaaaatgtaagcatacatagattttactgttttttttaataccttaaagactcatcagtcatgaggttagttgatggatggaatagtactgagtgactaagcctatttctgtggcaatggctcagccatagaaattagcatttgtcactcttctgcctgtttgtctgttacacattccattcttaaaagtaatttgactaggtataagatacaccaagcaataagctagtaagaaggttaatgaatatttaaatatatttgcagacatttcttatgttcttttcaagccagccatttggaaagatcactatagttttactaaaatgtgtaggacaatattgcacaattttaaaggtttgcaaaacaaaacaagtttttggctgaaaaacattttttgtaggttaactaacttattttggaaataaaaatagcttcaatctagtctgaagtaagctctgaaaggcagcccacattccagttgacaggcgtctgaactagcagtgaagcaggtagggctgcatttagctgtcacattagccctgtctggctggtacctacctaatttgagcttctttctgctgcactataccctcagagggaacagatattctcttctagctttccattaagtgtggcccatatatatgggggtatgtgtgtgtatgtataatatataatgtatataatccatatgcatatatacacatatataattatgcttggagagataaatctctctctctatatatatataaaattgtagttgaaagagagaaaatagaacagattatcttatcttcattattgatttactcccaacccctgcttagcttttgtcttgcctttgtagtttaggatgtaaatgaccacagatttatctaactatctcatatggattttaataaccaaattgtactgatatttttagtttacttggttaaattagagttatgttgaaccctgaagcattctttagaggtagctataatgtataagaaaaagacaagatttgacttagggactacaataacttttattggaatcccagctcagagatgtattctccatggtccgtggaaccatactagcctggtattcgtaagacaccccctaaactgtgagatcttctcccactagtttcccctcctttgcccatcatagtttcagtgggaatatggcctaggggaggcagggattataattgtttagacagtgattctaagggttaggatttgcccgaatcttatttctgccaatctttcatgagacctcgaaataattactttaaccttcctatcttcagtttcctgctctcaaaaatgtttgtagtaatatcatttagaacatacggtctttgtgagaattaaatgagataatgcatgtaaagaaatcagcacagttctgtggcacagagttaaggactcaatataacttgaattaaaataattattgttttgtaataataatattataaaaatgataatataatttaacctgtgtttcccctccacttctctcttcctctgttccacccctctcttcttttctcctgttttcttccattaagaaaagagtcaaggcaaggaattatagagtcaataagagaggatgaagatttagcaaaagcagataaatcaatctctaaatttgggtgtaagagacgcctcttaggccccagcgtgaaagatacactagggcctttgccctttgaaaacctcccgagcagcaactggatagaagcaaactagaatgttgaagagggctttaaaaagtgttatattgctaggggttataagaatgtcctttgacactcatgaaataaagactaaaattgctgctttttaaacttattttgtcctctgaactaatgtttgcatcctgctcagttcaggatttgttagaattatatgattctataatttctttttgtaatctaatttgtatttgtttattttgtttttttctatttactttatatgttattttttcagttatctttttctaggcattgttgggcctctatgtaattccatacttatattttatacaatcatttataggtacttctttcttatccttatagtgatcagatttcactaataattggtcacaatcagtgacattatgaacctctgaaaggagtgtggtggctccttccaggacaacgactggaaatgtgggttcctaacttgaccattcctgtccatacttgatgatttaaattatttgttttacctcaatgttccttgggacaaataatgtttaagcttgataacctttgatttgtagagatatgtatttgggggtatactatcaatttagtgttgcctacaagagtgcttaatatttttagaaaattctattcaccagtcaccataatgtgttctggctcctgtagtagatacatacatatacacatatgcatacatacacacatacccctctggtatatacatacatacatatacatacatacattatgtatatgtgtgcgtgcatgatatatgtttgtatatgtgtgtatgtatatttaccttttctgtttctaaatttttaaatattttaataatatagtttcctggatttatgctatcttatccttcatatgttcagaaatctatttttttcatgaaattgttcctagttaatattagtaactttttaacccacctattattgaaccatattcatacattagtttttttttttctaaaataaacaacagaaatttatttctcacaattctggaggttgaaagtctgagatcaaagtgccagtatgggttctgatgaaagccctctcctaggttttggacacccaacttctcgttccatcttcctatgacagaaagagggctagagagttctctggagtcccctttattttattttattgattcttaatgtatgtacatatttatggagtacatgtgatcatttgttacatccatagcatttgtaatgatcaagtcaggctatttaggatattcactacttctagcatgatcgagtcacggtatttgggatattcactatgtctagcatttactatttctctgtgatggaaacattgcaatcctctcttctagctattttaaaatatacaataaattgttgttaactctagttaccctactctgctatcaaatattagaacttatttcttctatctaactgtaagtttgtaaacattaaccaacttctcctcgtctgtccttctcatactcaggttcccttccaagttttcagtagctatcattctcctctctacttccatgagaccaacctttccatagcccctacacaggagtgagaacatgtgatcttactttctgcgcctcacttatttcacttaccataatgacctccaattccatccatgttgctgcaaatgacatgatttcatttctttttcatggtcaaatgatgttctattgtgtatatatcctacattttctttacctattcatgtgctgatgaacacttaggttgattccatattttggctattgcaaatagtgttaaataaacataggagtgcatgtatccctttgatatactgatttcctttcctttggatacatacccagtagtgagattgctagatcacatggtagttctatttttagtttattgagtgagcaccatgctattttccataatggctgtactaatttacattcccagtgatatggtttagctttgtgtccccactcaaatctctttttttttttttttttttgagatggagtctcactgtcgcccaggctggagtgcagtggtgcgatctcagctcactgcaagctccgcctcccgggttcacaccattctcctgcctcagcttcctgagtaggtgggactacaggcacccgccaccatgcccggctaattttttttgtatttttagtagagatggggtttcactgtgttagccaggatggtctcgatctcctgaccttgtgatccacccgcctcggcctctcaaagtgctgggattacaggcgtgaggcagtgcacccggcctcaaatctcattttgaattttaattcccacatgacaaaggagggacctagtgggagataattagatcatggggatggtttcacccatgttgttctcatgatagtgagggagttctcatgagatctgatgattttcaaagtgacagtttcccatttgcatgctctctctctctctcttgccaccatgtaagacatatcttgcttcccctttgccttctgccatgattgtaagtttcctgaggcctctccagtcatgcggaactgtgagtcaattaaatctcttttgtttctaaattacccagtctcaggtagtgtccttatagcagtgtgaaaaatggactaataaagagaattggtactgaaagtggggtaatgctataaagataacctgaaaatgtgaaagtgactttggaactgggtaacaggcaaaggttgtaacagtttggagagcttcaaagtacacaggaaagtggggaaaagtttggaacttcctagagacttgttgaatggctttgaccaaaatgttgatagtgatgtggacaatgaagtacaggttgaggtggtctcagatgcagatgaagaacttgctgggaactggagtataggtctgtcttgctaggctttagcaaagagactgcttgcattttgcccctgccctctgtggaactttgaacttgagatagattatttagggtatctggtgggaaaaaatgtctaagcagcaaaacattcaagatgtaacctggcttattctgaaagcattcagttatatacattcacaaatagatggtttgaaattggatcttatgtttaaaaatggaagcagagcataaaggtttgggaaatttgcaacttgaccatgtggtagaaaagaaaaacccgtcttctggggaggaattcaagccagctgcagaaatttgcataagtaacgaggagcggaatgttactagccaagaaaatggggaaaatgtctctaaggcatatcagagaccttcacagcagctccttccatcacaggcccagaggcctaggagggaaaaattggcttcatgggccaggcccagggccctgctactctatgcagctttgggacttggtgccctatgtccagctactccagttccagctccagcagtggctaaaagcagccaaggtacagctcgggctgttgctgggaacatttacccaatgcctgtacctgcattgtatcttggaagtaactaacatgcttatgattttacaggcttattggcggaagggacttgccttgtctcagaggagactttggacttggatttttaggttaatgctggaatgagttaagactttgagggactgtggggaaggcatgattggttttgaaaggtgaaaagtacatgagatttgtgagggaccaggattggaatgttatggcttggctctgtgttcccacccaaatctcatctcaaattgtaatcaccatgtttcaagggagagacctggtgggaggtgattggatcacggtgttctcatgatagtgagggaattctcatgagatctgatggttttataagtggcagttttccctgctatccctctctctctctcctgctaccatgtaagacatacctttcttcccctttgccttctgccatgattttaagtttcctgaggcctctctagccatgcagaactgattcaattaaacctcttttgtttataaattacccagtctcaggtagtatctttatagcagtgtgaaaacagactaatacactcagcagcagtgtataagagttcctttttctccatgtttttggtttgcatttgttattgtctttttgtttaagaactattcaaactcgggttagatgatatttcattgtggttttgacttgcatttccctgatgattagtgataatgagtgttttttatatatctgttgtctgtttttatgtctttttagagaaatgtctgttcacatcctctgcccactttttaatgggattttttatttatttattttttttactgttgagttgtttgagcttcttttatattctgaatattgatcccatgtgagacaaatagcttgcaaatattttctaccattcaacaggttatctcttcactctgttggttgtttgctttgctgtgcagaatctttttatgtcccatatggctttttgtgtcccatatgtctattttttgttaattgcctatgcttttgggtccttagccatagagtatttgcctagaccaatgtcctagagtgttagtctgtgtttccttctagtagttttatactttcagaacttatatttaagactttaattcattttgcaatattttttgtatatgatgagagataggagtctagtttcattcttttgcctatgggtatccagtttttttcagtaccatttattgaagaacctattctgtttccgacgtatattcttggctccttttcaaaaatcagtagactataaatatatggatttatttctggattgcccattttgtttcattggtctatgtgtctgtttttataccaataccatgctgttttagttattatagccttgtaacacattttaaggtcaggtattgtgatgccttcagctttttttctttttgctcaggattgctttggttattcaggctgttttggttccatatgaattttagaagttttttttcttttctatttctgtgaagaatgtcatgatatattggtggtaattgtgttgaatctgtagattgttttgggtagtatggccatttttacaacattaatccttcctatacatgagcatggtcttttcatctgcctgtgtcctcttcaatttctttaatcaattttttgtaggtttcattgtagagttcctcatctccttagttaaatttattcctaaggttttttactttttgttggtagtgtaaatgagattaccttcttgatagtttggctgattagttatttgtgtataaaaacatggctgatttttgtttgttgattttgtgttctacaactttactgaatttgccaaatagagtttttggtggagtctttaggttttttaaaacataagatcatgtcacctgcaaaagggacaatttgactttttttttttccagtttcagtgtcctttctttctgttgtctgattgctctgagtaggactttcagtactttgttgaataggagttgtaaaagtgggcatcattgtctggttcaagtttttagaggaaaggatttcagctttttcccatacattatgttatttgtaggtgtgtcatatatggcctgtgttatactgaggcatgttccttttatgcttagtctgttgagtttatattatgaaggaatgttgaattttatcaaatgtttttctgtgtctgttgagatcacatgatttttaccctttattctattggtgtgatgtattacatttattgttttatgcaggttgaaccatccttgagctcctggaataaattccacttgatcatgttgtagtaccttttggatgttctgttgaatttagcttgctactgttttgttgaggatttttacatctatgttcaccagggatgtttgcctgtgaacatagatacaaaacatagatgttcaccagttgttgttgctgttgtgtccttgtctgcttttggtatcataatactgacctcataaaatgagttaggaagaattatctcctcttgctttttaacaggtagtttgagtagaattggtattaattattttttaaaagttaggtagaatatggcagtgaagtcatctgatactgggcttttctttggtggaagccattttattattgattcaattttgttactcttattagcctgttcagtttttctacttctttctaattcaatgttggtagtaggttgtatgtgtctaaaaatttatccatttcctataaatttttgagtttgttagtacatagtttttcataacagtcttttaggatttttttgtatttcagtgttatctattgtaatgtccattttttaccttctgattttgtttatttgggtctttcatcttttttttcttagtttaactagaagtttgtcaattttttttaaagacttttcatttcaataatcctttgtattattttttaagtctctatttcatttatttcagttctgatctttattatttttttcttctactaatactaggtttgatttgttcttacttttctagttcttgaggtgcatcattaggttatttaaaatctttatattttcttgatgtagatacatattgctataaacttccctcttaacactgcttttcctgtatccggtgtgttttgatgtgttgtgtttccatttttatttgtttcaagaaacttttagattttctgcttaatttactccatgacctaatggtcattcaagagtatgctgtttagtgtccatatatttgtagagtttcaaaaattcttcttgttattgatttctatttttttgtttattgtggtctgataagatatttgacttttgcaccttttcaacttttaaaagtttgttgaaacattttgtggccttacattgtttttcctggactgttttgtgtgctgatgagaagaatgtatattctgcagttgttggatgaaaggttctgtaaatgtctgttaagtccctttggctaaactgcagttttaatctgatgtttgttgattttctacctagatgagctgttaaatgttgagagtggatattaaagtccttaactatttctgtattgtagtctgtctgtctctttagatcaaataaaatttgttttatatatttaggtgccctgctgatgggtgcataaatatttagaaatgtcctcttgctgaattgatccctttgtcattatataatgacctggtttgtctctttgtactgttttttgacttaaagtttgttttatttgatataagtatagctattccagctcacttttggctttcatttgcatagaatatctttttttcattcctttactttctgtctatatgtgtctttacgagtgagatgaatttctttctttttttttattattatactttaagttttagggtacatgtgcacaatgtgcaggttagttacatatgtatacatgtgccatgctggtgtgctgcacccattaactcgtcatttagcattaggtatatctcctaatgctatccctcccccctgcccccaccccacaatagtacccagagtgtgatgttccccttcctctgtccatgtgttctcattgttcaattcccatctatgagtgagaacatgcagtgtttggttttttgtccttgcaatagtttactgagagtgatgatttccaatttcatccatgtccctacaaaggacatgaactcatcatttttttatggctgcatagtattccatggtgtatatgtgccacattttcttaatcgggtctatcattgttggacatttgggttggatccaagtctttgctattgtgaatagtgctgcaataaacatacatgtgcatgtgtctttatagcagcatgatttatagtcctttgggcatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgactgtttaatgattgccattctaactggtgtgagatggtatctcattgtgattttgatttgcatatctctgatggccagtgatgatgagctttttttcatgtgtcttttgctgcataaatgtctttttttgagaagtgtgtgttcatatccttcgcccactttttgatggggttgtttttttcttgtcaatttgtttgagttcattgtagattctggatattagccctttgtcagatgagtaggttgcgaaaattttctcccattttgtaggttgcctgttcactctgatagtagtttcttttgctgtgcagaagctgtttagtttaattagatcccatttgtcaattttggcttttgttgccattgcttttggtgttttagacctgaagtccttgcccatgcctatgtcctgaatggcaatgcctagattttcttttgggtttttatggtttcaggtctaacatttaagtctttaatccatcttgaattaatttttgtataaggtgtaaggaagggatccagtttcagctttctacatatggctagccaattttcccagcaccatttattaaatagggaatcctttccccattgcttgtttttctcaggtttgtcaaagatcagatagttgtagatacatggcgttatttctgagggctctgttctgttccattgatctgtatctctgttttggtaccagtaccatgctgttttggttactgtagacttgtagtatagtttgaagtcaggtaatgtgatgcctccagctttgttcttttggcttaggattgacttggcgatgcgggctcttttttggtgccgtatgaactttaaagtagttttttccaattctgtgaagaaagtcattggtagattgatgggaatggcattgaatctataaattaccttgggcattatggccattttcatgatattgattcttcctacccatgagcatggaatgttcttccatttatttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtttgttattggtgtataagaatgcttgtgatttttgtacattgattttgtatgctgagactttgctgaagttgcttaacagcttaaggagatatcgggctgagacaatggggttttctagatatacaatcatgtcatctgcaaacaaggacaatttgacttcctcttttcctaattgaataccctttatttccttctcctgcctaattgccctggccagaccttccaacactatattgaataggagtggtgagagagggcatccctgtcttgtgccagttttcaaagggaatgcttccagtttttgcccattcagtatgatattggctgtgggtttgtcatagatagctcttaatattttgagatacgtcacatcaattcctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgcgggcctcataaaatgagttagggaggattccctctttttctattgattggaatagtttcagaaggaatggtaccagttcctccttttacctctggtagaattcggctgtgaatccatctggtcctggactctttttggttggtaagctattgattattgccacaatttcagctcctgttattggtctattcagagattcaacttcttcctggtttagtcttgggagggtgtatatgtcgaggaatttatccatttcttctagattttctagtttatttgcatagaggtgtttgtagtattctctgatggtagtttgtatttctgtgggatcggtggtgatatcccttttatcattttttattgcgtctatttgattcttctctctttttttctttattagtcttgctagcagtctatcaattttgttgatcctttcaaaaaaccagctcctggattcattaatttgttgaagggttttttgtgtgtctatttccttcagttctgctctgattttagttgtttcttgccttctgctagcttttgaatgtgtttgctcttgcttttctggttcttttaattgtgatgttagggtgtcaattttggatctttcctgctttctcttgtgggcatttagtgctataaatttccctctacacactgctttgaatgtgtcccagcgattctggtatgttgtgtttttgttctcattggtgtcaaagaagatctttatttctgccttcatttcgttatgtacccagtagtcattcaggagcaggttgttcagtttccatgtagttgtgcggttttgagtgagtttcttaatcctgagttctagtttgattgcactgtggtctgagagacagtttgttataatttctttttttttacatttgctgaggagagctttacttcccagtatgtggtcaattttggaataggtgtggtgtggtgctgaaaaaatgtatattctgttgatttggggtggagagttctgtagatggctattaggtccgcttggtgcagagctgagttcaattcctgggtatccttgttaactttctgtctcgttgatctgtctaatgttgacagtgtggtgttaaagtctcccattattattgtgtgggagtctaagtctctttttaggtcactcaggacttgctttatgaatctgggtgctcctgtattgggtgcatatatatttaggatagttatctcttcttgttgaattgatccctttaccattatgtaatggccttctttgtctcttttgatctttgttggtttaaagtctgttttatcagagactaggattgcaacccctgcctttttttgttttccatttgcttggtcgatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgatagctggttattttgctcattagttgatgcagtttcttcctagtctcgatggtctttacgttttggcatgattttgcagtggctggtcctggttgttcctttgcatgtttagtgcttccttcaggagctcttttagagcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgccgttaacattttttccttcatttcaactttggtaaatctgacaattatgtgtcttggagttgctcttctcgaggagtatctttgtggtgttctctgtatttcctgaatctgaatgttggcctgccttgctaggttggggaagttctcctggataatatcctgcagagttttttccaacttggttccattctccccgtctctttcaggtacaccaatcagatgtagatttggtcttttcacatagtcccatatttcttggaggctttgttcatttctttttattcttttttctctaaacttcccttctcgcttcatttcattcatttcatcttccatcactgataccctttcttccagttgatcgcatcggctcctgaggcttctgcattcttcacgcagttctcgagccttggctttcacctccgtcagctcctttaagcacttctctgtattgtttattctatttatacattcgtctaaatttttttcaaagttttcaactgctttgcctttggtttgaatttcctcctgtagctcggagtagtttgatcatctgaagccttcttctctcaacttgtcaacgtcattctccatccagctttgttctgttgctggtgaggaactgcgttcctttggaggaggagaggtgctctgctttttagagtttccagtttttctgctctgttttttccccatctttgtggtattatctacttttggtctttgatgatggtgatgtacagatgggttttggtgtggatgtcctttctgtttgttagttttccttctaacagacaggaccctcagctgcaggtctgttggagtttgctagaggaccactccagaccctgtttgcctgggtatcagcagcagtgtctgcagaactgcagattttcttgtaccgcgaatgctgctgtctgatcgttcctctggaagttttgtctcagaggagtatctcgccatgtgaggtgtcagtctgcccctactggggggtgcctcccagttaggctgctcgggggtcaggggtcagggacccagttgaggaggcagtctgcccgttctcagatctccagctgcctgctgggagaaccactgctctcttcaaagctgtcagacagggacattgaagtctgcagaggttactgctgtctttttgtttgtctgtgccctgcccccagaggtggagcctacagaggcaggcagacctccttgagctgtggtgggctccacccagttcaagcttcctggctgctttgtttacctaagtgagcctgggcaatggtgggcgcccctctcccagcctccctgccgcgttgcagtttgatctcagacttctgtgctagcaatcagcgagactccatgggcgtaggaccctccgagccaggtgcaggatataatctcctggtgcgccatttcctaagcccgtcagaaaagcgcagtattcgggtgggagtgacctggttttccaggtgctgtctgtcacccctttccttgaccaggaaagggaactccctgaccccttgcgcttcctgagtgaggcaatgcctcgccctgcttcggctcgcgcacagtgcactgcactgctgttctgtgcccactgtctggcactccctagtgagatgaacccggtacctcagatggaaatgcagaaatcacccctcttctgcgtcgctcacgctgggagctgtagaccggagctgttcctattcggtcatcttggcttctccccgagatgaatttcttgtaggcagtatatagttgggtcattaaaaaaatccattcagctagtcatatctttcaaatgaacaccttattgtgtttatatcaaaggttattattctttaattgtttttgtttgttttgtatatcgtttgttcccttctttctctcttattgtttatcattgcggtttagtggttttctgtagtggttccagaatttgtttggttcttttatatgatgtctatctctttatggaacttttcattaatatcctgatttttttttctttgtattgtttttctgtgttctctgtgtctcattgagcttctttgctataattattttgaatcttttttcaggcatttcatagatctatttttcactgaatattttgctgaataattattgtgctcctttagaggtgtcatacttcctggattttttatttcttgtgtccttttctgtccttatgttgatatctacacattttgtgtaatagttgcttgtttcaatttttttttttttttttgagacggagtctcactttgtcacccagtctggaatgcagtggcgccatcttggctgactgcaacttctgcctcccgggttcaagccattctcctgccttagcctcacaagtagctggaattacaggcccacagctaccatgacccactaacttttgtatttttagtagagaccaggtttcatcatgttgtttaggctggcctcaaactcctgacttcaggtgatccatccacctcggcctcccaaagtgttggaattacagatgtgagccaccatacccggccagcttttttcaatttttttggatggattttcataagggaaaatttttcctatggatttatctatggtattggttgagggggcactttcgctttgattatagggttagcagtagcatagtcctcatatgatttttacagcatcagtggtgtctgtgatttccgtttcttagactgtgattattagtggagactgtgttgaaattttactgggtgtaggagtgccaggtagttcagtcctgaggcccagtggtgttatcagtgggctaagtgtgcctgtctttaggctcctgtgtggcatacaagggcacgtgtgttagtgggctcaggtgggccaattgttgggcctccaggaagcttgcttcggttcagtagtggcagcagtgggcatgtgtgtggtgaattcctgggcccctaagcagtatgcatggcatgagaaatagcagtagtgatggtgggaccacccttggactctcaggcatcacatactggtgtttgcagtgcctgcaacaggctggatggaccagccctcaggagaagtgcacggacaccagcagtggtgaacaaggcagggctgttctcaggtccctgggtggcatgcttgggtacttgggggatagtgccaggggtgtgggcctgcccttagtgtcccctgatgggtgcatgggaataggctgtggtgaataggacagggcaatctccatgccccaggtataacaatgtatttcttttttacaaatatgcatttaccagttttctataatctctaccttttcttattttgcagtgcattttcattatgtatttatgaaaaaattatatagagatttatgcattcaagtgcttgttgacatttgttacattgtgtaactacaaaaccaccttcactactttgcttattaaccatagagtgttgagtgagaaacccagagaaaaggatataaactttggacagattatatggattaaatccagctctacgtctatatgctatggtttgttttttgagttacttagctgctgtctgccttggtttcctatttgacacatacttgatgggattgcacctgaataatggttatggaaattaaaggaattaatttaaggagagtgcctcacacacagatattgaatgaatgttggctattaatattattaatagaagacagattttcacatatttgtgagaataagagaaggcacatttttgtgagcattcttgtgagaataagagaaaccacatttctgaagcactagaattttcacacggtttttcaaaggaaggagatttatagacacacaattttacaaagaagacaatagtttaatctgacaagatattaaatataaatagaaaaatctacataatatcaccaaaacaactagtctaaaattaaaaccaaaaagtaccccaaactggagaaaatatcatagaaagtatttcagaagttctgtttattgatttataagtaaagatattttaaactgggaaatccagaagtagtttgatcagcgacttttagattacttgtacctttttctcaaggatttatattttattgttacagacagtagtctcaccattttgcccagactgggctcaaacttcagggctcaagtgatcctcttaccttacccttccaagtagctgggctacagatgtgtgccactgtgcccagctatatttatcttatagtttaataatattatctaatttttataattgtacttaaaataacagatttcaaagagttttattagcaactactgtgtcctgatcttgaaactgaaactatataccagaaaagattttttgatttttaattaggcaaaattattttctagcattgtcatattaaataaggttactactctaggatttttatgtatgtcctgttagattatctatatgtcagtaagtcatgaaaagcaattttcatgaaaacttggaattagaaatattatagattgtattcttttagttattttttccataatagatcaacatttttatcttggcaataactgctatagtttttgtaatcttcctcatacattacgtgttaatcttaaaaactgtggaaaatatgaaataaaaattttactcatgattaattcacaagagttaaacattattattttattgtgttttcttgtttttgttgtttatatagtatgtagtggtggccaaaagcattcctgaacagggagggtgggcttccccacttgttagctgtgtgatttcaattagttcttcacttttcccaaccttggttttgttatttataaaatgttaacaatagattttttattatactattattcagagaataaagtaaatatattaattacccatatataagtatacatgcatgtgtattttagatattctatttaatttataaatatatattgctttataaggtaatacttcatattactctataaatatatattatctgtacatatatttataaagtaaatatatattatgctgtatttccataataaaccattatatatttttttttatgtatatattacatataatagtttatattatatataaaataatggttatatattaataatggttttatatattatatattatatattacatactatatataatatatgaaaccattatatattatatataaaaccattatttatacatttatatatataaaatgatttatgctggaaatgcagttctgtataatctaaatctaatttaacacaacaccatttaagatgtatttaatttccatctagttgagtatttttcaaaacatgattttttagtgcttatataagaaaacatcgtgaatttatttagaaatttccctattttggtcattcagtagatttccactctttttttttttttttctaaaaacaaaacaatggatatgtagccttcattcttagctccgattttcttaatgctaattccagaaagaggaattactgggttaaaataaacataaatatttttaaggctctcttacgttttgtgctgcaaaattaccctttctgttgacagttatatattttaaaacactcaaaatgtatcttcccaattctgttgatgatttttgtgactacctgtgtaatatatgtaatatgtcctctgaatattaactcgggtcagagacaaatatcagtcaaatcctcaggctcaggatgtatgcctcaatgaacactactagttttcactatgcatccttcagggtatgtgaaaatagtcagtagaatttataaaatgaaggtttggaatctgagttattttcccaagagatttatgaactataaaataatattattatgttctcttattgcattgtgctctttagccatcttccattttatgtggtatagctccttaggatccatttggttgaaagctactgtgtatactcattttgtattgtattgtggcaaatgctgtaatctacagggttcctattcatttcacagctcactaattgtgtgaatgagaagaggaaatatatgcttttattctaaagcatgccaagcagatggccaaagttcattactaggagcattgtcagtgtggctgtcttttctaggtagtaagcctggcatcgatctgtcaaacacagagtgagggtccatttaacacagcacttgaaaatcactgagcctctgttttgttatgacttataaacattttatttttttatcatcaacctccaaagtggttggtcatttgagcaggtgcaaacacagtagaattcatatttgttttacctgagaagccaaatgaacttttattcatatggaaatcttggggaaaggaaaccgtacaagagattaagcttagtttcttgaaaagcgggtaatacagctattgagattcaaaactaccatcatttctgagattgaaacttttgaaaatttaagttgaagaaaaagatcagggtttatatctttttaaagctaaaagattaaaacaatgaaagaatttaaggttttaagtaagtctcccttaaaatcttggtttcttcctataaaaggaaactgtttacttacttttatatagaatatgtaatttatgtgaccattaaaaatgttagcaatgtactcattgtgtgtgtgtgtgtgtgtgtgtgtgtgtataagtgagacagagtaagaatcagagatagtgacaaaaaggaaataaagcctgtcttcatacatgtcctacttcaacggcagtactaggactatatgtaattgggttatttcaggaaaaggagggtaggtcaaattttcttatggagctgatgtagtaatttgatcataatgtcttgtttaagagaacgagagcatgttagagataacgttttcttctttatacaaagaaaaatgggatatatatttcccttacctcttccctcttcctccttgcaaaccatctaccacaagttctacaagttatattgactataaatttccctttcccttgcttttcagactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggtaagttaggagaagaacatctgccttgtctcttttgttgtcaagctgaatgaagtgagattattgtggtttttctagcaagtgtccttttactttatgtttaatttaaattttctctcttactccaaataagcaaaattaacatttttactaaataataccaaatgaaaggtgaggggaaacaaaatatctatcaaagtatctatgagggttagcatttacctttctgaatctttattacttttcctttatgtagagatatagattaataaaggaatgtttatattttaggcaacaaaatataaaatgcatttttaacataaatgtcatttgcactacagcaaaattatacctaatttgtgaggcttcaagtatagttattcagattaattgttcctaaatatgtctagttatttaaattatatttacaattaacaaaaatagaatgtatggattaatcaaagtgcaaaatttactccatgttatataatgcaaccattcttatgaccatatatcatttctgactatgtctgttatagatcaagaatattcatagtgagaaaaagtttttgaagatcatacatacatacatatatacatgcatatatatacaaatatgtatacgtatatatttttcctgtcaaaaaagaaagtcctttgttaacttagaatacttttcatagatgaaagtttaactgtgccttaatctttgcaatgaaatatcacaggtattattaccatatgaaattttttattaatggcttaaaataaatcatcagttcatcttgtaataaattattcatcatgaaaataaaagtgcaaataggatcataattaagtatctctgaatatccatgaattttctttgtctaattcttatcaaactctcaggtagatgaattaatagtttcgaagaatatgcagtttattagttgccccatattctaacatttacttctggtttaaaactgaaacttagtgagctgtagacacagtccacaggtctggcgagatgaagaattgatttttctgaactcagcactagattattgaaacaatgacgtgtcaagcagccctaaaagaagcagttgtatgacattccccattgtatttattgtagggtgtaattgagaatcttgtccactaaatcacacagtgtcccccttatgaggaccaacaggagaaatttctctcaggtctcagtgccaggaaaagctctttctcctgagcagctggtatgtcttaaattatagaccctgtatattgtgtttttatcatattttcttctttgttttggttgctaggaagttcagaattgaatttgtgataaaattacttgtgcaatttcacctggtatacatttctttatgctctctctaccccagatttgttcttctgttttacacttctattcttgtacttcttgatctttttgtttacttttatactattgtccattttggttagtcacttgaaagtttttctttggaagccattaggctaaaaatatttttttcttccttattccaaaccagtgaacacatgtttaactttagcaaagacatgttgcaatatgtttatgaatatgtattaaactttttctatttcatttgtaatttattagctgaaaactaagaatcttgcacataagtatccaaatatcatatggagcctcagaaatttagtaatattaatttcaaatccttattgaaatattacccttaatctactgatatttacttcttttgggtcttggttatattattttaaacattttagttgtgagtatacattttataattgaaaatttctgtatttaactactttttcctaagctatttccaaatgacaaacaatggaaaacatctaattgtggttctataaccaacagaatgggaaaactttttacgttaaaaaagtccagatatttactcaccttttagggttgaacatattatacagctagattattatattcccatctcctccatgaagtatatcttgatatgaagtaattataatacatttcccttgcccttacttagtggaaagctagggggaatgtatataattgagttagtataacatagcttttcctggattcagtttctcttattgtaataagttccttttcatgttattatgaatttagtagtgggattttataacagtagttctaactgtatttgccagtgagatatttaatatctcatacaccataaaaagtaactaaattcttctcactttagttaaagaggtacactacttaaaacataataatacaatgtctcctagacagaaaattgtaactggaaaatgcattgtataaaatgaaaaatttatagtaaattttctgctgaaactaggataatttatgtagaaaaacatttttcaaatttcagaagaaaattaaaatattttaaaaatctctagcaatgtaaactgaaaagtaatgaatataagtttcctacttttgtgaaaaaatgtttattccatctttcttcacttatttattatcaatgtttttctattcccataggcacattgggaaggcctcacaggcagaataactttcaacaaaaccaatggcttgagaacagattttgatttggatgtgatcagtctgaaggaagaaggtctagaaaaggtatttcagtgagcttatttgctttaattactaaatgaaacatatctcaaagaagacaaatattctctgttgtagtcacatttcattgacatttaactttattgagtaactctaaaaataaatagttaattcattatattgaatataataattgacaattaggattcaaggataaagggtatcttaagacaattttatattttattttctaactagagatttttctgatgcatataatgtttgaagtgcatataatgttaattagtcttaaggtttaatatagcaattagaaaatatttggtttaatatgggtctttatacatgcagcttataatcacttatggttgcatagactttccaacttggagcaggccattaagaaattaaatataaaagtatgtttctattttttgagtcatatttaagtgaaatatttgaattcatgtatgcacagtaactagggtatatacataaatgtaacataccacactggatctatcttacttgattttattgctagggattgtggtaaaacacccaaagaatgtgggtatgtgcctacttaatgaatattttagtgtgagttttcttaaatacataatgtatgtatttagatatttttctgatagattcattgataattgacaagagatattaaatctttttatatgttatttagatgttattaaatcttattagatcttattaaaataagaacttgagaaaaattatatgtgactgagataatattgctttgaagatagtaagctatcttatatttcacccagcaatgaaacatgcagctttatttctagacagaaactgaagaggaaagctgagacctacgaagggctttcttagtctggaagataacagcatatttgaatgctgattcaaaccatccaggacagagtaaaattgcatttttgatagtgtccccaagacagttttaaatacattatgaccaactgatgactcaaactgatagagctgttacctcctgccactgaggatttcaaactgtacactttgtgaagaccaagcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcgaaatcactaggaggaatttggaccattgctgacatttcaatacatctgcataaaatggcagtgctcttcatattaccatagatccattcctgtcttgaattcaaaataaatgaaacattacaaaattttctctgtgctccattgtggcttacagatacgcctgaatataatggttatcaagtacatatgatgatctatcacactgataagcaaggtaaaccagtgtgagttgttcaggttgctctgagatttcataaatattttatattattttctaaaatctgaaaattcattttgctgaattaattatgttcagtccttatcctcaaggggcttttcatgtacagtgataagataatacatatttgtaaataaatacaatcaaaagctatatgtttcaagctttcaaaagaccaataaaaatataatttctgataaaagatataattaatcaagagtcatagtcaattgagtacttagaattagcctttgaatatgttgaattattgattgttagaaaatcagtcattttagaaggaagtagaagtatggggaaacacaaacatagcgtttgattttatcattacacacatacacatacaaataaagctaaaatgctagattttagtcataacatagataccatgtccaagatatttgcagggtattagaacacaatgtgagtttaaagaaagaatagccctgaaggctatgggttacttgggaagataatatagtttagaataattttagtatgaggccatgaatttaaaaccattctaataggaagtggagatgagtaaacagtttgtgacagaaggcattaactgaaccatcagcaatgttgttagttcaaagactagcaaagcatttggactatgtttttaaggagaaatggaggagccaggtaggaaaagggagataccagggataaaagcataactcaaatattggaaaatgaattagcaagtaggggaattactagtagaaataaactggcataaaccttcccctgaaaagacagataaggtaccgaggatgggtggaggtaagttaaagagaaagggagcaaaaagttcacatcacatgttttcaatatccttgaaaatttgtacatgaactcatcagctaaaggacagcggtaaagtttagtcggttcttaagaaaaattgaaaattccattttgacagacttgattttgacttagaaggaacaaaatgctgctaagtagcaaaaagtcctcattttaaatttagtagaatagtttacagctcaaggtctagattcagagatattttggctcaaattctcactctgccctttactttttgtggacaaatttattaatctctctaaaacacagcgtcttacactgaatcatgaggcaacagcagttatctgcctcatgatgactgagtgttattgacttgactttttttctgcctagaaagtatagttaccaacccatagatggaaaagacagcatccctaccctgatggaattcacagtttagaagggccaatagatggtgatccaagaggcttgaatttcagttccaattctatcaaaactaagcatgtgaacttcatcctgccaccgaacttctctgtgccaaattcatcaccttaaaaaaaaaaaaaagtgcagggcaaagggctgccctcttggacagtctgaagtgagaatactatggcctctaaaagaacccggaagtaccatcttgaaataaattgatgctagaaattttaatcgttaaaatttaacaattatgttctatcatgactgagagacaaaaataaagaaggaaaacatgtaaagtgctaggtttatccctcttctcatgcctattgccttttcttcattctcattctgtcttggtcatcttagaccagcacacttcatttagtaggttaatcttctaacaaatatggaaggaatgtctgttttatgccctcatgaaggttataatctaatagaggaaacctgccaataataaatagactcattagacttataaaattataagattgggcagtaataagtgctgaaaagaaggtcattttgtttttatgtcactgacatgatagattttacataatgttcggaaacatgaacttcaggatgaaaacagttaacaggaaggaagtctatgcttctgttgtttacaactgtggagcagataaaccaggaagaaaccagtatgcttctgatgaatgggaaaaggtgggccatgctcaagtgtctgagcctggagtggagatgggcatcctttctacttagatggtgtccatagatcaaatgaattctttctactctattataacagaagccttaattggaacccagcccaattcactgtggtcccaaaaagatcaccgatactgtatacacagccagccacttctgtgcaaacaagctctctgggaccatggcagtgccttcaatggaggaggggagggcaagaagggggaaagacagtaggtactattacagactttgcctagttcaggcaatacttttgcttatgagaggctggtattgagcactcaggaacaggaaaaggaaaacagaataagtgattttccaagcttgaattcttctggtcagttcaaggatcatatagtgtattctactttcaaaatatgtttagaatccattcatctctcaccacatccgttgctgaatcataaccatagtacctttcaactgtacaactacattggaattcccacaagcctctctcttcaattctgttataatccattccctaaaccacagcagccaggcagatatttttaaaaggaaattgacccctgtcatccctctgtttaaatgctttcatagattctcattgtgttttgaataaaatccaaagcaccagtgacctctcatcatgtcatcatgttctcagatattttcttctgccctacctacagagggtttttttttttttctcatttcctcaagaaaacaaagttttcttatcactttggcatagagtaatagaaacagttttcccagccaggaatatccattcccagttcctttgcctggggaactcttactcatcctggtagtatcatcttaaatattacttccttagataggcctcctctaagtctctaatcaagtttaaatttctcctaatgctctgccctttttaatttctgactctatcaaagtacacaattatttattcacgtgaactttataaaagggctatctccctagccagagtgcaagacctactagatggaaaatatatgctcccttttccactactatatattaaggctttgcaaagtatcctttgtcttgaggacaaagtatgtactcaagaaatatttgttgactgttgaatgaataaagaatctttatggaaattatgagatacttcacacagaacgcttactcaagtgtctgatgcagagttattttcctgtagcacagtttgttgcttttcctagctttgctctatacctccaacatgaggacagggaaagacaatagtcaagggatcagtgggttggggtcatgggtcaatgtttcaagtgggtaaaggattttagattgcagaaggtcaccctgaagtcggaaattgtaaggatccacattgcttcagtggtaaatctggccccattcatggcacaattaaaaactctctgaccttccagtattacattaaacagtaaaactcaacattctatttataaatgttccttttttgtccttacaagttacagtatggaaataaacaaagctcacccaaatgagaacaagtggaagttactattcagaacttactacaggaagggagacagccttcatcacttgcattaaacagggattcaaaggcaagcaggggagtggaaaagtttcatagtggaaagaaatgaagacctcaggtgtgctgtgattggagattgctggcatgaggaaactggagttggtctaacaaagcagggcacctagataatgggttttggggggcacatttgactttctctggctggttctgatttggagggtggcaaaaaattgggaaactggaagtaataggatgaatcctgattgttttgggtagattgcctgctgagattgtgtttggcttcctgaggtgctcactccagagcttctgggtcatagtttgtcatcacacatggtttggtcattgtctatttgtgtattcagtctgtgagtggaattactgaagtaatttggagggagaagaatagcaaaaataaaaagaagcaggaaaaatttacttgtgaggaaatataaaaacatcatcaccaacaataaaattgtttttttggtttgttttgtttttgttgtttagaatgtgtaaccaggatgtaacttattgttggaagtggtttatccttattgttccatcacctgaagcttagctatgtgcttaggaaagaccagctctagagggaagaaaacacaaaactgatggcataagatgttacagaaatattcaggaagatcttagactgtaacttcaaaaggatatcatttacagcaaaaagagttggaagagttccacacaaaatgggtttagactgagttgatgacattatataaaatagtgcaatttcattgcaagatgagctacctagaagccatttttgggaaaacaaccacttaaatttagaaaagaatttcctataggaaactgtaatgcaataataaaatccctgaatcttaactcatgattgaattttcttttaaactctcctatgtgaccacaaagtacttcgtgtgttttccaagagaaaaaagtcagtcttttactgttacactttcctggttattcaaaataatttttattgtactacagaatatttgtttctaagtacaggtgtaaattaaaattattcttgtgtacttctcttatcctttttctagcatcaaattttgccaatctgattactttgtggatattctcctgtgtgatatttaaatgaaaatagacattggagaatagaattccctatctcctcagcagataggctctaataaaccattattaaaattggctttatgtattaatattatattaactttgaaaaatagaaaggataaaactgataaatttctttggacagaaatagtgctgagggaccttgaagcatttgggactataaaaaacaatcacaatgtgtttgccccagcgtaggtttgtaataaaatcagatttagtttgtgtatcctttgggaaaatcttaaaaaaaaatacagaaagacattttatgaaatatatgtttgtcaatttctatagttaataatataaatataaaaataatttgtaaatgtcttataaatagtatttataaataatataaagcaatatattgcacatttacacacctctaaaaggtttaaatttgtcatattttactttcatgtgaagcttcattttaacttttaacacttatgctttttaaatatttactgcttgcatccaccagtatagagactagtattaatccacagactttttgctaaaactcaactatcttgataatatatgaggaggataagaattgatagtgaaaccctgcctgcctgagtttacaggcttatgtgttctagaattagaacatgtttcaaagtgctttttgaatattttttgtaaagtatgtattttgaagaaaaagtggttatttctacagaaatctttactattgacctttcttttacttgttgactcctgccctcattaaacttcatatgaaaaaggtgcctgaatggaatttaaattttctgaacttatctaaatctgaaaatctacctcagataggtgaaatttacattaattatagatttctagaaccggatgcacggcagtttttatcttcctctctttggtggcatttgatacatatacccagtgcccatggcaacagtgacccccaacttgtccaggaactgagatttatcttgccttcctctacgaaagcaattttaatggtgatgttaactcgtaaactttaaattagtcaaaaagtgatgtttgcttctctaaaaacaaaaatacttcctgggcaggatccaagcctattgcctttctttggagatgttagccatttaatttgtctaactcttatatagaattcattataaaccctgtctcagaactgtaccgacatttttgtgtgtcagtgtgtatagttattattttgtttggcaactttacactttcaggacgataaaatatttcagaaaactatttatgaatgatgtttatgtttagaaatcaatcagattgccttatttgaggtcacagaatttattgttttggttcccaaaaagtcttattttggcccaccaatgaatattaaatattggcttttttcttttaaccactaaatttgaattaacatatatatatgtataaattacaattatgatatatataacataattgtaattgattgatttgatttcaaatcaaatcaaatctgacctacatttttatctgtggaaaaatggcttttaactgaatggtatcgtattttcatatttgggaacatgtaattcattaattcaaacattatttaaaaaatcaaaatcacaacctgtctgttaactctttaattgtgcttagcattaaattgccctaaactaaaataaaaatcttaaatgagaaaaatcagtgtttagttagattattaattcctttccatgagatgattatatacttactgatttattgtactcatattagcactatagttctcgaatggtaaaatccgagatcctatgcacactagttgagagtttcaggacgctgattacgaaagcgttctttgccctatccttataggccaattaacttatatctgaaggtcagccaatttccagacaattgctctggactcaaattctagctggcaggaagcacataggctttgctgtaaaatatttctttttgttttctagagctcaggtgccaatgcttaagtgctctcttttcaacacttagttcaatggaagtaaacagttattaaacttcggtgtcaagggttattagacggtaatgcaactaactatctctacttttcatttaactattcatcatttgaaggagtgaagtaaggaaaacaaaagtctctaatttcccactaatagtgagaaaactaatctgttgaaaaaaatttctgtacccaatattcatgcattgtattggcttgagaaacccaggttttcagaaataataggtatatgagttaatagagaaataaacagtccactagtgtatattcagtcaattgcaggaaacatctttcatacgtaaatcagcatttaatataaatctctttcttatgctttctatttctcaattccctcaaacagtactatcggggtgccaacttttttccaagggaagtagtcaatatacttcaaggaaaactatactttgtaggtcatatggttgggggcaactcattactggaaagaaatttctttaagcaaacatattctaagatggagagtctgcattgtgctaagactgttggaaacccatgtacagtgtggtttctcattatcatcacacaggatctctgtggaaaactatggcttatattctttattcaaggctgacacattctcctgacattaagtcaaaacaatgtacaatcaaataactttcttttttacatttttacattgttgtctaatggaaaactatattgcttctttttccatctaccaacatccagtgaatattttgtgagtcaatgccagtaagaaagtataaagagaattttgatagatttgtatcaggtattttttagtggagaatttaaattatttcttaatttaaaataaatttaactttatttggaactaatatttttaaaactaactgggaatgtttattttgttcctacttgaaaaatttcttgtatacatatcaagcaaattatttccataaatttcatagaaaataagaaatgtgtgacattgatccggtgtacacaaaacagagctaacatgcatctttagaagaaaagatgctactttcagaggttaacaattatatagcccaatagaggaaatagaaacattttttggatttaaagtagtaatatgagttacaaaacaaaatttgtactgagaaaactgtcaccaaaaataaacaaataaacaataaagaagcaactaattaataagataaataatttaaaaattattctgaaaactgttgttttctacctagaaaaaaatacacagaaaccaaagagaaaatatacttataaaacaaaattatatgaataatttacacattcctgaaaaacaaaacctatagtgtaaaatatttatttaaaatacttataaaatataattaggaaaaaatggaaattcatagtaaaggtatgtggcataatatttcaaacattaaatatgatattgagatagatcttaaaacattaagaataacacaaaaaacatgaagataaaatatggaaaacaaaatatgtaattataaaagaatagacacatatgtatgttcaacatttgccaaatgaatgaatgatattggaaagtcaaccaaaaaagtctgaaagtttttatcatggagtaattcactcacttactctatttatttattcaataaatattcattggatatttattatataatttaaagattgatgaaatgtttcgttttgtgaaggcacttagagtttaacacagcaggatcaataaaaatgaaatataatttggattcaaagcaatacataagtggcatttctgagatgaggaaaataaaacatttatttctgttcaataaatattattatttatgttcaataaataaaacgtttattggttatataaccagtatgttcagagatctcacatataaagcccgtaggatgtcctatattcaaaggccttggggtaaaaagatgagtatgccaaagtctccatccgtagggaattagtttttactagacagagataagtaaacagttaaaatataatatgatacttattgtagtaagtaaaagcataactaaattgctgtgtatggaagcgtaataaacgatcatccattactgcacagaggaggaattgttttacctatattttgaaacagtaattaagatacatgcataaggtagtgaaaagggaaagagtacaccttctatagaagacatgaggacacaaataattgagaactacaagatgcaacaaagtctatgttcagaaaatggagaaatgcattatatttctgacaatttaagaaaagaaccattgtttctctctctttctactcagtctttaggtaacatattttgcaaaaagttcatatatacatgatatacacatccgtatataacatatacataaatgctatgtatgcatatacataaatgtactatatatagagatacatgcatacatctacatagacatatgtaaacatccacatatacacacacacacacacacatatacacacacatatgtacttgttgagatttaatatttccaaatgataatactgaagactttcaagaaaaaatattcaccaatagcaaaatacatatgaggtagctctcagtctttttgagcaacattaatactagagaaaaatgaataaaacttagctctgaaggaagacggctctgatataataggtcttcatttagctaagttttctttatataagaaggcagcaaaaatacctttaagtctgcaaccataaaagtatgtcacataattatcttttataataaattatcttgtgtaagtacaatgataagtgaaaagcaaatactcagaagaaactgtggctagatatcctagtaaacatcaaattcagttaagcacaaaaaaagatagttttgaataatgactttacaaattatatcaaaattacaaccttttccttgtagcaaaataattcataatacacaaagcaaaataaagagaggcagtgtttacaaccccacattaaattaactaaaaccggctgggcacggtggctcatgcttgtaatttcaccactttgggaggccaaggcaggcagatcacctgaggtcaggagttcaagaccagcctggccaatatggtgaaacccatcttttctaaaaatataaaaattagctgggcatggtagtgggtgcctgtaatcccagctacttgggaggctgaggtggggagaattgcttgaacccaggaagtagaggttgcagtgagccgacattgtgccagtgcactccagcttgaaggacaaagcaagctccatctcaaaaaaaaaaaaaaatgttaactaaaactgtgaatcagtatgtgtggcagcagaatgggacaaagcatagataattttcgtagagtagatatttcaatttttatggctgaatattcgtttttcagcatgatagtaatatttcaaacagaagctgataatacacattagtagacttaaatgtattttatctcccaattaccataggaaaatttccaggagtagaaagtaaataataaacaccaaacaatgtgaaaggagcaaggctaaataaagataagattcagtaagagaaaaagttaggacattgaaaaaatctactaaggcactaattataaaaaaatccaacaaaatgagaaatatgttgaaagtgaaaatatatataatgatttatcagcaaatgcaaagaaacaaataatggaggtaaagtaagtgtgattaataatatatattgagagtttacgtaaaacaaagtaattgaaataaaaacagttatttttatcaataacaccatctacagttaaaagacttgacaattataaacctttataatataatctgatgttattcaaactattaaaagctaaattgttatacagttgtcttatggaaactaccatgaactgtaaagggaaagataacaagtagagaaattattttggaaagttatttggcaacatatagtaataatcttaacaactcagattatctgtgctcagtcattctaattctagaaatctgtttttaaaatgataaaatgtgtgaacaaatatttataaataaatgtgtttactaaggccttgtaacaatgatagttgaatcacgatatgttcatatgatcattttgtgtagtcattataattatggatttgattatctttggtgccaggagaaaatgctcacaatagtgtataaacagaatataattagtaattgtcataattatagcatacttataaacacactatgttgaatactttttcatttaatcacactatgttgaatactttttcatttaatcttcactatagtttatgaagtagatactattatttcccatttacagatgggagaattgtgacacaaagaaataatgtacccgagtcacctgatgttaagtggtggacataggatcctggcagtcaaatacgctgtccataaaagctgggccattaacaacaaggctatgatggaaactgtgcaaggaatgtgtgtggaaagacaaatgacaggaaaaaataggaccacaatattaaccatgattgactctgggtgtattcataggatcaaagtttaaattgatcttcttcttatatcttctgcatattttataatctcatgacaattaatatgcattctttttctgaccacaagaagaaatcaaagagccaatcagaacataaaataaaaatgaataaaatcataattttctatagctccttatgacttttgaagcactttcatatttcttgtatctaattgaatccttataattagaatggccctataatttattacacaaatcatgatattttttatttgtacaagagggtattattaatgaaaacagtacctgggcaaaccaggatgtagagtcaccatatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgttttttgccattaaaacaaaacaaaacctctggtgacaatttcctcaatggaagaaagttttgaatcatgtagttgacaatctaggaatatctaaaattttatttgacttaaaatattaaagccactgatatttctgaaatgtcataatattacgctaagaaagctgagatttacaaaagaggataactaatacttgtgaatataggaaattgtagattcatgtaatattcatctgtgtcagaactccaaaaaaactagaaaagcaactaaccaataatgaaactagagaagtattttcagatggtaagttgagtgaacatttagctaaattatttttataaaagtaataatggagggtggcattatgtgaaatgggaaattctttgtattagttacttggttagaaagttgaaaactttctaaggttttattagatagacgacagtgaacaaatgatgtttgtcagtggtttcactggtagcattacacatctgaaaatcttagctattttgccaatttatattaaaaaaaaaagtaaaatctaagggaacaaatgcatgataggtattaattatggaccaggtatagaaaagtgacagtcattcactgcaaaatactatctgcagatgtgtcttgtttagccaagagtatttgcaaatgattttaaatttgaaacactttggccgggcacagtggctcacgcctgtaatcccagcactttgggaggccaaggcaggcggaccatgaggtcaagagatcgagaccaaactggccaacatggtgaaactaaaaatacaaatacaaaatactaaaaatacaaaaattagccgagcgtgttggcgggcgcctgcagtcccagctactcgggaggctgaggcaggagaattgcttgaacccgggaggcagaggttgcagtgagcagagattgcaccattgcacttcagcctggtgacagagcaagactccatctcaaaaatagataaataaataaattaattaatttttaaaaaattaaatagtttaagcaggtcaacaggcattctagttttgacacccctccatccttccctacccaggtccccagcaggccctctactagccctggtggtgccttaccggaaactcaactaaagcacctgctctgggaacatgcagccccaaggcacacagctgttggaaaagcaggattgggattgtggcccctcctttctactgtgtcttgacattttgtgagatttaaaaattgcacatacttgcatagaaattcttactacggccctgtacattatcatgtttcacattgatatgaccggcttggctcctgaagcctttcattattgactctgaaatagaattaggctccatctttaggacattgtcataagcatagtctaatgtaaagaaatgtaaattggccagtaggtggtttagtttggaaagaatactgaattacttgactttttccttcctaacaccaacatcaggaatatacagaatttaatggtgagaggaaaattaactccatatgaggaaatatggcaaagagattatgctgatgggacctttgttagcatatttagttagaacagagtaaataatacctgctaaatcaatgccattttaaaaagacttaatttatatacaaagacttattttaaagataatttgatagttttccttttctttgagaaaaataagttggatacttgtctaggagagtatggaagacaaattttgttattgattactcctgggtatgagacagtgaggaaaaagaactgatttcacatcttcttttgcctctgctcttccttgctgctgatcattgttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaagatattagttaaattaaaattcatattaaatggatcacagaagaaagtattggaatgtgttattcagatcagattttactgtcttctcctttcttgggagcactttaaaaggtgcaaagatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgtatgccattaatgagtttctagccagctatcaaggtatcatcaaatgtggtttatcttggtgaatgaaagcttgaatggaaaattaagctcccacactgactggagaagttcagtggatcgttttgttctttaatgttacacttcactgaacacacttcacagagccgtgaatcatgctttaaacaagctgcctttactttaacggcagcagacaatgcagcaaaggtgaataataagtgttagcaatcttaactttcttttgcagtactctctaccacgtgcctgatggacaatttacaaagtacatatgctattttatagattggaacgtgggatccagccagtggcctgaatatgacagaaagtcaaaagggaaagccagcgaacatcacagattccttatccaatcgttctttgattgttaccaccattttggtaagtatttgcttttccattattcttagttaaatgtagatgaacacagaagtgcatagaaaaggacattataattggaacagcaatgaacagaatgtattttacagttatttagcaattactgtacaacagatgagtcaatgttaatttagtcacagttttgttagtcttaaatgatctaaattgtattaacgtttgggctgtttatgttgactaataatacagcttaatgtattactggaaatcttttcatttttccaaaattagttactattgaggaattgtcaatgtcaagacttgaaaaatacgtgcagctctataaatatagttaagtgatgagccaaaagtgaactttgcttctgcttttattttccgcaaatatatttcatagggcatggcacttatttttcagaattttttctcattataattatattttaactttattttcaattttattgttttcatcttggaaaattaattttactttatgaatttccctaatgtaaccaaatggcaagtgctttttaaagccagaaatattttcagcactgacagacttaatattgttaagctagatgtttttacccctcttatatttatttatatcttttaattagatcacacagtaatgttcgcttatgcccactatgtcatttgcaaaagggaattttaatttaggataagcaaatagctcttacattatttagtcagtacttttcacctaccaaataagcttatcaatgaccattcttattaatcctcaggtagtcagtaaaaattgagagtaatatctagaacaaactaccatgaacatttagcatttatataatttctaaatttgatttatggtgggaaatcaagctatgaggaatatatattcttgcccctttagtagcaacgagggatgtcagatctgtaggcatgtcaaaatgaagtagcttgggttaaagccttttgataatgaagcaaagctgataatcatgaagtgacagtgatgaaagtcataaagtttttaaccaatctgtggctaaggacctcagtggatactcgctctctctgtcacatccaaacgtctaagacacccttttacttaattttctatcttcctttcttttcaaagataactcccatacccaccaacctagccctcttcttcagtcaaaatgttctcacagtacaattacacatcctctttctgatctacatgccactatgttctggatctcattacttcctgttgggactattgcagtagccacgtaactatttcttctgcctgtggctttcctcctttgcagtgcacccaagtcccaccataaaagtctaattctgttccaggcaaatggtgactgcttgaacaaggacaacatcaacaacaacaacacaacaacgacaatctaatcctgtcatttctctacttctttgttatacagattgttagagaatccttattgaccattaaaaagccaacaaatttaaatttttatatatagggtcctctatggtcttactctctctcacctttttatcttcacttcccattattttctttcaggaaccgtgtgttttaattgaattgggataaccagttagcctgctacatagttttgtgaatgctcttcccttgctctgcaatatgcttatctcaatttctgagatatagtattcatcagtaatatatgacttaatattcatattatgctattcttatttcatgtgtgcattattttcccaaatatcactaaacattccttggaggaatagaattagattatgtcttctgtttctataccatatgtacctctgcaatgatcataggatcaataattctgggtagaaaacatctgtagccttcagtaatctggcccctacactcctttctatcatcttcctgatctagccaaattcctcaaaacatcacttattttatggctccaaatcttcgctcaattcttcttcttctcctcctccttcttcttcgatggagtcttgctctgttgccagtctggagtgcagactcatgatctcggctcactgcaaactccacctcccaggttcaaacgattctcctgcctcagcttcctgagtagctgggactacaggcgcgctaccactcctagctaatttttgtatttttagtagagatggggtttcaccatattggccaggatggtctcgatctcttgacctcgtgatccgcctgcctcagcctcccaaagtgttcggattataggcgtgagccactgcacccagcctgctcaattcttctttatgttctgcagtaaaaatcctattcattttcttgtatccatctcaaatgctacccacttcatgaaaatctttgacagctccattaagttgcctgtgtcttggggagaaggaggaagtttgtatactttatgtaccagaatactccatcatggcattatcatttttttaattaaaaaactatgtatgtttgtgtttccacttgacataagctctataatcaaattttacactttctgatttctcaatgtcggagaaaagtgccttgggtatagcaagagctcaataaatatttgtcaaattaaattaaataaatgatatttaattaaatgggaaattagacgaagtacagaactttcaaatgactatatttaaatatttttcaagtgtgcaggttattaaaattatctagtacaaataaagcaggtgattaagagtacccatataatttctcaatcttgcttcagtattcagtgttattttttgagaagtgttcagatattgcttctcaatcataatcaagtttatatctctctatgaagaagtggtatctaattttatcttcatatcagagtcagctctaaagctttaataaatacactaatgcctaaaacgtaccccataccatttgaaacagtatttctggactttgaatcttggacactttgatttttttaattttcacaggtaacacaaatctataaccatgattaagaactatagctcagattattactccatatgaataagatgtaagatcaactatggaagatgcactaagctctcattttaataaacaggttatttatattttagagtatgccaactacttgtttctaaaagatcctaatatttcctaaaaggataaaataaggcactttatttttataccttttagttaaaaaaaaattcctttttctgaatactctgacttcaacatatccatagtcaagtaaagaacagatttgaagagattatgtaccttatttatgtaagcttatttttgatgtaatttactggtattctatttgtatttttggagaaattatgattttttgattgatgttatgattattttgcccttttctcttgaaatatcttagaggaaattctggctacattatgaataatgacatttctcccatatccctatcatgggaaggagatacaaggagatgttaacttgtgcttcttgttcaacatttttattacgtgtctttaaaaaatgatgaggtattctggaattcagcactatccacaagctaattataatcagctctatttctcatgaattctattcattcacttatttaattttattcattattttatttgatgaatatgtattgaataataatgatatactaagcactgtatttaaagctaacaaaatagacatgatcgcttcccttattgaacttagaaaatggcaggaattcatatggagagttttacacacacacacacacacacacacacacacacacaaacacatacaacttataattaagatataaaagaaaagtaaatgatacggtgccttaatatacagggtaattttgagttatactagatgtcaggagtggaagggcaagtcaggttaggactcacagtagaagaatagacagctgagactgagagtttgaggaggaattagcaaggtgaagaaagggcaagggagtattctaggcgaagagaacagcatattcaagcatcctaaagcgggaaagggcttggaaaattttgtggaattgaaagaccattatgactggtgctaatgcctcgatctgcttctcagctgcttccagtataaatgtatgaatatggtccactacaaaaaatcatagcagacatgtattacatgcctactgtgtcccagacatagtttgaaacactatccatggatttattcgtttacttgtaataataaacttttgaagtagacactattagcaccattacttatttatagtattatatatatattttttcttttttttaggttagaaagctgatgtttatacagcctaagtattttactcatggccatacaactagaaggtggagtagttgtagggtttcaaccaatctgtttatccaacctgagcagctgatactataaaatgaaaattctagtggtcaaatatagaaaaggctaacacttatagtttatgatcaaaatagcatcttgattgataattatttacctaaagcaatgtttctcatccagaagtcccacatatgctagaactttgtgatgcccttagagatgtgcctccaaatatctaaacattttttctctacggagaacattatttaggctactcttgcgtgaatatgttgggtttctagtctctgcactcccctcatttagtacttagttttcttttactctctttaaactataatctcagattctcctgggcaatcaagacggtataggagctcacttcattttttctcttaagaattgcaatgtttacacatgtttttactccactttaataacatgacctagacccagtacattgtacgggtacagtacatagttgtattatgcagtaaatttacatagagagcattaaacatttattttatatatttttttatttttgaattaagatttatgatataaaattggagatttatggatcgtcaactacaggtctatgcctaaagctcagctctatttatgccctaattttattgtttgtgattttccatattgcctctttcatctttgaatttcaagttcggttgttgttaaaattctctgtttttttgtgtttatcgttattaatggaactagaactattatctttcaaattatattttcatttatgatgattttatttattgcatagaggttgttaaaatatgagttcctaattgtcaaaaataataacaaaaatacaatttttgagcaagtagtagagagattttaaagtataacgtgctaaaccttcagtttgtaacctggtcttgttgctgctgctgttagctatgggaagtatcaggggactaagtattattttatttatttgtttgtttatttctatgggttttcgggggaacaggtgatgtttgtttacatgagtaagttctgtttttttttttttgtttttttttttgatggagtctcgctctgtcgcccaggctgcagtgcagtagcatgatctctgctcactgcaacctccgcctcccatgttcaagtgattctcctgcctcagcctcctgagtagctgggattacaagcactgccaccatgcctggctaattttttgtatttttgtggagatggtgttgtatttttgtagagacggtgaccatgttggtcaggctggtcttgaactcctgacttgtggtgatcttccagcctcggcctcccgaagtgctgggattacaggtgtgagccaccatgcccggccatgagttaactctttagtggtgatttgtgagattttggtgcactcatcacccaagcagtatataccgtacccaattttgcagtcttttatccctcacacccctcttgccctttcccctaagttcccaaattccattgtatcattcttatgtctttgcatcttcatagcttagctcccatttatgagtgacaacatacagtgtttggttttctattcctgagttacttcacttagaataatggtctccaattattcaagttaatataggaaatgcctactttttcctctaaattcttagttttcgatagacatttttcactcctgtctgactatgttgagtgtttctcattgtgctatgcctgtataataattaatttttgtccatcaaaagattagtagcatttaaatgctactgcacatgttccttcttttgttgactagtaacactttagcatacaaatgactatgcatttggttactttttcagaaaagcatttattgtcaaggagattccttctccccagtggctcagtgaatttaacaaatgtacttgctcctgaaaacttagtcgtattttttattttcccagtactttgtggaaggtattacagtatccactttacttgcttaagcttgtaaagcttttgtgtcacagcccacagatacggaaggcttactgggaagcaaatttccaatgacaattgaaaagtacacagtacaaaagagagaagtgaccgaattatcccctaagtggttctgtagcttcttctataatatcaacaaaagcagtttttttctaaggcttcaaatctgccactgcaataagttttccctctgattctcgtctttccattgtggtagaaggactgtcaagcatgaagttcttagagagttgcatagcatttgggcttggaaacccagacactgcaacttcacaaagaagaaaaatattttccttctcagcaatctcagtcacatattaaaatgcgagataagagtgactcattcaaactaaagtcttctccaaccccattcctacaatcagcttgttcagacaaccacactttttctcaccatattttttcttctatttcagagattgtgctggtactacatttctctctttcattcttgctctgataactcagtgtgttttatttcaaatgtattttatttctcatattttcagagacttccacaaagctagtcaaatataaaactattgatggtggtagagaaagaagaaataaagaaagtcatgagttttgatgtaaaattaggtataattttgaaaatcctagggtcttaatttctaaagccttctaagtgccagaacctcattttttacttcatatacacattctttttcctttgtcctttattaaatctgacttaaattaactaccatgatgaagacttataagcagttttgcctttatgttattttttattccaaacattattgtccatactataaaattgacaattttataattgtcaatactaaaatggttgaagactattttattatgatcagtatattaagttttgtataaaagaatgaatagaaaaatctgaattttgaattcagctcagccactagcaaaatatgtgaaaatgaaatatttttgccttaacattctcatttttttaggaagatgttatcacaataggaccatatacacttgtacaatctgaattttagctacaaccttgaactgagattcaaatgtaaatttgcaattacttactggacatatatccacttagatatacagtatcatgctccacatgcatcaaacctccttctttgattcaggactcacaatgctgattttgcctatattttcaatctctatttatgattccagtacctttctattcaccccagccagaggtgtgttttcttagattcctcagtccctttaaaacccatactcacaattcaagtacctaaaggagaaagagtagattattctaagaaagttcaacagagaagtaatcaagaacattttgaacaaatgagatatgatttgttcatgggtactactgaatgggtgattatttttagagtctgctttgagaggcactgtacttataggaaagaggaaagagatggcaacattaaaaactaagtataaggtttcttgggaatgcattagatagggcaaaaatctattgaggaatgtggatgaagacgtaaaggttaaaagcctagaagcagggatgatagcactgccacagcgtgtgatggggatggtgggaaaggagatgatgaatgatactcaagtatgtatggagatgttggcaatgacttttgagcagtcaaatcttgattatttatgtaaggggataataaattagattcagagatgaaatgctgtttggagattagctaataggtacagtctcctttcccatcaaaccttttactggaaccacaatgaaatagtacatttgattgattcaaacttcagctttttctttcttactatctttcccttgtaaattaaactacccaaaattttaatgaccaaaatagaaattatcagcagaaagatagtaacaaccaactgaaggaatttaatagcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacaggataaaaacagaaacttttcttagaattataattatggccaacaagacttagatttttgtacattttgaaattctctaaagttatgtttctgaaataaggtaaatacagtttgcagaaactacgtatatgattatgcttgcatagtttatgaaagatttatgtgtgtgtaagtatgaaaatcactcctggcaaagattgcctttgcttaatagacttgaggaagaaagtagaaaagaagaaaataaaagaatttttctagattgcctcagaatgtacttgaattttgtttaaaaaagtaaataataagcatggtttattaaaaaacttattagggttattgctctataagcctggcatactatttgtttttgctttaaaacatagccccacattggattaaaaaaacaaaacaaaacaaaaaaaaaccaatatcagtctttctgctatcttcagaagaaccatttcacatgtaatgacacccatagactcaaaataaaaggatggagaaagatctgtcacacaggtggaaaacaaaaaaaggacagggattgctatttttgtattagataaaaagataaaatagacttcaaagcaacaatagtacaaaagtacaaagaatgacattacataatgataaagagttaaattcaacaagaagatttactactctaaatgcatatgtattcaatattggagctcccacgttcataaaaccttacttctagacccaagaaaagactttaacagctacacgatagtagtgaaggacttcaacacaccactgacagaattagagagacgattgaggcagaaaacaaagaaattctgcacttaaatttggcacttgaccaattggacctaataggcagctacagaatcttccatccaaaacccacagaatatacattcttctcatctgcacacataacatactctaagattgaccacaaacttcatcataaagcaagtctcaataagttttaaaaaactgaaatcacaccaagcatcttctcagagcacagtagaataaaaatagaaagcaacaccaagaggaactctcaaaaccacacaaatacatagaaactaaacaacctgctcttgaatgatttttgtgcaaacaatgaaattaagggagaaatttaaagaaatctttgaaatcggaaaatagacacacagtataccaaaacctctggaatgtgtgaaaagcagtgataagaagaaagtttatggtgctaaatgcctacatcaagaagatagaaagatctcaaattaacaacctaatctcaacctaaaggaactagaaaaacaagaacaaactaaatccagagctagcgtaaaaaagaaataactataatcagagcaaaactaaatggagacccagaaaacatataaaggatcgatgaaatgaaaagatgggtcttcgaaaggataacaacattgatatactgctagctagattaacaaagaatgaaaagagagaagatccaactaagcacaactgaacacaacatatgtgatattacaactgattccacagaaatacaaaagatcctgagactactatgaacatcactatggacacaaactagaaaatccagagaaactgaataaatatctagaaacacacaaccttccaagattgaaccaggacaaaacagaaatcctgaacagactaataatgagcaaaggaattgaatcattattgctgatcaacccaaaaagctgtggaccagatggactcacaactgaattctattatatgcacaaagaagagctggtgcagatcctactgagattattccaaaaatttgaggtggaaggactcttccctaactcattctataaagcagcataatcctgataccaaaatctggcaaagatacaacaaagaagaaaactataggccaatattcttgatgaacatagacacaaaaattctcaacaaaatgtaaccaaacaaaatccagcagcacatgaaaacattagttcaacatgatcaagtaggctttattcctggaatgcaaggatggttcaacatatgcaaataaataaatgtgattcaccacataaacagaattaagaaaaaaacatatggtcatctgaatagatgcagaaatgcattcaataaaatacaacatcatttcataataaaaatcctcaacaaaccaggcattgaagaaataagaactgtcaatgctaaacccacagccaacatcatactgactggggaaaggttggaagcatggcccttaagaactggaacaagacaaggatatccactctcaccagttctattcaacattttacttgaagttctagtcagagcattcaggcaacagaaagaaataaaaggcatccaaataggaaaagaggaagtaacattatttctcttcactgaatttatgattttatacctaaaaaaccctgaagattcctccaaggactcatagacctgataaatgacttcagcaaagtctcagaatacaaaattaacatacacaaatcagttgcatttttatacaccaatagcattcagactgagacccaaatcaagaatgcaatcccatttacaatagccataaaaatataaagaacctaggaatacacctaattaaaaaatgcgaaatgtctttatgaggagcactaaagacaaaacaacaacaacagcaacaacaaaatcacgctgaaagatgacacaaataaatggaaaagcattccatgctcatttcatgctcatgagttggatgaatcaatatcattatattgtccatactgcccaaagcaatctatagattccacactaatcctgtcaaattaccaatgtcatttttcatagaatttgaaaaagaaactattctaaaattcatattgaaacaaaaaagaggctgaatatctacggcaactctatacaaaaagagaaaagccagaggcatcacactacctgacttcaaataatactacaaggctacagtaaccaaaacagcatgggattggtataaatatagacacataaaccaatgtaacagaatagaaaactcagaaataaggctacactcctacaaccaactgatctttgacaaaatcgacaaaaacaaataatggaaaaggatatcttattcaatgaatggttctgggaaactggctaaccatatgcacaagaatgaaactggaccactacttttcactctatacaaaaagtaactgaagatatatcaaggaaattaaatctaaggcctcaaactgtaaaaatcctggaagaaaaccaaggaaatatttttctagacattggccaaaaatttatgactaagtcctcaaaagcaactgcagcaaaaccaaaaattgacaagtgtgacctacttaaagaagttctacatgcaaaaaaatatttgcaaactatgcatccaacaaaagattaatatccagaatctaaaaggaacttaaaaagaaaaggaaatatccccattaaaaagtgggcaaagaatatgaactggcacttctcaaaagaagacatacaagaagccaacaagcatatgaacaaatgctcagcattactaatcatcagagaaatgcaaatcaaaaccacagtgagatgccatctcacaccagtcagaatggctattattaaaaaagtaaaaaaaaaaacccacagatgctggtgaggtgggggaaaaaaggtaatgcttacattgttggtgggaatgctaattagttcagcccctgtagaaagcaatttggagatttctcaaagaattaaaaatagaattgccatgtgactcagcaatctaacacagaaacagaaaaccaaatactgtatgttctcacttataagtgggagctaaacattggtacacatggaaacaagatgggaacaatagatactggaaattccaaagagggagggagaaaaagagaaagaaagaaaggcttgaaaacatcctattggataccacattcttggttgacagggtcatgagaagcccaaacttcagcatcacttagcatatccatgtaacaaacctgcacatgtaacccctgaatctaaaataaaaaataatttaaaaataaaacacaaactctagattatgatagttattccttttatatgtagaaagttcatttgaaagtgattttttaatagtatcgagatatcaaaataggattttttttccagacaataaaacatatatgagcccatgtggagataattatcatcagtagtttttgattttcacaaaccagtcatctccagtgttgccttttcttgaaaacattgagttgtactgatggtagcttcgaggcttcttttcttgttcttcctggtattctcacttctaattttgataacctgtggtgcaccatggcttctgacatgaacactaattagggatggcagaattcaggcttgaagagccacagtgaataggaggaaattgaaagatggactcagacaatgacaagaaggttcttagctctacagaagtaagagtacatttgttggaatgacagatactgaaaaagaaataaaataatactgtcctgtcagtggaataatatcaatcaactgttattattatttatagttacctattattgttcttgttggtcatttcttgtgactgtgaattagaacttagtttttggcatgtccaattcaatttctgtgtattttttcctgtagcatttacgggagtatgagttattgatatgcaatgaaaatactagtagttaaggttattgtcaactaatattcttaaatatatgacccctttccaattttgagatcacagttttgctatgtacatttataaaacttaaaaaatttaactgagaacaaaataactgaagactattttagaatgcctaaaatatagtttagattagtggtggtatttattaaaataatttaaatcacaagcttggtatcatctgtaggctctggaaataaaagaagttatcagtctttataaatgttaatgatactagattcccattaaatctcatcaggttaaaaatacagttttaatgaatgaaaataaatgcagtataaaggaatcatttacaaataatgtaataatctttacttctgcatttctttttatataatttctgaaacttttctaaatgatcagctaaattagcacttaaatatattttgttttctaatcttgataaatttgaaactcttttaaaaattgttttacagttataagactcacaattttagtcacgctcattaacaaataattggctatctaagaaaaaaaccccaaaactcttttatttctcaccataataataaataattttatgaaatgttcttaaatagtaaaaaagaaacattttctgaagcaatttaggataaatgtaagaacaatcatttccaaccaataatcacaaattattaaaagttaggccataagaatattagctcttcattctgcttgacagtatttgagcatggcttggcttcttacttggcaggtggcctggcactcctatgccagctgtcaagctgaagacgtggctggacagatactttagaagagctacgtatgatgttctgagtgagatctaaagaaaaacagaaactgaagaaacaaaacataaagtttgcctgcattaagagcctgtttttctgtaatatacatttcatttttttaaaatcttgaacccactctttcaatacaggtgcccattattataaattctggttttggctttagagttcaaataattcaaattatctgcaaatctgtaatcaaagaactgtctagatgtccataatgaaagctatcctcattactactgtgaaatatttgcttcatctcaactttccgatgaaattctcatgaaaattcagaagaaacaacacaaatacaattttaaaagtgatattttaaaataacgttaaaggagaactatcacaatttcaatagaatacacaaatagactttattgggatagatttctgtggttgaatgtttttaatgctataaatatagaaaaatatcttatttttgaatttttttcttatcttgagtcaatttatggaaatgctcctgtatttaagagatttacaattaattgttcattaattatatgccctttggtgagaactttactcttcatgcctgatcttgtttttcgttgttgttgtttgtttgttttgttttgttttgagacggagtcttgctctgtcgcccaggctggagtgcagtggcatgatctcagctcactgcaaccttcgcctcccaggttcaagcaattccctgcctcatcttcctaaggagctggaattacaggtgcctaccaccatgcccggctaatttttttttgtatttgtagtagaaactgggtttcaccatcttggccaggctggtcttgaattcctgacctcgtgatccacccacctcggcctcccaaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaattaatttttgaatggcaaaaatacttatattccagcaataagctattattggtaatggttaaaaaatattctcatgaactgctatattttgtttgctctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtttctttttgaatcaattttatattgtgcactgatatataaccaggtattcaaatttattaacatagattttcacataatgtcaccatataaattttataatctcaatttactgaatctctttctcacataaaattctttgaggcttaaaatttctttcccttttttcttaatttggttgatgaagaaatttattttattactgttgcttttactaaaagacatgtttactgtttagccattttcttccttcctactttgtacttcactattttttcagcattttcttattatttttctttctgctatttgggtttttttggagcgtctatttcccagcctcttatgatttaagtactccatttatttatgttgattttaatcacttagtggtaagttcatatgaggctgaacttttctttcacaagtcttttgaagatatttataaattaaaagttgtatagctagtgattaccagagtgctttgaaatcaagcagaacactcatcgcttaaatcaaaccagactttggatttcagataacagttatttaataattcatttaaataatacactttaaaaaactacttttaacatctacacatttctttttatttagggaaatttagacaattttgtttattaaagctagtgttcatggtttttttaaatatcaccttccagggcagacatggtggttgggatgacttgacacctgaagttcaagagcagccagggcaacataggaagaccctattactacaaataataaaataaaaaaaaatagccaggaattttgacatgcacctgtggtcccagctactggagaggctgaagtgggagtactacctgagcttgggagatcaaggctagtgagccatgatcttatcactgcactccagcctgggtgacatagtgagaccctgtctctaaataaataaaaacttacatacatacataaagtcaacttccacattttttgtcccttaacttgactagtgccaataagtatctttaaatgaagtgtgtatgtttactaattttcattccattcatttattgcctggtgaagtgactgaaacattaaattttttcaattttcacatttcctcttgaaagcaattttgatatttttttcattggtttaactttggttttattctggctagccagttttattttaacttgtttaaagcttacaagactattctccactttatgtttgtaatttgtttttatacgttgatttttgtcaggctgggtttaagtaagggtgatttaaatttatttgacagttttctatgaaaatgtcattccttcatcctccaaaattcttaccaatctgaaaaaactacccattataaaaagaggtacagattacctatgagttccttttttttttttttttttttttttgagacaaaatctcactctgtcgcccaggcaggattgtagtggcatgacctcggctcactgcaacttccatcccccgggttcaagtgattctcatgcctcagccccccgagcagctaggattgcaggcacccgccaccacgcctggctaatttttgtattttagtagagatggggtttcaccatgtttgccaggctcaaactcctgatctcaggtgatccacccgcctcggcctcccaaagtgctgggattacagccgtgaaccatggcgcccagcctatgagtttcttttatgtctttggaagcataccctgaagttatatgttttcctgctgcaacatggctttgttttcctctagcctctgaagtagctaggactttttttcaccatactcctgggaattttcttttttttttttttttttttttttttttttatggttgtgttggaacaatttgtaaagtttggaacaagaaaatagtctcaattagctccaaagtatctcctattatttaattaatttttttttttataaattaatttttttattattattattattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggcgtttggttttttgttcttgtgatagtttactgagaatgatggtttccaatttcatccatgtccctacaaaggatatgaactcatcattttttatggctgcataatattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctcccagcacctgttgtttcctgactttttaatgattgccattctaactggtgtgagatgatatctcatagtggttttgatttgcatttctctgatggccagtgatggtgagcatttcttcatgtgctttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggaattttctttaccgatcttctgtgctacagccccatttcctggatcttattcttgcatttttcttgaattattttctcattttgttaaaggctgtaatagcatcctgagaaaggttgctgagtacaaatttaagaccttatatgcccaaaaacattgagtcttccatgaagaattataggttgaatttttggggaggcattactccattgcctttttctgctgttgcagttgttcacaggtcattctgattcttaaccttttgtatgtggcctgtatttttccttcctatgaacaatttcaagattgtctctatttctgaagcttggaaacttcactaatgatatactcttgtgtatagaattaaaaatgaattttaaaaatttaaaaacttcattatgttgaacattctctagagtcttgatttgtgccgtccaatacggtagcttcgtcacatatgactattaaacacttgacacctggctagattgaatggagatgactgttagtgtgaaataaatactggctttcaaagacatgatatttaaaaacgtaaaatatcttaaatttatattgattacatgttgaaatgatagtgataatattttgatatattaggttaaagaaaataactgatgaaattgaattcatctttaactttttaaaaatatggttattagcagaagctacattatatgtgtgctcctttttggggcttgttgctatatatatagtgtgtatatatatatatatgtatgtgtatatatatatatatatttttttttttttttttttttttgagacagagtctcactctgtcacccaggctggagtgcagtggtgtgatcttggctcactgcaacctctgcctccagggtttaagtgattcttctgcctcagcctcccgagtagctgggactacaaatgcacgccaccacgcctggctaatttttgtatttttagtagagatggggtttcaccatattggccaggctggtcttgaactcctgaccctttgatctgccctcctcggcctcccaaagtgccaggattacaggtgtgagccaccatgcctggcctgttgcattatatttctattcagcagcactggtccagaatcttgttgggcatattcaatccagaaactcagttccttcagtcttgagatattttcttaacattagttaacatggtaatttcctttccatcatttctcattgtctgtatcactgagtattggtcatctgacggttagacttccaagtaccatgtaaacaatagatagattctgtttgttttaaacattgatgtccaggtctcacatccagacattcaggttgatgaaacccagacagtattgtctgaaatctccctacatgattctactgattgtctaacttgcagtcgtgtgatgagtaagttctggagatctaagctacaacatgatgagtattgctaatgatagtatattgcaaatttgaaacctgttgagagattagatcttaactattcttaccacacacactaagaggttaactgtgaggtgatggatatgttagtcaactttgattgtgttaatcatttcataatgtatatatataccaaacattgtttcataagccctaaatatatgcagtttttatctctgaattatacctcaataaagctggaaaaaaagaaaaagggaaaatagtctggggaattaattttaggctgatgcacatttttatttagtcttctagatttcaacatagtgcttaatctctgcgaatctagagccacttcaattcaattacttcttcagttttctgccagggtcaggacaaaaagaatgggtagttctccagaaatgggttgaaatttctacctaatttactacttggtacagattatggacctctgaacacggacttttgttggggagaagaatgaaatatttcttgtactgtctctggttaatcaaggattattggtttcctggggccttatatttagtgtcaattcttcaaaaatgataggtaaagttctttatggggttcaggacatgctacccccaaatgtgtctccgtggtattaagaaagtctaggaaggtcactttcttttccccttctcccccaaagcacgtcataagactctcatctgagaggtaccctccctacacttggaagaaaagaacatccttatctctgaaatcacagggacacagagaagaatatgaacaaacagttcttgctaagtttccctcagtttattactgttagatcctacccttttgttctcaaatcctatttccccttaactgtccattcttcatcaaacttaagcataaaagtacataagtttacttcattttggagagtcttcatttctgaaggtttccatgtcatgtaaaacttgtattaaataaatttgtatgttttgctcttgttaatctgtattttgttatagaggccacagccattaatctagtgatgggtgaaaaaagaaatcaacccaccaagattccttaatcaattgcctgtaactctatatattttcaatgtgtaacaaaaaggtcatggattccagccacatgtgtaagccaagttgaccaccctgctgtgccagtggaaacacactgtcacagtaagactgtggtattacctacgtatcaataagaccacagacggaattttgtatctgcaatttttccatttcaagagttcatttattttaaacataattcattaccaacagctaaccctctttttttcactctattaatacaacttttttttttttttgagacggagacttgctcttgttgcccaggctggagtgcaatggtgcgatctcggctcactgcaacctctgcctcctgggttccagcaattctcgtgcctcagcctcccaagtagctgggattacagctgcccaccaccacgcctggctaattttttgtatttttagtagagacgaggtttcaccattttggccaggctggtctcaaactcttgacctcaggtgaaccacctacgttggccttctgaagtgctgggattacaggcttgagccactgtgcccagaaatacagcttatttcttaaaaatagtctggaatatgcttttttttttaattgaatgaggctctttttgatgccaggttcatgctcctgcaccagttttgtttgtttgtttgtttgtttttacaagaatgcctacaacttaccagttaccttcaaacacaattttttgtacatatctgaattttgtgcctacaaacttttagcaagactccaggctactctgactttcactgttctgaatttgtatctttgctcataacctcacaactactttggttgggtgccagtagaggcaatgccagtgcttacttttcaccaatccttgagctgtatttggtttaggaatatgagtctattaggtgaagaaggaatgtaagatatttcagatagtggggaaaagtatatttgaaggcacagatgtgtgaaagagtttaggatatatgaataactctaagtagtctaccactgatgtagcacagaaaatgtaagggactggtgatggatgagtgtgaacagataggcaacatcaaagtagaaagcctttgtaagtttcctgaaggaatttagtttttatgatattaaagaaattttgaaggatttaaaatacatgaacagtatgatcaagttgggggttttaaagatcccttttagttttgaaggtggaattgttgttcactggacaagatttggtgagaacagccaaaaaatattgcaagaatacaagctgataagatctgaattatggaagactctaaagggatgagggaaagaaatcagatttgtaagatatatgggggaaaaatgaagaatatatcatttgcaaattggactttatgaagtcagaatttaggaagacatctttctgataaatatgactggaaatgggattgaggtaaaaaagcagaattgaaataatacaggatgaatttaattttgaacatattgcattttattttcttgtaatatattgatctagttggcagttagatatgtaattccagagctcaagagaatgttctggcttggagataacttttggagttaagatgatggttggtctcatgaataatggtgtgatagttcactcagggagcacatacgtgtttcagtacatttacactattggacatttctttcttctcctgacactatttcagtgattctgtcctaaaacttactgtattctgtttggtttgacaaacaattataaattatgggcttccaaagaaggtaaaaagcatctgggattaaaagaataaaatgtcctttgagtctggctcacaagttctttaagcatattgggaaatgatgattgtaagatgacagccatgagacattcaaaaccagtaaatcctgaatatgtcagatacctgcaacctaacttcatttcctgatacttatcggattcccaggtcctgatctctgtgttttcaactacaacttgagtacttgacattgatttctaattacttctcttcatttgagatttattggatactcttaatgacagactatatcctgactccaattaaccccactacagtgactcaaaaagaaagttacagacttcttcctctcatagaaaacacacatattttgtcttgctggcatcactggaatcagtgctttaacataaaaatccacaataacagatgagtccttggtttatccatttatcagtcaattattttattaggcatatttcttattaggtgtttatatatagtgacattaattaggtgcctaacctggaatgaatattcttaacttgaatcctataaattttatattctgagctctcttagctttagttctacatagtaattgattaaaaaaacaaacaaacaaaaagcatgaatttattttaactactttgagtaatctcatattggaaaagcaaacaaaacattttttcactacttcatcagaggattaataaaagaaagaaatgctttcgccatatagttgtttgaaaaacatttcatgttatatgaagaataccttatgctacattcaaatataattatagccaaaggcactaaaatatttattttcatgtatgtcacagctttatgtctttaaaaactcaaaatttgtatttgctgtttttaacttttaaatttacattgttggcaagtatgatactccctgaccttgaagagaaacaaaacagtaccttcaaagtgaagcacacactttttgtgccctcgagcaatagcattccgtgtttactatttgtttacatcagaatttcagtgtgctccacagttctgataggtataaatatataggcacaccctaaaactatcctgtacttaaatagattttagaggatactgggttaagcagcaaagtttgttaggttttgttatcactgaatgtttaacaaattcacgtgcattgtgaatatctcagaatgattttttttttttggtacggtttctctctctgttgcccaggctagagtgcagtggagcaatctcagcccactgcaaactctgccccccaggttcaagctactctcttgcctcagcctcccgagtagctgggattacaggcacccaccaccatgcccggctaagttttgtatttttagtagagatgggggtttgccatgttggccaggctggtctcgaactcctgacctcgagtgatccacctgcctgagcctcccaaagtgctgggattacaagcgtgagccaccccgcccagcctgcagaaagattttttgaaactaaaacttggggcataatttctcagaagaatacactgtggaaaacaataagttagactctgacgattttgaagcccttacaaatatttataatggaattcacttatacgtgcaaatctatgaactacataccctaccaataattagcagaagagcagaccatttctataattagttgacacttggtacctggatttaatatctaactgaaaagaagctttcagtaaggtctgcgagttgaatggaaaaatggaagtcagaatctggttttgaatcgtgagcctgccacttagtagttgatttactttaggtaagttgccataactggagtggggataataataatgaataacttgaagtttgtttctattagagataaaaatttataaattatataacatcattcctggcacaaaattgtcagtgagtgatcgtttttaacgaccacagggtaatctaaaattaaaacataataaatggtgttcttcgttgctatttccccccggactttctaatatgttttttaacattttctccttatgggccaccattcctcttcttcaggccatgtgttggtgaacttcttctctatatcctctctcaattcatttctcttgcttggaaactcatttatctccatttacctaattcatactcattctactcatacctttttctggtggtttttcctctgggatgatttaactgactgacttgggacatttttacttttcccttctctcacatctaatgatccttttttctataaaatgttatctttatgcatttaaatgcaaacttttagtattagtttatatttttctgtacaagttctctgtcctcaactagattaaaaggtgcttgagagaagcaactctgtcttaaagcagagtattttctttaaaatgataggtattcaaaaaacttttttttattttattgattacaaaaggcagcagctgaaagttaaactcactattcattatagaaaaagaactttcagtagacagatgtggctaactactactgatcattgaggaataattctcattgcacaagatctttttcatgtctgttttacatgcatattcagtgacattgaaggagttttccagtgtctgatcaacttttgagtgggatgtgggtagaaagcaagttagtattgagttctttattctaattcatttctctatcaatgtgtttccatttgttttggagaaacaaacagaagtagaggatggcaaacactggaatctcctttctaacaccagagggcctccaaacaaaatgttcagtgaattaaaagaaatagaattctagtcattgaaaactccaccttctaatctttggatgcaaaatgtcttcatttttcgattggctccatctttctttcatacattcaaatttattcgatctttaagtagtgaaaaatacataaagagaatattgaagaaaaaaaattcaacctcatttattacaccaaaattggttttaggtagatgctttaaaacaattttaggaaatggaatgccattctaagcaggatatgaattcaaagagtggtaatcagcaataattatatctggatagtttgtcagagtttgtgggggtaaagatttttcctaacttaggccttcatgtccttgtatccccctgtctttcttgctccacacttttcttcacttaagtcctacagaactatttatactttccatcatccacatgagtcattttccctcttcaaagtatttccatctacgccacttctttaactccatagttatctgtcttgactgcatatttgaccagctaaataatttctatcccatgtgcaaaatgaaaatgagggatctcttgttgaacaagtactaagaatttcaaaaggacactagcagagcagaaaacccaaaagcagagtcctttgaaacgttgggccctgtaccacagcacaggtcacgtccccatgaatctggcccaactgcacgttataatcacataggaagttgttttttgctttgtttcatttttaaataatgatgctaaggtagtgctcagatgcattagatcagaatttctgggggtaaggcccagacctcagttttgtaattttaattgcattttaattgtaaaaaatttaagtttattttaattttaatgtgtagccaaggctgggcaccaaattcaaaggctatttccttgtcacttggcgtatacttacctatttacttttctatctctctcatgagaccattaagttccttaagagtagatatcatatctttttagccttttcatctttatgacatagaacaacacctggaacattttagatatctattaaatagattatactgaatgaatgattaaatagatactaatatgacctcatttttaattttacagggtgtaatcaagaaaaaaagaaagtaaaggcagacttattggatgataatttgaaagtgtaaagagaaaacatactcttagaaaaaatgtaataaaatatttgagaaattagatctaaatttactttttaaatgaagggtattgagagatacaatagtcccctcaattctgtgcttaaggggaaaattatcttatttacactattactcattaaactttcagagttgaggaaaagcaagaataaggaaacaagatgggagaatgtttacagaattaaggaaatatgatgtttctcaatatgtgtgtaatacagttgaataataggagagtaaatttgtggtagaagattccttctcaaagaacgacatggcttgtgaatggtactagaactggaaaataatgagccattattagcactagttttgtctgatcaaattaatagaataaatgtaattgctcataagcactagtaaagaacaatcttaagcatttgctagttttaaataatttggtccagattttaacatagcatacattttccattatatgattgtgctagatgtttacacataatgtaagagtatggcacatataaatagcccattattatgttgtgtttatagtatatcatagcaatttgaggacacatgacatgtctcatttttttctttttggtacagcgtttggcaaactaagttcagagggctagatacatgttttttgtattttctcttttatttaggtaaaacttacatgatgcaaaattcatcattttcaccaaagtatgtaattcagtggttttcagtatgttcacaatattgtgcagatatcaccactatctagttccagatcattttcataacccctaaagaaaactctgtatccattaatcatttattctgcgttcattgtttgtttgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtgcccagccttgcatttgtttttacccatgaggccctggcaatagcctatctgctttctgtttctatggtttgagtactctggatatttctgggtgactagaatcatgtactgtgtggctttttgtgtctgcctgctttcacttagcataatattttcaaggttcatccatgctgtaacatgtatcaatacttcaatacttttatgattaaatgatattccattttatgcatattcatcatttagtttatctgtgaaaccactgattggcattcagtttatctccaaaatttggctattgtgaaaagttctgctatgcacattggttcacagtttttgtttaaacaccaatttttaatctttttgggtatatacctaagaatagcattgctgagttttatggtaattccatatttaactttttgaggagctgccaatattttttttatagcagctgcacaatttcactttctcactagcaaatgtatgaaggttctattttctctatatcctcaccaacttgttactttcatttttaaaattataaaacatcctggtaggtgtgaagtggtatcttactgcggtttagatttgcatttccctaatgactaatgatgttgagcatgtttctgtgtgcttgttgacatctatatgtcttctttggagaaatatctattcaagctctgtgcccatttttaaacagcattgttttttttttgttgttgttgttgtaggagttctttatatattctgaatagtagaatattatcagttatatgattcacaatattttctcccattctttagtttgtcttttcatttgtttgacaatgtcctttcatacacaaaagttttcacttatgataatgtccaatttatctatatattttttgttgattgtatttttggtgtcatatcaaaaaatccattgccaaatccaaaatcatgaagtcttacctatatattttattgtgagagttttatagttttatcttttacatttagatcatgataactttggattaattttttgtgtactatgtgaggtaagtatcaacttcattcatttacatgtagatttttagttgtcccaatgccctttgttcaagagatgattctcattattttgttgagaagttttacatctgtattcttaagggacattggtatgtagttttcttttattgtgaagtcttttctggtttagtatcagggtagtgttggcctgaaagaatggacaagaaggtgttccctcctgttttattatttggaagagtttgagaaggattggtgttgaattttctttaaatgatgatggaattcatcagtgaagttatttggttctgggattttctttggaggttctggatgactggttcaatctctttattttctctagatatattcagatttttatttctatttgaggaagttttgatagcagtgtctctgtagaaatttgtctatttcattggggtagtctaatttttgatgtgtaattatttctatgattctcttgtaaactttttatatctacaaagttggtagcaaaggccctcttttttcatctgattttttttgctattacttttttcttgattggtctagctaaagatttgttaattttgttcatcttttcaaataatcaaattttggttccattgcttctctctattttttttttctgttctctattttattatctctgaggtaatctttcttcttttcttcctacctgcaggtttagtttgatcttattcttctaggtttctatggtgtaaatttatgttacttatttgagatttttcttcctttttaatgtagatatatacagctgtaaattccctttgagggactgctttcactgtatccattgagttttaatatgttctgcttttgttttcattcatcacagagcattttctaatttcccttctaatttcctctgcaactcattggtttctctcaaggccagtttctattaatttctttgttcctgtcaatgggctgtactttcttgtttgtatttttcacttttttttggttaaaaaatgggcattttaaacagtataatattgcaactctagaaataagatattcccctcacccagggttttttgtttactggttattgtagttctttgttgtttagtgaccttgctaaattaattttgtaaagtctgtattttttgttctgggtggccactgaaatgtgtgattgttaggttagtagtaccttagtaacttgacagagatttccttaaactcctggaacaaaacaacaagaaacaaaaccaaacttcccgtctttgtagtttggttgtatattggggcactcctttactgtttagccaggcagtttacaattctgccctattcttccttcctgcttgcatggagcctgaatctagccagaggtaagggcttagggtcttgtcaggtcctttctgagcatacatcccccactggttatgtgcatggactgctagattcccttgactatacgggagcttgtcccagctcttagtgcccccaagtatttcctccctagtctttctgtctcaggctttcaggtcaatctatttcttgcccctacttttccctcttacccaccaggtggcaggtaatatatttgcctttaaatgcttacaaaaaacaccacgtgtgaagcagcttcagccttagggaagctccttatgcagatgaaccaatggcaagtccttgagcccatccctctgggagccaccacacaggttaaaatacgtaacaattttgtaagaataaggtccatatggtttcctatggtgtgtatgacctgcatcaggaatgcaggctactatcttcaagactgttgtggagctgaggagtatcaaatagtatcaacagggtaaattaatatgccacagagctctccaaccaagattctgtagtttttcccttcactaaacatttccttgtcgttgtaagtttttattcaattctagagttatttaaaaattgattctgatggtttgccagtttatcaactgcttctatggctgctttcacactataatgacagaattgaatagttatgactatatagttcataaagccaaaaatatttactatttggtctttaaaggaaaaaatttgaacctctagtctacatatctatattcagaatttacataaaaacatttgtttcatgaatgtattaatgactaaattggtggatgaatggatgaatgaatacatccaaaatatttatattttaacacgaggtattccaatatagatatctacatgcatcttgttaaacttcaaataaaaatttagaaaatcatggtaatttattgatcatctttggagttgctcttttcacttagaggttactatggaaatacaggagtggcggtagtcaattatcaataaacatgccaatcaaacacatatattactactggggatcattctcatggtgtttataagctgtcccccatcccttgatcaaatcatactgtatgtgtgctaaatctacccaagagtgttgcttattagagtaatgagttgataacatttttgtgagagaaaaatttatctttgctgaaaatcttcctttattctgcttgtatttctttgtaagcattagttatatttcttgggtgtttttcatcatttgagaagaataccttttacccataataaaagtaaacctatccatgaaaattttatctaataaaaatttttagtttagatgcctgaaatcaaataaaaataatattaaacagggttgaaaagaatgttaaaacaggtaactaaaacttgctgccttatactatctagtaaagcagactttccgaatgtttatcctctgtgcttggatgagaggactgcaagtgaagatttgggaaaattcaagtaaagcatggtctaggtagaaagggaaacaaagaaaaacccccaaaccaaaactaacccaacgaaaaagggcagagggttatcctttgttccatctccttaacattgctgtccatagtaatacctttcatccttaatctcccttttaaaagtgtgactgtcccctctgcattatcctgagcacctcttgagcccttagggggaaatatgttgaggtctgtttcattttattgttgttaaggtgtaagtctgatagttataatgaaccaactcaccttcctgaaaagcataattgttccactatttctgttgcccattcatcagccttctactttcaatcaacttaacatctgccttgatttccatactctataaaaactagattgccctcttactagttatgatttaatgccttcagtaagagggcagtaataagatatagagactgaacacactgctcagaaaatagaaggaaataaattattttcaggaaaatatgaactgctcagttttgtttcaattgccgtaatattactttaatcttagattatttttttgtaaccattatgtctttttcatttggcccatagggatgctatttaaaaaaaggagggttttttttttttttttttttttttttggtcaaccctatgttcattaaggaaaaaaaaaaggcaccattaggtaatattttctaaatgcattgatatctttaagaaactggaatttcagctgttgccacaaataaactttacaagttttttagtcataaggataaattcaagaacaagactggggttacctgaatatacctgtctatttttcaaaataaatgatttgtgggctacagcatcctgtgttctgagattcaccacaatgctctaaaacaagacacatgtccctgtttctcaaaaacgtagcctgtgagaacattctgcattccacttctgataactaatgaagcaaagtagacgtgtaaataaatacaggataatatataattggtagggatttcaaattcaccactagattgggagtttcataagggcaggaatttttctatgttgttttgatttgtttttcattgttcagtgttgtatacctagcacctggaagagtgttgggacagagtaagagttcagtgtatgcttgggtaaatacattggtttatttattcttatcattgtaatagcaggggatattttatacatatcacattaaaattaatttacattttaatgtccctatgttttaagtagcatgagtaagacactgatatctcagggttaacatatgaaaaagataattgagccctagataagagctgagagatacatgagttatatgctttaaacattattaaaagttttattatatttaaataaaacatttttataccctcaaccttaaaatgtattttactttttcagaacttcattttggattcattctgtgccaactcccagtctaatgcagataaaaatatatgagttattgggttccttaaaactggggttgatagtagaaatgctgacaaatccttattacagatgccagtggaatgaagtgcctttacctctagcaaatgctgatgtggagatttaagactatatgagaaatcagttaagttgcccaggagagttttatcatattattcaatgaacttggtatgtgatgcagtaattgcttttggtaccatttttcttctcttacgtgaggttattatttatccttgtaccgtgtgaaacagagaaagagagcttaaaggagagtcataacttgatgtaaaactatcccatgacacagtgtagctggagataggaatcaaagcaagaaaactgcatcttacttatcagaattaaatatgggaagagtaatatttgacattgtggagatccataaatactaaaaagatacactcagaccacaaatatttttttctagtgatgtgcaaacctgttgaagacatatatctaagtaggttttttaatctcagagggatcaacaaatttatttgcctatgacagaagttttcttattagctttaggtgaaggaaatcaaattaacaggtaggaggctagtaggacaagttagagtaataagatttaaatagcctaataacttttacaattatattgctgttttcacttattgcacacatatatccctcatatgcttcacagactcctaacaccaactttgattatattttatccagtgttcaagtcagtttctgtgaaaaataaataaaaagtacttaggaatataatttaatttaaaatagagacaattataatttaacaatgcaaacagaagaaaaagcatttttagatagtcatatgttgctacctaaatctgattagtttaatagatgttatttttataaattcttaaaatactttatgttaaaaaggtgtgcttttatttagaaatgagatgatttgtcaggtagaaaatgaattttgtgtattttatatttactatttattttcttccataaagttgtcttgatggcattgttcaataattaataccattttgcatacaatatagcccagtggctaatcccagttaactaaaaaaaaaaaagtcatacaacaggtgtttaattatgtaatgaactatttacaattttatattcacatggagtttggaaatggtcagtaagaattatttaatcaaggaagtatgggagggatgggtaagtggtccagcagtcagcctggctgagttgtatactggctgttgactatgggcaaaaaaaaaaaaaaaaaaaatcttaacaccctttccctcagttttttcataatagatataatattactgacctcatgtagttgttatggagaatacaattgaaataatccaagtaaagcatttagaacagggtttggcacatagtaagtgcttgggaaatgttaaacattactattgcttagtcatggggattggcaaattgtcgatctttgttccttttaagtaaaacaaaacaaaacaaaacaaactctgtatttgaaaatcataacctaaatgaaacaaaagtatgaaatcaatagagctaatttactatacctacatgctttatttttttcccattccaccaaccctgtattctcagtctttcccctactctgcaagggaatatgatattctcctcaagtccttaaccctctacacatgggttagtgacttgaggatttgttaccatcatgcccgagcctcatagtggaacttacctgtctcaatttttttccttcaagttcaggtttccctggcttccccggttgaccagaacaattcgtttctattcaattcatttcagcagtcattttattggtaagcctgctatgtgccaggggatgtttggtgcttttgaagcaaaattaagtaaccattttgccgagtaaatcgctcaagtctagttcagaaggcttacatataaatcatcacctactacttggtatgataaatgctatggtaaaagtattcaaaagttgttgcaggagcaccagaaaaagaaacacctaaatatgtctgaaaagtgaatactcagtaccagaaagctgtttcaccacagggcttcttccctttctaatataacaagggcatataaactatgatctatggaaatgtgttatctacttgaaagactagcaggccaggaagagtagtgaggcaaaagggtatgataacctcttgggtggaagggcactacatctgttacatttgcagtactttgtgtacccctggggaataaagtttatatgtgatcaaatgttacataaaaatcagacaagatcctaactgttcttttacttatgttaagctcaaatatgtagctttggatgtagttaacagattaatttctgattcccatctgattcaatttaaaaatccaacatatatggttttctcccagacgatattacgatgtagaaagcaacctaaaatagtgggaaaagtaggtattgtggaagttgaaaaacctaggttcaaacctcttattttgttgcctcttttagttgttctttacctcttcttagctatgtgacctgggaaaattatttaacctctttgaaaatttaaatgtcaaatgaaaatagtcccaataagactgcattgaaacatatgaaaaaatgcttaacatcatatggcattagggaattacaaattaaaacaacaatgagacatcaccgtataccctcaagaatggccaaaatccagaacactgacaacaccaaatgctaggaagaatgtggagcaacaaagcctctcatttcttattggtgggaatagaaaacagggctgccactttagaagacagtttggcagtttctttcaaaactaagcatactcttaccatatgatcttgcagtcatccaccttgatatttacccaaataaaccaaaaacttatgtccacacaaaaaccagcacatggatgtttatagcaactttatttataattgcccagacttggaagccaccaaaattttctccagtgggtgagtggacaaataaactgtggtatattcacactatgtaatattattcagcagaaaacagaaatgagctatcaagccatgaaaatacatggaggaaacttaaatgcttattaccaagtgaaagaaaacaatctgaaaaggccatattccaactatgtgacattctggaaaaggcgaaactctggagctactaaaaagattaacggttgccaggagttagagtggggaaaggaatgaatatgtaaaagcacagagaatatttagggcattgaaactattttgtattgatactacaatggtggatgcatgccattatacatttgtcaaaactcataaaatagacaacaccaagaatgtgcccataaggtaaactatggactgggagtggtaatgatgtgccagtgaatgttcgtctgttgtgaacatgtactgatttggtgctggatgttgatagtagggtaaactaggcctctaggaggggtagggagatatgtgaaatgtctgtaccttctgctcagttttgctgtgaacctaaaattgctagaaaaattaagtctattaattaattaattaatttgagacagtcttgttctgttgcctaggctggagtgcaatggcacaatctcggctcactgcaacctccacctcccaggttcaagagcttcttctgcctcagtgtcccaagtagctgggactacaggcacctgccaccacacccggctaagttttatatttttagtagagatggagtttcaccatgttggccaggctggtctcaaacttctgacctcatgtgattcacccacctcgacctcccaaactgttgtgattacaggtgtaagctgtgccgcccagcctaagtctatcacttaaaaaaaaagaatcatgaaaaattattgggaagctgaaataatgaaattatgttaagaagctgatttttgccaggatttttttaattaattcccctaacaactttaaatgtattgttaaatatatttagaaattagaaaattgagttatagaagtaactaatttatcaataatttatccaatcagtatttactgggcacctactatatgctaggcattgtattaggcatggaagatattataatgagttcatataaatgttatattttaggagagtgagacaaaaacccaatagtaagccaacaagtaaaacaattgaaaatgacttaagtactgtgagaaaataaataatgagatagataataacagagaagattctctttagatagaaccaaaggaaagattttatatttaacttgagccttaaaggaagcaaaagagctcaccatttgaagagcattatagacagataaaacaacaggtaaagggctttgagatggaaaatagctttgtatttttgaatctgggagaaaacaggatatctagaccttaaggaaaagaaaatagagttggagagagaaaggtaagttttaagcctttatgatgaatattttattcatttaacacatgtgtcttgagcaccaacggcttgccagtcattttcttctatgcactgagataaattaatgaacataatctctaattcctctatactcatgggtttatgtcataataggggaagaaagaattgcacatacatcaaaagataaataaacaaaacttcagatgggatgagtgctatgagcaaaacaaagcagggtagaataatggagagtaccttagaggaaagaggtaacatatatatgcggtttctttgaagtggtgaatcttgagcatagggttaaatgacgagaaaacaaccatgtgaagatcttaagatagatcttccctgtcagaaaaatcaatcaatcaatcaatcaataaaaaggcagtgcaaagagccaagacgtggagttagaaacaaatctggcaagtttgaagaccaaaatgaaggccaatgcctggaataaaatgagaaagagagggaatagaagctaagttcaaagagaataggccttgaagaccagcataaacagtttttattttattccagttttaatgaaaagccactgttgggttttaagcaaatgcacaataaaagcagatttagtttttacaagattgctacgactttctggggagaatggactgaggggggcagaaatggaaagtaaaagatgtagttacaataggaattcagataagaaataaaggctacatgagccatgattctagcaggggacagtgtaaagaaattagtagaatcagtatatattttgaggggagaatttgcaggatttacaaaggataaaacagaatttgagaatgattgcctggctttggacttaatcagttttgtgagttgtgaagcctttcaccaagatgagagcaagtggtagaacaacaggttttagggcccatggcaatgatgttgaatgttattctaaacacattgggaatctatgtgatgatttcaagtagtagtggggaggtaattcaatgtatccttcagtaagatcccttgtgtttctctgtatcaaatgagctaaaagaaagggaagcaaagatgatgactcacaaatcagtttgaatagcagagtaaacgatggtgccattttctaaaagcagagaaaactgaaaacatgtaaaagttttggggaaaacaagaattatatttgggatatgttaaatgtgagctgtaatataatgtctatgagacataaaatcatgctgacaagtgctattggatacgtgtgcctaagacttgcaagaagtgtgggcctaatatataaattttgaggtcatcaggataaagatgttattgaatttgatgtgtgtggatcagaaaaaagtaggaataaaatttaagaaaaaaggttagagctcataactaattttaggaacataaacatttaactgaggaattataataatggaccatggaatttggggccagataatgaagtgaagtcaggagaggattgagaaatagtagggaaacgtgagttcactgaattgggggtctttatgtgatcgaagagcacaggcgtgggtgtgattaaacaatgagttggatgagtgggttgttagaaatcctaactaattttctgacaaatgcaggctgcagttttgaccatgcggaagagagactagacttcaatgagggaaataatttggtaatgagtaaataaaagaattaagagatcagctgtattggatacttcatgtaggtggattttgaatataccgagaataataagaatttgaaaaaagagcaaaattaccatccagtagtcaaatatttgaaaagtaaaggcttctcttcctacttaataaaacttttgaaccagatttcattgaatgacagcaattgtagagagagagagcctggtctagcagggtggaatgagtctcagaggagcagtagttactgcacaaggcaggggaaaaaatggtgtggggacagcaatgaggggcagggaaaacaccaaatgtgcctctgtctccaagggatgtggaggtaaatgaaaatagtctgtaggaaagagagctgaaggctaagcaatgtcatcagggtacagtccagcagagcagggagataaaatggtcattctaaaaatcaggtgaagatacgaaacaacgtgcctatctctgaccaggacttctctaacacacagtggcagtgtttagaaagggtcagaataacaggaggtgaggctgcagggtgcatacaactgtatagagataaggtaagtccacagagatgggaaggaagatgaaaataatcttgattatttcttagttgagtgtgggcaagctgacacatggctgtcatgtctaaaactcctttaggatagctctcatgggatgactgttgttctccaggggttggggaagagggtgagcacattcctaggtggactggcatgggagtatcctaacttttctcactctgtaatagcttcctctaagataacaggggctttgcccataagcaaatagtgaatagcagaaccaattgttgcaccttggtttattcatagcagcacagtctgccataccatgtgcaagtgccttcgataaaatgtgctaatgcatggaatctttttgcacttagttaaacatacaaatttctcatagggcctaatttgcagagcctcacaaaaattggctcctcaccccttttttattcagatcttgttcaaccaactcactcacttactggatgtgacttctgtcacactgttgccaattatcctcttcctgaaacactccaatattatgttggtctcagggctttttaccatgctgtgtccttggcttgaaatactctgttttcagagtttcaagtgtctagactctttctcatctgttggattatacttcgtctcttaccttctctgaaaagactttcaggaaattacttaattttgtcttctcttatcttaccgagtaccttgcagttgttttcttttctattgacctattttatgtttttataccacttaggaggatctgataatatgtgttgtatttgtttaggcatttgttaactgttttcttctctttatcatgaacttcatggctcaaggatttctatttatatagaggagggctggctcacaataggtgctccataaaattatgttggatgaatgcataagcacttgataaagatcactttcttcctctctctctctctatttttttttctttttttttttttttttttgagacggagtctcactctgtcacccagacttgagtgcagtgagcaatcttggctcagtgcaagctccgcctcccgggttcacgccattctcctgcctcagcctcctgaatagctgggactacaggcgcccgccactacgcccagctaattttttttgtattttttagtagagatggggtttcaccgtgttagccaggatggtcttgatctcctgacctcgtgatctgcccgccttggcctcccaaagtgctgggattacaggtgcaagccatggtgcctggccttcttcatctatattttaaagtaaactactactttttaaactataattaaatatagtagttgtaattttcatggttgttgggacaaaatgtgattatatatataaaaagtccacactccagttctttgcacatagtaggcaattagtcagcaatttttttcattaattttatccatagatcccatggaaacagcataccagatattgattaaatgatataattcaaattgaggtattataatcatggtgaaattagatgtcggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaaatttctgtcttctaagaaaagcaataattctgatgatgagtttcatgattaactgttacctcttttcttctttttcaatgttttcaggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcatgtaagtcccttccctcatgatttattagtttgttatgttgctacaaggtttactcttttgttgatgtatatgaaataactacaaagagtagtgatatatttcaagcatgtatttccttcaataattttatttaagctagatagtatttgtcactaaatgtaaagaatctaagagggatatatagccctatatatgtaaacagattaaattttccacaggaactgagagatggaacattatctctcttgattattacatttcaaagagatacttcccaggtccttgagaaaggctttcctgggccataaagttggcaagaggcttaattagcttttaaaggagttatatacatttttaaacagagagggagaaatgacctatgagtttttaaagtaagtattctaagaaaaaggggtgaggaggggtgtttctttccttattttcagttggaagaatcaggcctttttttagaatttagtatttaattagtatttagtatttttaattagctcttgcaattgcaagtctttgttattttagaaataacatgtttgtcaccttcttattctccatccctctttcttaagaggaccttaagcatacagggtttggtatgatctttcaaattcattatgatctaaacaagatggttcttggtggtacaatatgaagatgcaacttcagatagacatcttaacttttaaaaagtataatttataaatttagaagaggagactttgtttcttacaaagggttgcagcatgcacggtggccattcagacaggttgggaagcatagtctctggttggaagccaaaagcagatactttgagggaggggcaaaaggaacaggaatttatgctaagcaagatggctgaatatatatattatattttccccaatgggatataggagaagtcatgaatatttatgaaaggagaaacttgtgcatgaacatgaacatgcctctccatggattccatgtacaaaaatggtggcattagcatggtgtgagggtggagttttcagccctatggcatcaaaaagtgaagcacaggacatgaaaatccttactaagcattctctgaagatggctatagccattcaatggtcgtggtctaacaggcaaaataaggaaaggcagcatcaaggttggttgatatcactggtgaagtctttcgaaagggctgttttctgttttcagtggtgaagtcttctgaaagggctgtcttctttagggaaaaaagtctaaaggcagttagtgagaggttggtgtataatgaggcctcctgtcatggctgagaatacagttttcaaggttactatggggttccctgggcagggaaaaggtccattcagttgttttaggggctttggatttatttttatttctcagatattaggagaaagtgaatttctgaggcattaggtattgttagtccttgaaaaaagaccttttccctgaaaacatcatcctctcttctccactttcccatactcggtagggctccataaaatagtgtgctcgtgagcacttggtaaggcaaaggtgagttcaaatcctaattcttcaactatgcagttgcatgccttgaaaacactgccttaaacactttgaaacttaactttctgaaacataagatagagataagttatatcattttaataattaggaatgatatataggaattttctaacacagcgtctgacatatagtagataatcaataaatagagatgtaactaataagcccaaacttagtgtcttcttacttgttctgtcttctactatagtatttatgagtgtttgtgttgagggctaaaacataaacatttagatggtattacaatgagaaatctgtagggactatagcactataattattaaatttgaatttaatcatagtcagtgagatcagtattaagttttagtagtgaagtttattaactggatcctttgctgtcacaaatataccagtgctttcctacctaaatgacctatatgttgtgaatggcagttttatattaagattaattaaacatagagaagcattagtagagagtcaaattcactgttcgatcaacaataggcaagataaagaaaaacaaaacaaataatatttagggtacaacaaagcagggacacccttatttttttgaaaattactcttaatattaaaacaaactcaaaatagtcattatagataaaatcaaaacatttttggaccttcttatacttagagtttgatatttcgcaaatttgaattacacatacaggggacaaagctcttgacccctaaagttttgatgaaaatcactgataatgaggctgattaattaataagagaaaatacatacaaatttatttaacttgtatatacaggacccttcagaatgaaaactcaacttcccaaagaagtacagaagcttatattactatcttgaggttacaacgagaatgggggcttggatcctggtaaaatagtttatgagaaggcaaagagaataaattttatggaggggcaataaatgattacaacggaacagaaattaagttgtaaacagtttcctttttttagaacttaaatgatgcttgaagacaatgattatcttgcaaaagggtctgttcagatgtggttagattttttgttttctttcctgtaatggataatgagattacagggagggaaacaagaacacttgttctcctaggcaggtaaattctgactttttgtagataggaaaaaaagtctctcctagtgatcatcgattcccaagaatttttaacttaaaatactcattataccaggaagccatattttggggtgaaatattttgatttccttcacatgtaagactgaaagtgaagagattcattttctttcttaaatctttgaggatcttactccagcatttctcaaatacattttattctccttatatttatatatttttaagagacggaatctttctgtgacttagactagggttcagtggcataatcatagttcattgcagccttgaagcccttggctcaagcagtccttctgcctcagccttgtgggtagacatgctaacatccctagctaattatttattattattattattattttagatatgtggtcttgctatgttgctcatgctagtctcaaacttttggactccagggatcctcctgccttagcctctggagtaactgggattatcgacatgagccactgtgcctggcttcaaatacacttgaaaaaataaattttgtggaaactcatagtttgatacattttaaaatgttaataatatatgtcctactacagaaaaaatatggaagcaaacaatctattttgtttttcctttatgtactaataatctactctttcagtcctagcagattttccattgggctgatcatcttttgagtttttatgatgattggtgattgatgacttgaaattttttggttagctataaaaagttgataacttttgaaagttatcaaactgatttgaatctaaattaggatgctattttatcatatcagtttgctgcattcataatcttctgtaggggcaggttgaaaataaatctcagatctgtcccatctttagtttttcaccgcccatgtagctcatacgtttgccattttattatgtctctattatatacttcctgcctttaatatcatctccaggaatgcatatatacattttagtcagattttcatttaatcagcaatgttatctcaaagctttctcactgaaatcattgcagagatactgaaagattacagtatataatttcaagtactcatgttggcctttaatttctttttcatagtcccctgacacctgatggtttgcacagtcctcagttctttcctcttgtcaactgtttaatgtccatccccagagttctctgctggggctgtactccaaaaagctttttgtgccattttattcttctgaaaagcctactttcttcgacacctataaaactactacctctggcacttaatcatagacattccttattacttgaaattctttgtcctttcatctttcacacagactaatcccagctggaggcaaaatttcagaatatccttaagccagtgttctgctggtgaatctctgacctactgtcataatgctgataaaatgtgtgagggaatactgagtactcacattcaacagatctacagttacttcttaactgtgcaaatttgggcaccgtgtgtctaacttttctctttctcttactctcctgtgtagctttgggaaagtttcttactctgtcttgagtgacttatatcatttatacaatgggaataatgatactcacttcattgaatgaagatgtggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagatgtggattaaatgttaatatctgagaatagagcaggactatagccttctttaacttagttaaatacatcagtgagacagcagagtttgggtatatttggaggagacacaacagaaggaaaaacgtaatgacaggaagtaggaaaaatttaaatgcttcaggacagtgatgcagatccctctgtagatattaggcccctcatgcttcagtgtatgaaaagctcctggcactgatggataatctcatgcctataaatacaaatttttcctttttaaaacctgagccctagtcaaaaaactgctacttaacctgggttgcaactaaagaaacagcatacaaacagttctaagactgagctacttaatgggttttcaaatcagatttgagaagtaaactctaagttgggacatgaatgcattgcataggccttaatgtgctgagtggcaaataggaaatactcaagaaaagtagttattattattattactattaaaattattattatggttaatgtatccaaaaaggtgccaatgtttttgaatgttgctatattttgtctattcaaccccatgagctagtttacaggattactgttgaaccatgattatatttaaaacaaataattgactaaatgtgtgctataatgttatcagagaaaaggggcatttaaaaacagatttttaaagccacattatccattcctttaccccattagaattgtgtggactatgagaagttatctaaatagtaacatttaaagtttagctcttttataagtgccaaacatctttacaacttctttgtctttaaagagatttgtgttttaatataattaaccatttgatgtaggtaaaagagtgcatcgggcaataaatgcttactttttaaattatgttcatttttgtagcttcaattgtgaaatttgagaagtaaacaaaacttgatcatttgacaggttttcttaaaaaaccggaatgagaaagaaattctgtttcagcttagaaaacaactatagtaaaatgggaagtctgttggaatctaattcagtattttacattatttttaagaagactcacgatgccacagatttccagctgtctgaatgcttcccagcttgctgccttggcattgcaattggtatttaatattatcaagccttttatgattcataaatgagccttggaggacctcactacactttgcttttgcctcctgattgctcttttattatatgttggaaaggaaatcaaatatttgtttttcagggaacttaaaaaggctccaggtattatcacaaaaatggaaacactaaatcaaaagcagtttattctaaatgggaattgacttgcacagccatagctttaaattttgacagcacattgtttaattttgcatcctagttgaggaactctagtacttcttgtgaaaataaacaaaaaggctaggcgtcgtgactcacacctgtaatcccagcactttgggtggccaaggtgggcagatcacctgaggttaggagttcaagaccagcctggccaacatggtgaaaccccgtctctactaaaaatacaaaaaagttagctgggcgtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattattattgtatttttaaaatgttggcaaaaacaactaaaatcacaagtataaatttataatttcctatgaccccaaagtgacaactattaacatatttgttaactttgcttcaagtgtctcttttaatgtaaaagttataaaatattacagataatgttgaagtgccttcctcaccataattgtcttgatttagtattttccacatcagtcataaaatataaaactacattttcctcatccctctccaggtgtaaccaaaattgttcaatagtaccatgtaacaggattatatcatttttatttagtcttctactgataaacattcaaaatgctataattgaagatgcacatcttatcttccatagcacctatgcaaaagcttttccataatatatgcttatttcacattgcatgcctgtagtaaaacatctcatgtaccccataaatatgtgaaatatatgaacaaggaattgtttatcatagttcatgtattttctttccaattttgttagcaacctcatccgaaaaacaaatttcattagatattaaaaagatttttctccaaaaaatttttactaatttacatttctaccaatagtttataagaatttctattcctctgcaaaatcattagtacttgagattagacatttagactagactattagagtacattagactatttgaatttggtcaaatagtctggggacaaatagaatcaaattgctttaattttcagatactcataactagccattctttttctccatatttataggctttttaatttccccttctttgaattccccatttacttcattccttcttattaacatatagtaatttattatattttctgaatgcctataatgcaaatattttccccagctaagactttatctcttaatttcattgtgtgtgtgtgtgtgtgaatgtgtgtgtgtgtgttttcatatagaagttttaaagttttagtttgtcacatttagtcattttttaaatggcttgtgatgtttgtgatttgttggaaaaattcttttttaactgaagctcaaaaagatattttcctattttttaatattcttaatgtttttgtttctcagatttagttctttcatccacttgtggtttgtttattaagtccatactgattggacctcaacttaagtgaaagcctgaattccttttacgccctttctgaagcagtacctccccccaacacaccaaattctgctacaacatgtatgccagtaattttctcttctttgtaaaaaagcaacttgaaaagcaagtaatttttacttttaaggagacattctgtgattataatctcagacgatagagacattaggaattatgaaaagtatataacattttttaaaagggctaatatagttatttttaaactttttttctcaacgtgaatttaaacagtgagctgttgaagatataaacaaactggtttcagtgacaaggatattttgaaatttaatccagaaacatggtctatcacagatcagtgtaattctgatttatgctatactagattatgattcattagaaattatcccaggatagagcctcaacaaccatttattgaatatatattctgagaaacacacagtaaccacagcagtaataatagttctcaaatataaatgactatattttattaaaaaaggtatgttaagtgtttaatttttctttcagtactaatataataaagaatgtcttctcatgcagttccaaaattaatattatgtttagaaatatttatatatatttttaaatttaaatttttttttgctgtgatgtattctgagaatacttaaaagaaattgtttccctaataacaatcttctgctaatttgctattaattgcaaaattatagcaaaaaccagagctaaggattattttatttggcaattgtatcatgaattattgaataaatacccccaatgtacactattaagttcctttaaatatgacttctgaacttaagctacttaaaatgtctgtaaaaaatgttttggtcataatttgaagattgagagaaagtaaaatactaaattgacattatagagacctctataaatggagacttctggacactcctatccatcctattaataattttgcccctacaaactggaagcaactaatttgttatgcagtacagagcattgaaacttttccttactgtagtcaggaaatgcttcttaaaaaaaaaaaaagcttcaatgtcttcttaaataaagaaaaacagtttggagtagaagaggcgtgaaattgggaatttcatcgctcaaacaaaatgtatgtaaaaatgaaaatagaaatataaattaagggcaagggaattctgtgaggaagcatgtccaaaatctagtattatttaaagtcagtaataaaaattttgtatgtaatttaaatagtaaatttacaatgacactattgaagcagtgggccgaaaaatttgtttatctgtggtatatggaacatctgtgtgttattaaataataaatactgatttgcatctattactaccataacagcagaataaatgtaactgaaaacagatataaaaaagtggcttttttaaaggtgatattttctttagagcatagagcaaatctaaacagaaagacaaaaaagccccacaaaactttaaaaaattaaaaaaaggaaaatcatagcatgaaatgtattaatgctatagaaatttgttcagtgtgactggattttcctttcacattaaattgcataaagtttcttttcaaagtaaatttgagtaatagaaatttcagaaaaaaattgctcaaataagatattcttcatgatattcccatgtggaaaaaaattcagtattattcattaagcatttttgtgccattcacatttttaggtactgagaaacatacaaaccctgggtgagatgaacattaaatacattttatatactttagatagtacaacaatagagatattctgaaaatattttgggaaacatgagggagtatatctaattttgtcaagggaaagggtcagggaagtctttaagcttgaattatgaaaaaaatgacagatgctttttcaaatacactatttttagtgctgcagttcatttaattgaagcacgtattctacctgagggatgttatcttatgtaacaccacacgtgaccaaaacggtgtacttggtcaggtttatttaaatattttgaaagccaattcaatttaaaatgaactgatatgattcagacaatttgcggagggagaattaacataaagaaagttttcacatcttttctcctaagaagaaaatagatctagttttctcaattaagaagaatttattgaaaatgtattggtatgctaatatgtaattacactaacattaaccactgttgttttgtgccaaaatcatgtgccttcatccatataatttcctgatcacatctaattgcattttaaggttttgtggctcttctaggaaattcagtttgcaaaagatatggccactgaactggagtttattttttacgtattttattatgatagtcatctgatcaagtcttttgtattttttaaacattatccaatttggatcattgaaaatcagaagtaatgtctgtgggaccattatagagcaaatagtctcactgtccagtgtgcacaaaacactggcttttgaggaaaaaagggctttatttgccttttttcgaataggcaagtagtcagcaaggagacaggagtggattcaaatctgtctcctcaagttagggaccccttgcttctgaaagagttttagtattcaggttccagtcatgtcccagttttaccggtatagaggggaatattgattggttttgggtgttgttagagatcaaagctttttctattgtgcatgcctaggctacatgaactgcagattttggttttattatatctgaaaggtaactcaacattttgttaccaactaagcaggcccaatttgggctagtccagtaggtacaggacttattcaactaaaaattcaattatgaatttatgtgacagtatttagtttaatattaaacagcattaaactatcctttatgtccttatattttcacttccatgaaaatgaatgattttgataccttgtaatctactaaactatctttgttcactgtagattaatttgcttttaccaacatttagatttaaaatattctcattttactttgtggctttcaatacatacatcattaaggtcctttcctagttagaatataagctgtgggagggcagtaactatatctctaggacttagcatgatgcttaatacacagtagaaaatgagtgtttgttgaatgcataaatcctgtttttccatccaggccagtttgtccaattcaatgtataaaactacttataatcaggaatatgccacaaatggattttcccaagcattatattttattgatgtacatgttttgtttcctctgtgtaggtgtcaatgtcttgtttgaggcaggaatgatttgattttcttggtatctttcatagcacttgccacaatgctttacacgtagtcaagatggtcaataaatatctaccaaataaatgggtagatataaattatccacctaccctttttttctttccacactaaaggagtgcaattaactttacattgtacgtgtgattacttgaaaccatagctataatattatcacactttccttcagaaaaaaaaattgggtaaagttggtaaacttattaacagagttttgaagtagagcaatatgtcatagctatcgaataatagataaaggcattctgaaacacataatatttaaaacatagactcataaaaagtcattttcaagtatttcttaagcagatactgtcagatatattggacgatgagataatttgagagcacgtgttctgaaaaacagggtaagacacttggacaaagaagttttatctttaaatcctgcaaaataaacatacacaaaaatcagaatttttaccaattatattggcgtacttcaaatgagatttgattacctatatacactatcaaaaatagcatttttgtcaggcaggagcagaaaggaaatatagtacatgctgtaataaaagtataatcaatataaaagtaaagattttagcatcagcatgtgaagaaaaagtcatcctgggcaacacatggtttatcttttaaacatcttaataaaatctttttggatggatcatttctagaatgtattacatgtatttactctttgaaactgcaggacagtgagaataaaccaaactctagatgaaaatttcatgtctgttttgatgctttcataatcattctatttatatatttatttttttaaaagtatttcatgaagtgtcttctttttctaacttttattttaaattcaggggttacatgtgcagatttattagatggctatgttgtgtgatgctgaagtttggagtgtgcatgatcccataaccccgatagtgagcatcacacacagtaggtagtttttcaacatttgccccctttgccccaactctagtaatccccagtgtctattgtactcatctttatttccatgtgtacccaatgtttagctcccattataagtgagaacatctaatatttggttttcttttttggccattagttcgcttaggataatggcctccatctacacacttgttgccacaaaaggcatgattttgtccttttttatggctacgtagagttccatagtgtaaatgtaccacattttctttatccaatccattgttgatgagcacctgggttgattccttgtctttgctattgtgaatagttctgtgatgaacatacaggtgaatgtatctctttggtagaacaatttattttcctttgggtgtaaatccaaaggatttggtgagtcaaatgatagttcaactcagttctttgagaaatctctaaaatgctcttcacagcagctggactaactgacattcccaccaacagtttataagtgttcctttttcttcacagccttgccaatatcagttattttttgttgttgttgactttttaacaatggccactctgactgatgtgagatggtatctcaatgtggttttcataataattgtatacttcacattgcaatcacccaggaatataaaattcgtgtctatccaatttcttattcatggtttgacctagaaatgtggccaacattaacccagtaaccatttactgtattagtccattctcacagtgctataaagaactgtttgagactgggtgatttatgaagaaaagaagtttaatcgactcacagttccacatggctggggaggcatcaggagacttacaatcctagtggaggggaagcaaacatgtccttcttcacatggcagcagcagggaaaaatgctgagtaaagcagggaaaagtcccttataaaaccatcagatcatgagaactcactcactatcatgagaatagcatgagggtaaccacccccatgattgaattacctaccatctggtcccactcaccgaacatgggcattataggaaccacaattcaagattagatttgggtggggacacagccaaaccatattaccatcagttttattctttcacctctttgtaggttcaaatgagcactcatcaataattcccccttcccatcccctctgaatagcatgtactcacctcacattgtatctcatctttttcatcttattccctattatcatttacttactccataattcctcacataaattatgtttgttttctacacaaatattaaatagattaagtaattttatgtctgttttcaatgagaatttaaatcctttgaaagtcagaattttaaattataggttgataataagctgatttatgagccgagctttatgaactgagaaaaacattgaacatatttaaagcagggttcactccttagcagagctgcaaatgacagtgataccatagtgaagatttcttgattctggttctgaatcttagttatataggtccccaatgcttattatgcatttatttaggaagtattgaggtagttaaacacaagtgatttttaaactggacattaattttttttaaattatacattaagttctagggtacatgtgcacaacgtgcaggtttgttatacatgtatacatgtgccacgttggtgtgctgcacccattaactcctcatttacattaggtatatctcctaatgctatccctcccccctccccccaccccacaataagccccagtgtgtgatgttccccttcctgtgtccaagtgttctcattgttcaattcccacctatgagtgagaacatgtggtgtttggttttttgtccttgtaatagtttgctgagaatgatggtttccagcttcatccatgtccctacaaaggacatgaactcatccttttttatggctgcatagtattccatggtgtatatgtgccacaatttcttaatccagtctatcattgatggacatttgagttggttccaagtctttgctattgtgaatagtgccacaataaacatacatgtgcatgtttctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcatcttttcatgtgtcttttggctgcataaatgtcttctttggagaagtgtctgttcatatcctttgcccacttgttgatggggttgtttgtttttttcttgtcaatttgtttgagttcattgtagattctggatattagccctttgtcagatgagtagattgcaaaaattttctcccattctgaaggttgcctgttcactctgatagtagtttcttttgctgtgcagaagctctttagtttaattagatcccatttgtcaattttggcttctgttgccattgcttttggtgttttagacatgaagtccttgcctatgcctatgtcctgaatggtattgcctaggttttcttctagagtttttatggttttaggtctaacatttaagtctttaatccatcgtgaattaatttttgtataaggtgtaaggaagggatccagtttcagctttctacatatggctagccagttttcccagcaccatttattaaatagggaatcctttccccatttcttgtttttgtcaggtttgtcaaagatcaaatggttgttgatgtgtggtattatttgtgcgggctgcgttctgttccattggtctatatctctgttttggtaccagtaccatgctgttttggttactgtagccttgtaatatagtttgaagtcaggtagcatgatgcctccagctttgttcttttggcttaggattgtcttggcaatgcaggctcttttttggtgccatatgaattttaaagtagttttttccagttctgtgaagaaagtcattggtagcttgatggggatggcattgaatctataaattaccttgggcagtatggccattttcaccgatattgattcttcctatccatgagcatgggagtgttcttccatttgtttgtctcctcttttatttcgttgggaagtggtttgtagttctccttgaagaggtccttcacgttccttgtaagttggattcctcagtattttattctcttagaagcaattgtgaatgggagttcactcatgatttggctctctgtttgtctgttattggtgtataagaatgcttgtgatttttgcacattgattttgtatcctgagactttgctgaagttgcttaacagcttaaggaaattttgggctgagatgatggggttttctagatatacaatcatgtcactgcaaacagggacaatttgatttccttttttcctaattgaatacctttatttctttctcctgcctgattgccctggccagaacttccaacactatgttgaataggagtggtgagagagggcatccctgccttgtgtaaactggacattaatttttaatctgagtgtaacaaggatgagtgtttcccattcctcttaatccttgttgataggtgcaattagaagccaatttacaaatcggtggacaagaaaccaaggacaaaacctcaataagagatctcttgtcctttatcttgggggtatttctttttaagtactatcgctagtcatttagaatcggagcatcctttcttagagataataatctacacatactattttttctttcattttgcttggtagaccatcatatatctgctcagccaaaacagaaatgtctcaaagatgttacagtgcaattgagtaggctattttttttttacagaaataactacttttcctaacttaagaaagtagtaacacagtaattatttatttctgatgaaaatttcatttctgttttctaaatttgctttcttcttgtttttctctttacttcttttacattgaatgagttttcttttgactcattgttttttcccctccattaattggaagttataagctttatttctctttattctttaggggtttttatggaaattttaaccagcaaagttaacaagatattgataaccaatattttacccttcttccaaacaatacaaggaccttaggaagcttagactgatcaaccattctgctgacatctgctattatattagttctaatctgattctttcgtgtttagattgaacatattttacacacttgtttgctttacttgccatttattatttatttcttcttatagacagtcttctgtggagtcctgttttcttctagaattacatatatattgtgtgtttatgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatgtaaatagtaaaattagtttgaaacacgaaattgtcatttttgtaggctaaaatgaagtgttacacatttcatataacctaacctgtacatttttcctccttataatgtctttaaaatgtttgcagaagcttttcttaccttaggacctaaatatacaacattaaagattaatctaaaaaagaatctggatccttttttataaataataattgtgatagattcctttctggtatttcacaagttttcttaagaacccagatctaattagaaatgaaaacaagtctaaatgattaaaatatggtttccttagaaaacaaaaacaaacacacacacacacacacacacacacacacacacaaaacctcatccctgcagcaccattcagggcccacttattctgaaagtgccagaggcctgtcaccattgttggaagcttagcaaagttcaaagagagcttatcaatgcacagtgagatttaatgtgcactactcattatcctggtgagaccctttgttaaaatagtcaatttctatgctgtttgtaaggttgtgcagttgtaattcctggatgactgccagaaatagccttagtaacaaaacacccagcatccttctgttctcaaatcaatcagtcattgtgtaaagaactttttgatttataatgaatcttgtggccagtatttttaggttatttcactacactaagtcaacagtatgttacttctaggtatgttattataaatggactcattcccctacatctctatacataagcttcttatgttatggtttgtcataacaggtgaagttgaatttgttaattaaaagagtatgtaatatgcatacaaataataatactagcattctgatatgcttttgtattccctctatacaaattatgggccacttaagaaacaaatgagcttcatagttttcctaaagtaattggtgcaatgttacaactaaacacagacgaacacacacacacatatatatatgtttatgtttatgtttttatacttcacatatatatgtagagtatatatgcatatagatgtttatgaatacatacagttggccagttggccctctttatccttgggttccagattcaatcaactagggatcgaaaataccagggctagggaaggatagttgtgtctgtactgaacatgcagactattttttgcttttcattccctaagcaatgcagtataacaactatttacatagcatttacattgacttaattattataagcaatctagagatgatttaaagtatacaggaggatgtgcataggttatatgcaaatactatatacttcatataaaggatttgagcaccgatgaattttggtattcgacaggggccctgaaacccatttcccctggatatcaacagatgactatacaaatatgacatttatgtgtgtatatgtacgttaaaaatagttttaaaagaataaaaacatctgagtacaaaataagtatttgaatagactaagattcagtattttgtcaaggacaacaactcatgtttaaatgtcaatattaactttgataacttagcaaggaactgatacatctatgtttgctttttttgttgagctctatttttcaattcattgttccttaatacattttcattctatgtggagagataaacagtccatcaaatgtattttgttttttaaaaggctttgtaactgtaacctgtagaatgacttgggaatcagccaagttttcaaatctccctccactctttatttgaagtgtgatcttagacaacttggttatgttctctgagcctcacttctctcacttaaaaaagggcattgatgaaagcacacacttcatagtaatgattaaatgacctaaaatgtatgaagtgcttagaatcgtgccaggtatattatattatattatattatattatattatattatattatattatattatattaatgtactgaataaatgttagctgtcatttgtatttttttcttgatggaaataatagcaaaatttctgatataaatgaaaacataaactcaggcatctcacttcctcaaccatttacccaatttcccatggaaattatcaatagagtaaacaaataagtaaaagtttgcattctcaatggaatctagggatggagccttcaaagtgtcaagtttttttttctatttagtctagtgcatataaaattagagtgaaggaagaatagaaggttggtaactgatccccttcataaaatatcagtgtgtctgagaattacatgggaggccatgagaaattgccatttgtattcccagtagtgttttgttttaaacattaaaagattctgtgttaatctaaacacaatatacctcacaaatttattactattagatattttaaacaattttgagactctctggtctgtttaactctctctgtatttttatttccagaacacattgagctctgttgactttctgacttatcacgctttctcttacaagtcattcgttatcgtctctgaattctcagtgtcctccattatgagtaatctcccttcattcctaatctttcttcattatttgctatcttgtttcacttctcttctattcaaactgctcattccgtagctctgccagtgctggctgctctgtctctcacactccacttattttaagagtctggttcagattcttttgactacctggatcaagcagtatgtactgattattttactgttataaactcaaaaatcttagtagtttatacctacagagattgtttctcattaacactgcttataaagcataggtcagctgaaggctctgttccatattttctcactcaaggactcaggctgatggagccactaccacgtggtgtgcttttacttctgggaagcgaaatgagagaacatggtgaactgcagaccgtctctcaaaagtttctttgcagaagtgaaagtacacaacttctgcttacattccttgatcaaggtaaaccatattactgtgctcaacttaaaggtaagaaaagagtacaatattccatgtacacaaagaaagacaaagtggaatgtagttaaatagccctaatgcttaacctatttcccattgctgttttaattcatggtttctctagaacccagaaaaaaatacatgcttctttgaggctcatttctctggatataccattcctttcattcttatgttatcacctactcactttctgatcacaattacatatgcaccatttattttgggaatggactcatagcctttcactttaagagagccaatttcatagttttatttgaattcagtgtccttacggaagactcatccattaccctggactctatgcttcttgggttcttgaacctctcagccacctagtcctaaagtcacatcatagtcatgatcataacctaaaggacagcgacaattatatcaataatctgaaaattcaaatcatttctgcttgcttgttaatttggttgatctcactacatttttttttttttaccccatccaacccctgagttgggcaactggaagaagctgtattagcatgaaaataagtagccccagaactccagaaactgtgtgcctttatgggctgatactcctatttcggggtaggtaaacttggaccacagaagttcactttcaaatggaaagtgaggtctcacgatttcaagcagtgaaactcaaaaactcagccagacaggcatcagtgacgttttgactttacaagaaattggaggaaattttgtccaccaacccatagcctaaaaataaaactgctgactcaatagggccctagattcatatggcttattttaaataaccgacaagttgaaacatcatgttgtcccttggactactgtggctatctagtgtcagagccaactacacaaaaactaaactgaatgtgatcattctggttagtgggcagaactcaaggctattcttatgtctagctatgatccttgagttgtttccagtgacctgaatatttggtttgctcatcagactagcagattaaatatacccttctttggggtaaccaaatatagaaaaacattgtggctgctaattggacagtttgggtcactaatgagttcagaatctgtgtttatttactgctatattgctctttctcactcataagttatctcaaatattccataaatcttctcctaaccactccactgatctcttgcttatataatttattgtgttcttatagtttctctgggtatttcttgcttcaaagagttgtgtataagctctgggagggatcatgtttaaatatcttgacattcttactctgccaagtctatcagtggatactgattaatagattctgtcatattatttcacagtcgagaaaatagaaatttactgtattttactatgagatatatttatatgaactcttttaactagtgaagggatgataattaccttctgaaattagggatatttaacatttttataattttgtcttagttccaagtcttatttttatatctaaacagaagagtaatttgattgattattacttcattttattcctggaaaaactgcatgaacatatgagaataataagaattggtagcattcaaacatagtagctaacaacatcccacaacatattactttatatttgatatcagagattccatctgaattgtttcaattaaaatatatttataaaaagagagcttagttttccttgtcctcaaaatatgcaacatattgtcttcatttcagcaactaaaaataaagcaaaacaatcactaaactatttactcatttcatgtcttagtagtttattttcagaaaagagttgtatttgtactgaagtcactctacaaacttaggccaaataaaactttttatatatgcatctcaatcttcaaagtcttaaatttaataaccataaaaaattttgtggacttactttattgtttatagttgtgttttatttgattaatgtttttcaagtacttgtttgataaatatataataacattacattttaagtaatagccttgttttggttttatgtatgtttaaatataataattatagaatgtaacaccatattttatatataggtaattatctttggcagaataacttttttcacttaaattgtgatttcaaaagatgctaattacttcagaatcaagaaatcagtaatagctaaatcagaaacagaaaatattagaaacattgtttagtgcagcactatgctcatgaacaataaaaatgacagacatagtaatatctattataataatagaaataatacatatttggagtattgatatgcaagatctcagattatttttaaataaaagtttagtcttttaggaattatcactgtgaagaaaacaggaaatttctgcgtactgatatttttctagggaacaaaagtaacttgtctagtgcattaaatataaattccagctagcctgtgcaacattatcagaacacatctctaaaaaaaaaaaaaatagaaaaattggccagatgtggtggtgcatggctgtagtctgacctacccaagaggttgaggtgggaggatcccttgagcccaggattttaaggctgcaatgagctatgattgagccactgcaccctaccctgggtgacagagcaagaccctgtccctaaaaaataaataaataagtaaataaatttgtcttagtccattttcacgctgttgataaagacatacctgagactgggtaattcataaagaaaaagtagtttaatgaattcagttccatgtggctggggaggcctcacagtcatgggggaaggcaaaaggcatgtctcacatggtggcagacaagagagaatgagagccaagtgaaaggggaaaccccttataaaatcttcagatctcatgagacttattcattactatgagaacagtatgggggaaaccactcccatgattcaattatcttccactgggtccctcccacaacacctgtatattaagggagctacaattaaaaagagatttgggtggggacacagccaaaccatatcaacatttattccatggaaatattataataattctagtatagagaaatattaatatttatgaagcatacaattgagagtgcacaacaaaatcagatttgggtggggaataaaacaaaactaaactaaaacaattaatatcctcccccaaaactctagaaacattttagacccatagttattctgaagacatcagttaagtttatttttcattgtcattaatggcaagtttgataagtttactcaatattatttgaaattattagcaggcttatttcaccattagcaagaaggaggtgctgaagcagcagctaaatctattactttttttttttaaatgatttcctattcatgccctacaagtgtgagggaaatctctgaattttataactcaattgcccactttactttctttctgttgggcactgtgtggtaactacttggtttggtgaaaatgaactaaattaatatttctaaaacataagtttatgtttttgtaaactgcaaatacatattagattttgtatagtatgggaaatatacaatttaaacaagtttaatttttttatattttaaacttacgtagctttaatctcatcagttttttcttaaacaatacctagtgagtgctgacataaccatatgcggtaacttgtttatggtaataactaaaacagttaatcacagagatatttatgaaacattttagcagttattgactattatttatcatagcaaaaattaaaaatcatgcacataaaaaatctcattttttaaaattattttttatccttttatatgatcccagtattaaccatataatccagcatttctcattcatgctgccagagatggagacctcaacagaaacagtgggctgaagttgttggagagatgggagggttgaagtacaaggacgtttttattaaatatccctacctttactactatgcggtctttacaacaaaaatgacccaacagctaatctaaaagaagtatttgggtgaaaaaaaatcaatgaaaatacaaacctcaagagtattctctttggcaaataataataataataataataataataataatataataaagggggtcctgagggtagaattaccatgtgcaatagtgatagttttattcattcaaaaaatagttgtttagtgactactttgtgccagtcactgtactagacactggagttacagaattgggcaaaacagtgaaactccttactcaaaaggaacttacattctaatagaaaaagactgacaagtgacaatgtctgtttatggcacatttcatgaagaaaattaaagtactgtatggagataaagagtgatagaatgagtgttcaggaaagacccctttgagtaattgtcaggcaaatgtgataaccactatgctctggaaaccccattgcgaaagtgacatcaaagcaagcacatgaatgaaatgaaagaataagccatttgtgtgtataaagggacgagctttccagggagagggaatagcaagcgtaaggcctggaaaaaggaatgtgtacactcacttgaggattagcaaggcagacagagttgttgaaacaacagtgagaaagaccagaagaatgatggaactaatgttgataaagccatatcttgcaatgctttgtaggcaaacatgttctataagtcattggaggatactgagcagaaagtggtaatctggtatgtgttttagaaagaaccttctggagttaggatagaaaagagattctagttgggcaagaatgaaaataggggaccagttggagtccattgtaagagttcaggcaatgtgactaggttggtagtggcagagatggtgtgccatgtgtacagaagttgagttgtgttttctttcaagtgtacacagagacaaattatttgttcacattatgcattgtggagagtttaggaatgcgtggtattacttacatgtgacattatattgaatatggataattaactagcttaagtgtcttagttagaataaatattaccaatttattcgtatgaacttactactttaattattttacccattttattaagcatttaacaacatcatggaaaagaaaacaacgtttagaactgattttccagcgttaaactgcaagaacctttagaagtatgcataagatgtttcactgatgagatcatgtattataaaaataagatcattatgttctttgatttctgaaacttcataaagaagaaagcttcacaacatattcaaatttggagtcattgtgccattcatgaagatatgctttgttatctaatttttggtttaagtttccagaaattagaccaataatttttaccattgctttataagatataatcagtagattgctattagttatgtaactctgtaaaaagaattaatctgttctatctagatggttagttcaattgaaattatattattgtacaaataaattttatttctagagtaagactagaaaaaagtttcaattaaaaattctctgagtggttttctttgaaaattttagtaagttaaattgaaactgtattcagcaaacatttactaagcagttccttggtgtcaaattttatcctatgccttagggatgttaggttcattatgatcacaaagatgaataagacaatttggaagagtttcacatagaatggtggaatattaaattagtgcttattaagttaataagatagctgctgtgtaggtgtctttgttagatttccagggagggaaactttaccattccctcagtttagagttacatgctttgatcgaagggtatgcctgccggctttcaagtgtttttactctcacaggaactgagacaatacagttacaataatatgtgcattcaaatttctcatatcttattggttgacttatatgtgaaataaccagaaataacacaacataaattattgctacatgttaaattacatgattctgtttataaattatatacaaattcactgaagagaaattaatgtggatagagtattcaggaggaaaagaaccagagatgtgtcttatagaattcgaatactagagaaaaaagaatatcattttgggcagggaaataacaaagccagtaaaacaacagaaatggatatgatatatttgaatggttgtacagaaaaatagtgggaaatgagcattgttaagtcatctttggagccatactttccttaagatctcaggtttcgggttagctattctggttttgtttttcatttgtaaaaaggaaatcacactacaaattttgtagggttgtagtgagtatcaatagaggtgaaaatcttccaaataatatagcacatttttccctcataatagacacattaatgctagctattactatgatattcatttttctttccccttccaccttcccagtccagggctgcaaacacagcaaagttgttttaacacaatatatctactaactgaggatatggtaaaaacaacatattgttatttaaaaatatataatttattttttagtgaaatttgaggtttacagatgaattgtgcagaaagtagactttcctggaccccctccctttccatttccatacacattttcccctattattaacaacttccattagtgtagtacatttgttacagttgatgatttattattgatacatttatgattaaagtccatagtttacattagagttctctctttgtgttgtacaattttaatgagttttgataaatgcataatgtgtatccaccattatagcatcctacacaatggtttcaccaccctaaaatccttctgtgctccacatattcagcactatctcaattcttttgaatccttggcaaccactgatcttttactgtctctataattttgccttttcctggatgtcatataattggaatcataaagtacatggccttttcagaggctctgaacttgaccctctaaattctctggtgtctttcacttagcaatatgcatacaagtttcccccatgctttttcatggcttgaaagctcatttatttttataaatgaataatactattccattgtatggatgtaatacagtctgtttgtatattaaacttttaatgaaatgtctgaatgtgtctatctgtatccttttttttaagtggctaatatctttcataattaaaagtattatagtattacataatttctatttttctctttcatatttggaatagaatttttattttaagcaatgctaaataaattttaaaatttaatatatgactattcaatcctattaatatattcctatattacaacttttttggaataatgtagctgtgttcttttaatatgtgttatttgaatttttttctaacttttttgctgtatatgaattagaaatattttaccatttttcaagaatgcaatatattattacctataataatcattttatacaatagatctcttgaacctatttctcctatccaactgaagttttatttcctttgaccagcatcttgacaacctttcccgctacccctataatcagcccatcccctagtaaccaccattcttctttctacctttttttttttttttttttttttggagacagagtctccctctgttgcctggctggagtgcagtgttgcgatctcggctcactgcaacctccacctcctgggttcaagtgattcccctgcttcagcctcccgagtagctgggactacaggcgtgtgccaccacacctgggtatttttttttttgtattttagtagagatggagtttcaccatgttggccaggatggtctcgatctcctgacctcatgatcagctcacctcagcctcccaaagtgttgggattacaggtgtgagccagcgtgcctggcctcttctctctacttctatgaaattaattttttaatattctatataagaagagagtggatgtagtattttcaccataaaaatgataactatgtgaggtaatgcatatgttaattagctagactagtcatttcacaatgtatatgtacttcaaaacatcctgttgtgtacgataaatacataaaattttatctgtcaattaaaaaataaaaagttaccactttatagcatattcgcttatatggtttgtatgtgacaaaattttgcttttcatgtgcctaagagaaaggaggttacagaatgaagtaacacatacataaattgtgctgtgtagtcaaccctccaaacacagacaaactactactttatgttcattttttacctgaagtctatatttcttaaaataccactgcattagtccattctcacactgctataaagaactacctgagactgggtaatttatgaagaaaagaggttcaattgacttacagttctgtaagctgtataggaagcatggctatggaagcctcaggaaacttacaatcctggcggaaggagaggggaagcaagcaccctcctcacgtggcagagcatgggagagggggaagggggaagggagaagtgctacacacttttaaacaaccaggtctcctgagaactctatcaggagacagcagtagaagactggtgctaaaccatcagaaaccacctccatgatgcaatcacctcccgccaagcccgaccttcaacacgtgcagattaaaattcaatgtgagatttgggtgaagacatagagccaaaccatatcaactactttatttctgttaacaaagttgttcactttttcaaacaatttttagtttctcccttacgtcttagaggaagtgctgtttccttcctgcagaaaatactccctctgtctgcactctacacctgaacctctagattctgaaagactgtaatctatcaatcactagagttgtttctatatatttccctttccatctgtacaaattattgaatgaatgaatgaatgactcttctatgattccattgttggtttttgagatgcatgtcatggttacactctaggtatagattcccacaccttgactttatatcctggttccaatgattaattaactctatgaaaatgaacaagttttctaacttcgcaaggtttcattttccttatctgaaacaggaaataatagtaggattatgtaagttttatggggaatgtgacaattcctgtgaagttcttaacatagtgctgttgtacagcagctacctaaagaatattagcaattattgttttaaattgatattttatttgatttatgaatatgaaatgtgatgatgctctcccccagaatttttaaaacctttttcttcctagtttttagagaaatatctttctccgtagcccctctcaaagatactctttccaagcatttcaatgttctttctctgcacaccaccaacacacaaatgcacaaaaacacacacagagaataatattgtcaacaaacttttctaagtttcttcgttaagtcctttgacattgcctgagacaagaaaacatggagggataatttcatttttttatgtctttctctaactcttgacggtgaacattttgttctttactctttgaaagtttttacatttattaataataaaatgaatgtagcaatatagcttctcatcacagatgctttcattattttaaaatattgtaattatttcttacaatatattagagcttaagttcatctttgacagatgattataacctggtgagtgaaaagcattactaattcaacatatttaagctactgtggaaaattagcaactttgtgaaaatggaaaaactcatttcctaatgcgatttaggcaaggctgcaaggattttcattaaataatataaaacaaattagagggatagaaacaaaattcagaggtagtaaacagaatcacactgagagatgtttcaaacaatattttaactatttaaagactaaaatcttttaactgtattctatattttaaaatcagaaatgtctgttaattctcagctatataatttgatgtagttattattactattataatttgaccaatgtattaagaaaataattaatattaaatagatttttaaagtttaaaataaaagcaattttgaaaagtctagtagcataattcatgtactgagtgtacaatagtttcttcagttttttaattctatgaagtttttttttctatatctacttccaataaatgctgatttgctaatctagaagaacatagaaatgattagtgcaataaatcagattctttacttcagagtaaggaatgctttaaattttaacataatcgttactgaggcaattaagtgtaaagcctttgttttatttaatttgattactgattttttcttgtgactgaaaatcaattttttctctctttctttctttcttttttttttttttttgtttgtttctgtctacagaaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaagtactttattgtcattgacatgtagggtatgtttcaagtcataggatcagaagataaaatgccaagctggcaaggtggctgatgcctataatccaaacactttgggagcccaagataggaggattgccttgaggtcaggggtttgagaccagcctggtcaacatagggagactctatctctataaataataaaaattaagaaaaaatgcctaaatgaaaaatatataaattttatattttaatagtggcctttaaaatctgtgatacagatcaatctatgttgatggtattactttattttactctcggaggtgtaaatttataatcatgtttatttatgcctacctcactatcaaactttcaactgatagattgtgtcaatatgatttaatttaacttttgctttaattaagaagattagtattgtgcctcaggactgatgactctattgacatggagttaagccacatattcattatattctttgaatttttacgtttttttaaatatcaaaaagataactctgaattaaaaatcaattagaattctacacataatttttcatggagataaaaatacctataaagtgtacatatatatatatatatgttttgtgctgtataaacaaaattaaatatgcagtgccttttcaattacattacatggattcttttgataaatttatcagtaagggtatttgtaaataatcgaactcatttttcaataaggaattaaactttttttttttccaatgaagtaatgtattttttttctagccataaaaatctttagttcattcagttaaaaattgatttaaatcaattagaagtagcataatattggccgggtgtggttgctcacgcctgtaatcccagcactttgggaggccaaggcgggcggatcacaaagtcaggagattgagaccatcctggccaaaatggtgaaaccccgtctttactaaaaatacaaaaattaactgggcgtggtggtgtgcacctgtagtcccagatacttgggaggctgaggcaggagaatcgcttgaacctgggaggtggaggttgcagtaagccgagatcgtgccactgcactccagcctgggagatatagcaggactccatctcaaaaaaaaaaaaaaaaaaaaaggtggattatatttttatatatttgcacacagataattttttacatatttatatgtaattattttacaaatgcattatttttacctaattagttagatattaagaattgtgttcttcagataattattatttgcatttgcctaaaactatgtattggaagcatattgccatatagcatttgaagctgtacagtagagcttattaaaattttatgtgacttttggggttctccccacagtaatgagaatttgaagtatgaagttcctaacattttagctccagctttttctaccttctgtgaaaataaaacagccttcacattttttatcatctttagaccaactgcatcttttttatagtgacagacacagccactctagtttatgtgttcagagaaataagtgcaagagtttcagattaagcaattcagtgcctagaaaactcttcagccagcccacaggtcaaacagaaaaataaatactccaaaatatacaaaaagtcttccttaatgtttgcatgtacccttgtttttttttaaattaacaaatttcccaggaggatagaaataaagcctagacgaaagtgtcatgagacaacttcgaggtaactgtgtgggcattagtcaagctgaattaggtctaacagtacttttctggaggtcttagacacagagttttgggttacttcaaatttgtattaggaaatttagttattcctaattttccaagcccacggcttttgaagttagattcaaagcaaatactgaaacatctggtttcctttctagcttaaaaaagtacatttgcaaatagaggcatatggatggatatgcacttatctaacttttcaaaatatttctgtaactcacttgataaaccatcatagacagcatctgtataattatggtaatctgtactgattttacgtgaaagaaattcaagtatgtcatcctatttgagaacataaagtcagctaatgtaccagttttttttttactgctactgcttttatattttgaaatgttactgttatattttgtcatagtttttaagtgaacagataggaaaatgatactatttcagcttcttattccacaatttcaaaacaaattgcctcataaaaaaataagtttaaatcatcatttatgggtgaattaatagatattgcattaagtaataatggtagacaaactgtattaagcaatatataatattagagattcttggtaaagtaataacacaaggataaatattttctggattttctcagaatattttgttcaattttcaatcttaaaataatcttgtttaaaatatttctgaatttgaaaaaataaaactgaaaaatcagattaaaagcaaagtctgaatatggtcaatttaaattttaaattctgaacatccaaaaatcaaatgaatttgtttaattaaaatatactctgacatagtattgaacttttactataaaagaagtttgtgacatgcaaaggcaaataaaatgttcaagtttaaactgtataatttaattgcctttgtaatttaaatggaatcactatctgttagaatttaaaatgcatttattttaatgcttcctttagcatttttattttacctatcgaaaaaattatgtcttatgtcatatagaggtcactgatatactcattgacataattgttgatatcataattaatatggtattttaagtatattctttgtctccataacaattatagataaaagaaagatcatgtttcaaaaaattcttaagtatgtattttattttcattgaaggtcacagaaacaaaggcataaaataactaccactttaataacagatttcgtatttattaattattggaatctacataatattaactgttagggaattatgtaatacttaggaataaaaacgctgtatctcaaaactaaattataatgagtgatttaaatattgtcaaaatttctcaacattattaattttacttttgttttggtcattatctgatgtcatttctgttattattattacaattaacctgctatatcttcttagctaccaaaccacacctttgattggttttgtttcctcttttgtttaattattctatcaactgctcactcaattagtcaaatatttgttgagcctctagtaagcactaattagatcccataaaatattaaacatttatttctcatttattcatttatttattcaacaatatctattggctacccgtaagtactaagagttgtgccaaatgcttgaatcccagaatgaacccaactgaatatgttattttcactaataactcacaatcagtgcatatatctggcaatatatatctattacccttgaataaatttataataatacttaaatcatcttaaattctgtaagaatgccatgtattttaaatacgcttttctgaaaaatatcttgtaatatatattttgctggagagaaacatacaactagaaaggaaatatgaggaagattgttatgttgtcattagactactagattagaagcttattgaatatctgctctactatcatattaataatattaattttattacaaattaagatctaataataattgttagaatttatgtttttaaaattggatttaaaagtagattattttgtcaatgccttttaaaaatttcccctcacatgttaagaaaaaatatctaagaatacttaataaatgttttaaatatatttaaccaatactgagaaggagatgtatggtgttggtttttgtctccatatagttttatattttatgatctcctgtaagcagttatattattatttatagcataatgacataatcagcatgcttatctgaattagctctgaatgttaattaagagtaaggattagcctgggatagtgctttctagacatagaatgaccttatcccaaaattctaatggtagctctttgctgacagagaattaggaagaaatcttgtccgggatgggttcatgcttactcagattttcccctaaatgttttctcctcctttttctttctcttttctttcacctaggcatatgattatagagatggcagttagtcatataaaaagtctggttagggcacccaccccttacattaataataaaatatatttttcaccttgcttcaaatatttattttattaaactaaagctactattgatataatagaaaatgtttataaaatgactccattaaaattcccatatatgttaggttttttttcctcttaaccatatatatctccaagaaaattgagctgttctgaaattcattattggtctagggttcttagcagtttgatgtacagagatgaataactgaagaccaaacctaaaagaaaggaataatggtacacacatatccctccaacaggattgatgtaaccttaataattattcactaagtctttaatagtgcatatcttattttgaaattggcatttacaaatacaaataaactttggagaataaattactataccaaattttgcaatatgagtactattacataaaaatgcattaggctatttaaatgaacaaatgattagggtcaaatagaggagaaagtgtaaaggaaggcaaacagtattaagtaacctggacttcttagctagaagagtaaatcaaagaatattcaatgtgttacatgcataacatttttctaagttaaaagaatataggaattttttgtgcatttctgtatataattgcctttaattatttttagagtattagaatattatctatcatattagtgggttaggcagcagggcatggactccccagaatctactcaatggtttattatttacagtgaccaccaacactgtcttaactttatattttggcttaactgtttgatggttgaactgactttagaaaaccatatccaaagtgcttacattaacagctttgatctcagctatggactagcgtgcaatagctttcatatttttgtcacagtgatgggtgacatttaatgtacggtgaaggacaacattgaattattatgcacttaaaaatagataactgttttggtgggatgttcagtgttaaactaatccgctgtcaaaacgactgttgtcacattaaaatgaaatgccaattttgttgtttgtctttgccaccaacttgccagctttttaccaaaaaaaacgatttcaattttaactttccataacataactttagatatattttatttttaatgtcctattttttacttaaataaattgcagaaaagcctatttattattattcttcacacttagcaattttcctaaaatttactgaaaatttagttttaaatacgtgctgttctgctaatatgcctgtcacatattaaagtgattgctaaaattgattaaatattgacaaatatttatctaaattatggacctaaaagtaaacattgatgaaaattagatatattttcaaactgtggattaaaatatttccatagtagatgaggctacttctgcactaaataatatttttaaaattattattttttgttacaatgtacctctttattttagtggttccagtgatgtttatggttgcaagtatatgtggagtcaccaacccagaaaaaattcttagtttgtatctttagtagaaccaaaccaattgaaactaagttgaatcaatgacttcttttcagttgtgataaatatggtattgaggtaattgaggcaacagagctcttgactgaaagtatccatgtaggacaaagaagataatttaatcttcagaggagaaatcaaacatattttccacctctcaatttttaaattatgccagacatttacaggtgtaaaagatttgagaaaaaattgagtaagacaaaggcaatttaaaattaatgtgctttttctgtaattttctgtaatcaaatgctagttggcattttttaaggataaacatgcttatttattttttagaagtatctacatcaatctacaaattatttttttcacataaatataatttattgttaggccaaaattaagtataaacgcaagagcagaaatttgatagcccatctttatttttcaaattctatggataaattattggcctctgtatccttctttgcctccatcaccagaattgagtggaaagactcctggaagcaaaaagacttcctctttctagtcattttaagtgtttccactggaaaaatatcttggccaatgaacttctgagaactatggtcatctgtgatgatttgtttccatttagaagtttcataatgtctagctcagtaaatcacaaaattaattataataagttacagtttatggggtgatatgaagaaactcagagtgctaaaacttgaagtacaacgcttattaaattcttatatttgctaccaaaaaatggcacctctgttcttaatcaattctttatggaacatgtcattgtatttaacacacacacacacacacacacacacacacacacagacacatacacatgcacacacatctgataagagcagcacacgtataaaaaatttttttaaagatttggacaatggagtgtagtgggttctttggcagttactaatgtgtcttttatacatttctcactagctaattcaagctgagaagctaataggacaagaataatactggtttatcttccactttattctttttttctttttcctttcttccttttttttggaccagaataaatatttttttgaggtgtcttttaagaaccaacaggataaggaaaaacaatcattttttaccaagtgatacactttttcttttatgttttgttgtttctagatagcaacattttttcatagcggcagaatactgtgaattgcttgtaagaatacacctctccaggctggtctgtctgtggtaattctcaaaacaaaatttcacttctgttttccatagccactggaaaaatggtgcccttggtctttttggaagctttctcagtcaacctaagaaaggtcttctcaatctgaaacaactattccagcaaaatcagtggctttaaaaaatttcaatttttttaaatgaaatattttaatccacaatgtctagtaaagacaggcgacatcttttatatgaacatatacctttaaaaagtgaagtctgtgcaggaagccagtgacataaagataatgaagaaataaagaattgtttactaggtatttttctttcattctgtatgtcttaatgattaggagtactgtgctcataaaaaggcaattgtcttgagaaatgtagaaaaataggtcagtattttttttctttaatgccaaacatgacacttaaattagttacaattttacttggataaagctgtccttttgctgtaaattatttggggtaagagtcctttcaaatggatggttgtctatgcagtcttgtaccagagtggtgggtcaggtgagggacaattgagagaaaaaagaagaaaactaatacgtattgcatgtcaacagtagccagattatatttgagaactataaagagattcatttattacctttttttaaaattagtaactgtgtgtttttatgatatgatttaaggaataaatacatatatagcagcccccagcccctcaccctcaccacaaatgagattagagatgttttctttttgttgaatgctgttattgtaacactttttaattttaacttattatgaagaagaatgtgacactaaagaaaaaataaatttagaagaaaatggaaaacatattcagaaaagcatttgtatcacttgatttgttttgcctatcatgttaactttaccttctagtttttcttcccaaaatttagaaacttggcagttttttttatttaaagtatgctctattaaatatttttactacatgttagtagtatacggttttacagtaacagataattccttgaaaaaaaaatccttagttagctgtacttaagaagtatgtctttttctttagattgcaaataagaaagcttgaaaactttccaatcaactgggcacctagacaggagacattagcaaccaaatgtgtagatttgctttataaagctagtctctggaaatgctaacactttttccctgaaaattattagctacgtgttataaagctagtctctggaaatgctaacactttttccctgaaaattattagctacgtgtattaaaagaataaaacaacattgtgagtttttctgaagactcaagtggtattagtattgttttttcataattcatggatatgagagaaatatcaatgttaaataataatgtacagacaaaattttagtgataaatcacatctttctttatactaagtaaaattatgcactctatccaaataattaatgagtaggagatatagtgtcatcaaccagtgtaacttcattcattagagcatctcacaacaccttaattgctataattttttacattccattacataattacatcattcaagttaaactgttttcatatcaatcctgttgggtatacatatatagaaagagagaggtttctttttgttgtttttgttttttttttttttaagaaaaaatatcgtggctgtcctaaatagtaatgggaatttcaatatctttggatagaaatatcttggttgatctatttcgtatataaatataattagtaaaacaaatgaccatgcaaactattctattaacttttaatatgtatagtttttctagttagctcttgtgtaataaagctgactatgaaaatataaagttatctctctaagaaacttgttgattttatactcatttttgaaattttgtttggaagcccagaaattcacgtttcattcctaatgacagtaaaccatattaatgaagttattatatgtatttgcatttcaagcctatagttattttttctattttatttaatgagcattgattgaaacagactttcagttttaataccttctaacttatataaaggatgatttttctctttccccgcctggatataacatagtttcctgctattctttataagagatgttaaatcctaaattaattacttttaacatttcgctttctcatgggcttctgactacacctgagatgataaaatgagatgaacgcatttgcagtaaattttcctattaaatggataaacttaatatttgaagcaaaggtgaaattgtaggttttgaatgttactggcatgataaagttataaacagaatagggctacaactgtcatctaagttggttcagaatatgcacctgaatattattttaacataataaaattaggtaagtgtttccctgcttcccttactattcttggtaatggggggtgctgggaggtgtatttcagtataagttcagcaattcactagactgaagatatgttttggaaactggtaataatctagtgattttacaaaataagaaacattaaaaatagagaaaattttgcttgtaaatggacatacaaaaataagattcatacttagagaaatgtgtatttattttaaaatgttgatattactacttcaattttcaattagagcttcaatatttaggaagatattaaaaataatgttttaaatcatccacctaagaatttaaacatatttattttggagccaggcgctgtggctcacgcttgtaatcccagcactttgggaggccgaggtgggcagatcacctgaggtcaggagttcaagaccagcctgaccaacatagagaaaccccgtctccactaaaaatataaaattagccgggcgtggtggcacatgcctgtaatcccagctactagggaggctgaggcaggagaatcgcttgaacctgggaggcagaggtagcggtgagccgagatcgtgagccgagatcgcgccattgcactccagcctgggcaacaacaacaactacaaaatatatatttattttgatattttagttgaaaacaaaagtaatacatgatttccaaacatatttcagttgttttaggtagtaaactgtgtatagaatgcatatatataattttaaaatattttattgatttgtttgatacaatagagtgtctattttcaaaagacatttccaatttatttagtggggatgtagaaaacccacaagtcattcagctttgtgaaagatgttataaaaattatttttataggtaaaatttcctgcaaaaaagaaaactttacgtgccttatatcttgatggtagctgtggctatttttgtgtcatccagataattgcatattagttaattcaatttaaatggccagatgattttatcctttccaatgctagcttcaagtccttgttgataacatcatttacttactgagtgtccttgtttttttttttcttaaaaaaagcatagttttattttttattattagaaatctcttgaccttctgacttatctgaggacagtctgcctgaagtctgttaattctggatttactgctattaaaatccttagcaagtttttactgcaagctaaacatttgcttttgacctgtgattaattcaaatgtaaatcactctcatagttcttttaaaataactactttttaagtttggtattttatttgcaaataaatagctatattggtaagaaataattttttacaagacaaacctatgtttttttatgtaatattatatgtgagccattttccttactattctcaatttaaagccactcttaatttgattggacaattgggtgttttagaaaaaaaatgtatattgatagccagtgaatggaactacatgatagccattgtatattaaaaaatagaatccagttttgaatgtctaattatagtttttattttactttgacatttgtaaaattgcctgaattcatggcaaacaatattatgacttttcttcagaaatcttattataaaatgatcaatagatgattataataatttgtaatcccataacaatctcataaaataataatctcataacaataaggaataatcttggctacattaaataaactaaaatacagtataccattataactttaagtaataagaataagtcataaggatctgtaatcagcttattgatgaagttaatttcctataacaaatataaattttaagtggaagttagaagtcataaattctaaagttgattattttattgtttttagttatccatttaagactaaatcatatttatttttcattaagattatgtattttaaaaaattgaccacgatttaaatttgttatcactaacatattacaaatcagtagaactgatcattgttatcatttcactaagcctttcaaattcatttggatctactaaataatacatttaatagcatattattacaatgttaggtacaaaaatccttctacttcaccatgtacatctggtaactttctggtactaacactaccaattaaataatgtcgagcaattcatgaatcatctataaaattggcttaaaaatttaatataaatgatatttattgttcagtgatgtgatgatagtttaataattggctatggcagtgaaaagggctttcctttgtagcatttgccaattttcatagtttaaatattcccacaataacaaatatcaaactaccaatgggagggtcaccgaatacagatttgggaaaagagatgcaaaattagttattgcaagccagaatgagcaggccctaggataccactaatatgtaatatgttcaagagaagggaaaaacagtaagctgtaaaagttaatagcaggtagttcgggtggaatgtattgacatacaaatatacacaatgtatgaagaaggatatgtggaagataatgacaaggttgtagagccttgaaagcaaaagtaaaaagttaagttgttattaagataattacaacctcggaaacaattctaaacttaaagtaaatgtcagtttatcctcttgctcatttaaataagtttatacctaaacaattagcataacatttttgagttaactgtatatgaacatatctatggacaagagaaattataccaggaagactttagctatatgatgttttcagggaatgagtcattgtgaatattaatgttttcttaattattgagttttcaatactaaattacaaaaatttaactatttacatggaaatttttttaactacaacatattctttcctgcttataatttttaaccaaaagttcttaaaggaataaaactctttaagataatttagttgcaatattataaacatcaattatttttacctgaaatttcagtaatagcttcagggcctgtattagaagaaataggttccctcgcaggtaataggaaacttcaccatgttgtttgaattaataggggatgattgtgttcatagtctcaaattagacaaaattgaaacagcagctgaaaggtgttatcaaggaaactaacacctctatctacctgctacatcattcttagagacttttatcctcatagttacaagatatccattgaaaggccaggcattttatctgtatcccaggctgggaagaagggagaaaagagaaagagcaacctgcaaaagtcttcacctttttattcagaaaggagatgcttcctctctgtatatcttattaactagaattattttgcttagatcgccctagctgcaagagaggctgcagaaatggctttcttttatctgagcttactgccacttcagttcttttgttagaaaagtgatattattgggtatgttattggcagtggctgcccatagggatttattgaattgtgaagtaatgattcatcactcatgcaattctctcaaaatttttatttcaagtgctcatttctgaaattttctttttccttcattgtcatcagttatcagaatgcctgtctctaagcagtataactgctcccttcttgtttgttattttaaaccacattttctttaaaacaagttaatgaaacgtaaacaacgtatgaatagtaagtgcaagtatttcatgtcttagatttctgttatactttctttctggttctggtttatattgttgaaattcaaatttgccgaactagttttgtgtaagaaacatgaatcattactctaatattttaagtgatgctaccaaaatgtaaatttttaatgttgtagaaaataactctgatttattttgatgtgggatattcaaatacatcaatgtttttcccaacttctctatagccatgaagaagttggagcaaaaaaaaaaataatagttggtaaattgatacccttcataatgcccatataatataaatgcatcatagcatattttaggagagcttttacaaatcatcagatactaagctgtttctaggggaaaatatctctatgatcaaataaggtcaggagaactatgtagtagagttttcttttaggaattcactattaacaaattaaaggctctgaaaattcttgcaataaagaaatctgattaggtttgttgaactagcattgccccaacacttagccatggggccttttttttttctctgttaatctattatctctaattttatgttctctattagttaactttctgaatcaaagatgtgaagcattgctttaacatataagttcacttcaatttttttatcttcatcgtacacattctaaattgattaaatcacttgtaacaagactaagaatctagtctcctgattcctaatggaattatcagtgctcattttgctgatgtacatggaagcataagatcgtgtcacatctatttaagtgatagtttatgacttcatagaacttgtgtatagataacaatttgaagtttttaaaaaaattactgaaacaacatcattgcttcaatttttaatgtcttcttttaagaaagtacatacaataaatgtgtaaatttacatttagttataaaattaaagacatttaattttttaaaaaaatggctggtcttaggacaacctgttattatttattagtgaacttggtcagaaattcaagttttgttattaatcaaaaagataatcattggatacttaagaattttctaaatgcataaaaatttatgaaatcattagaaagttgggaaaaatcctcacaacctagcaaacaaattcccctttttaatactgtcaaatcataatttggaagcaagcatatgattaatgtaaagtccaattttgttagtattattaccttctgtggtaaaggagaaagtatgttagaaaacagttgataatttattttgtgtttattgcaagaatgaaattagttatctattctttataaatgatcagtactcaaggtggattaattatgtagattttaatttcatccacagttgtgaaactatacattttttacgattataatctttttgttggagtcttattagtctagcttatgacaaacaatgtacaagcagaactgaaagaaggtcattgtattttaaatctcatttacatgttagacaagaaatgacaattattaatgttctacttttggaatacaagtatatagtacaaaaagctaaaagagaagtagtgaattcagttcatatgtgagtctagagtgtctaaaacttgactgtagtgatattaaaatggtctgtttagagacaactagcaatttttatcttcatgtctctagtttgctcatcttgtgtaggttggacaggtagcaattttgaatggctcatcttaaaatgaatgcaattatcaaaggattatatggtccatcctgcaaggcattcactcattttaatctttcatttgcagctttctgactccttttatacaatttcatttatagttaatgggaagtgttatagcttagttttagcttactccaaataaaatatgtcgttagacaaaagcttcataaatagcagttattctttctcaaatttgaccaagtgttgtttgtttcttaaagttagtaaagttatattatttatttagtttgtgatcataacacacaaaacagcatgtatccaaaacattaaactgattatcataatttatagctagattgagattatataaattcatattccatcctaaacattaatgcacttgtttttttatttagtgatcttttcaccacctaaaatttattactactacatctatcaatcatctacctacctatttctattcatccatgcatcaatttatcaataagtattagcatataaatcagtgtgcaaaatttattttttaatgtctcgctcattcataatttctaatatgtatatatttggaataacctgccagtcactatacctactctttcagaaataaaaaatggaatttttatttattgtttgattaaatggaatagtactacatggggaaatgatgactttatgaataaatattctggataataaaagtagtttttactagagcaactaaagaaaatatgctgtagtttaatacagcaactaaaaatagtttgattttcttaactcaaatattaaagtgcgtttagatattttattgtataataaatcatatacaaaatattgtttcaaaaattccactcattgagagaaattaatgattaatgttctacttcttttggaatacatgtaccatagtacaaaaagctagaaaataactagtgaattccgctcctatgtgagcctagaatattgaaagcttgactgtagtgatattaaaattgcctgtctagagacaattagcaatttctcttttcatttttgacccagggaatttgaaggacttttgtgtgaaagaatttcctgcagattattaaactttcttgaatcataactataaaacaagatctgtgtgtgtgtgtgtgtgtttgtgtgtgtttaaaccttgggataaagactgtaaactccagagacttaaaaccatttactcccaaatttttgagtatgctctcactaagaagtgtggagaaatgcaaacgtaatgcatgttctgtctaagtggagggatttaaaatttattattgggaaaggacaaatgtacatgggaaggcaccagatgctattcaattagtccacctgaagatagcactgtaaaaggcataaaaagcaggctcaagaagtagttaataagaatggatggcatttcagtgttgagaattgcctgcagaggatgtaatcctaatggtatatttgtctataatgtatctaaaaacaatacaccggagtacaacaagtagcaattttatttgtagtttctgcctctattaaccacctgttgtctacctgagatttgatttacttgacctcataaatactggtccgcactagagtgtggtagcacagcaaagaacaacaaattgttgattgctatttttcctcatatgttattttacaaacttatcacttgttgcacagttgtgaactttgtacaaaggcaagaagcattttgaataacatggtaaaatgactacaatcataaagattttgctaacagtttctcagagatttgcagtataaagctaatgaaactgctgaatgtaattctgaaaatcttctggatatgatattttgaaagcagaggtataaagaagtgtatcaactgtacaacatgttaaggaatatatattagatatataacatttaaataagacattgggacataggtattttattttctaatacaaagtcttaagttcttgaaaaacttttaaatagaccaaattaggttagtggaataacaagaatagtttataaacatcatctgaatgctttaagacatttagggaaacttaattgtgtgattaaaaacgataaaagtgcatacagcatttcaaataaacctatggagttctaggcccctgtctgatttaaaagaaaaaaaaaagctgagcatatcattattggaacctcatgcttgaatgaagaagctgaaacttaaagaaataagatgacctaacaagaatccatatttaatcatagaactggagccagattggtgaccgcctgcagtgcaccacagtacgaaagcaacatttagccacccagtgacagaactttactttcacaactgtaagtaaagttcaaagtttaagtcttgagcatgcaggactttaatactcgtagctaacattgggttttgcggtttttaagaggaatctgtttcttcataatatttaatgttactttaggtattaggttattcttttttatctttttttctttcttcttttagaagatcttaaaatggtttcaatccataaaatatgactacgacataaactttagagttctatcagctatgtagtgtgtagcaatatgctacattttagtttttcacttatttcctcatttatcctttaagacattaagtagacactaatctttgtgcattcactcactgtttttcagggtctttggaattttcttcctcctctccccttttatcttcctcctccttcttcattttctgtaagaatgaagagcacatttctgaatttcccctttctttctcttcctactgtttcagtagttactgataggagcttttcagcatgatttggccactgttttttcagtcctacatcattctgtccgagctgtcatttagtaaagattaaatttagaagaaaattttatttattatattgtatttggttgttttaaaatataaataaaaatttgaagctggactagatttaataagaaattgttgagtcattttattatgtgcagctagtaagttggtgcaaaaataattacggttttgccaaaagtacattaaaattaatggcaaaaaccacaattatttttttaggcaaaattatttttaggcaaaaaaaaaattaggcaaaaaccaccagcctaatatttttacatactagtatttatggaactttttccttattatccttcatgcagcttagataatatatgaatgtttatatctaagctaacttgaaggaggaaagatttttgttgtagtcaatttacctattccttgattattatctttttagtacattacagataaatatatttacctataatgctatatttatataaaaattttaggacctataagttaatgttaccataaaaaagatccagggaagagaaagagagtaaatagatattagaacttacaagaaatagtaaataattatatagaataatgtaggctaatttattaaacttgctgtctttcaattaataaatttgcaaagtgtaatatgcttaacaaatgagtgcatacattcaagtaaaaatatttctatgaaaagacagataagataggaaggataaaaatggagatataatgttcatagaaagcacattcagacaaactaaggcaaatgaaatatcaatcatattgagaacatcataaaattcttttggaatgaaaaggtgtttttatgcccctcccttgttttatacataagataactgaggcactgagtggttgaaagacatactagagatcacacagtcaaaggtacaagaggactggaaatagggctctcaactagtatagaaattaaaggattctcttcaaaaaaataattttaaacagtgtttgaaattattagtaaaacccaacttcaaagtaaaaaacacaaaggttattctgtaacttttattaaggtactaccagctgttacacagggataaaatattattaataaaaataattgacctcataatcagtataaaagagattttgatggtaaatatttggacagattttactgaagtacaccaaataagaaaaaaatatataaacaggattattgttataatgtcctataaatctctataaataggaacaggaaggaataatttaaatgcctgcaatgagggtttcagagtgagtaaaaaatttttggatgctgaaggaagatagggttttttttttttttttttttttttttttttttaaagatcatttgggatttagggaaaaaagtgtctactgctataagaagttggaacagttctatttgtttagtgaagtagatagtcaagcttgagatgaaaaaatattttgagaaattaaataactgatagctcaaagaaatgagtagtcacagatggacttcttggccttctttcgtgagcacatttcctgttttattggctttggataagtaaagctcttcaaatgaataaaaaatgaagaagaaaaaagcatccttgtgaaatgcataaaatatgttcattgcctttttgaaaaaaataataatgtgtgtatgtgtgtaagtgtgtgtctgtatatctgtgtacatatacacacatacagatatatatgcattgtataatacagaacacaatgaatagatatatatagattaattctcattaaccagaattcataaacaattctcaaaggcattaagaaataatgcaatttttaacatctacatgtagagaataaaaaattttaattatgtaaaataatataatgcagcactatcagaaataaaaatctgataaaatcagaaatgttatgagttttgagaacagataaactgatagaagtgttgtaatgtataaaatctcttatttagtaattgttttaaaaataatgtattattaaaactcttagtatatgtagttatagaatttgagtattaaacagaatcacttaaattattttaaatatctttataaagaatcagaaacatttaataaatattggcagtggtatatgtttctacattaaaaatagaatgtctgcttataatcaaatgcataaacatgctgtatatgctaaacagtttagtcagtttttgcactaaaaactattatctgccagttaaaatattataattaaacagtcatttttatgactatctagcaatatggcccacgtgactgggggattttgtttggtttttttaaatcttgattttaaatttgcgtcaattgttactaatttactattattatactctctaatgtttgctttggccataagtaataacataagaaaaaatatattcttccattcttaaagtgaaaggagatagaagccaaatagttaaatatgaatgtcatcagttcaaatcaagtgttagcaatgtgtaattttgtgaggtttttcattggtaaatacatagtacatatttataaggaaagaacatagatctaatcatattgtatatttgagcatgttgtacatgtgaatcatatgactttcaggtgtattctctgttttttattttatacaaataaaataatagatctgccttttaaataatagatcttaccatttatcttgaaattgaaacaaagaagatcattagagagctacagaatgccatagaaattacaggaaaagaattaggtgactataactaaagggggtcacagtaaaataataccaacatacaccacacacacacacacacacacacacacactacacaagcattggctaataatttttcaagtatctttatctaagataaataatttttcaagtatctatctaagataatttttgttttacccttcagtggatttacttcacatatatgtatagtggccccttaaagagaggcagccaaacaaacactgcatttgtgttattgctttcttatttctaccatataaatgtaagggctgttttgtcttctgttggggatacagtaaacaagggagaaatgagctggtaaggagaggataaactacatctggaaaagtcagagctagtttgagatgggtaagcatgtaaagagaggaagaaagaaggaataatgaatgccaatcaggaagttggggctatagccaagaattttaactgtagcctccccagcaatatgaggtgcctgtcacaattacaaaaccgtttgcctcattacatgaatcagtcaaatgatcagaccaaattggtattacatttcatcaatagattcttgatttttactgaatcaagaatattattatttatagttttataaaattcaggaaaatatgtatccactcttgtaaatgtatttgggtagctttattgtatctgctactggttcagaatgttttattttgggagatgctgacttaaagattatcctagacagcctttaaacttaaaggtaatcattatttgtaacactttgatttatttttaatcaactattttaacattgccgttcctttacctcatattgaatcttaacttactggaagcccctattctcaaaaatttgcctttaatactattcaaataatggtcccatccaaagttctcacaaaacattgtttgttttctacgtaaaacaacattcaaagagtaaaaataacttgagaacatttagtctaatatgatcatttttcagggaggaaaagtgaggtgaagtgactcatcttattacacaataatacacacacataatttaagtatgtaagttgaaaatcatgagctttaattgcattattataataaaggttttacaaaatcctgtcctgcttaagtaattacccttgtaatgtctacccttgtgagtgaatagataataagtaaggatttattttcaaaaagataataaatttgtgggttatcaattctagaaagaagctttagtgattaccaggggcaacacacacacacacacacacacacacacacacacacacacacagaccgagagagagaaatcagcactatagacaagactatataatctgttgtatcaagacaactatcaattatatttttttttgggtatacggctaacttgcacagacatcctaaaacattatttaaaaaaatggttggcaaatagaacaagtaatcagaggaagagtagaacctttaaaaaactcgttttcaaggcagcaaaaaactctaacagactctcttaagaagtgttttagctcccactacttagcattaataagtgtgaaagggattcccagtctcaggcctacatccctgtcagctcttagtatttacgtgcagctccttaattcatgctcaaagattatgttatcaacaatgattaccagtggtgggaaagccgggcttgaaaaggctgaataatggctaagactcgcttctcttcgtgcacatttaaaagcagtgctttcattgatagccaaaatcctgctaacaggggtgggtattattgtgcctactcctcagtttcatgaagagatctgttgtttcttagaatttccacgccacctcatctagtttcatgttgtttttccttgtgtcattaaaaaataccttgttcccactttttctgagtgctgtttccactgaggctggccatccagcagtggcctgaggttcttaatatttctctttattttttaaaggaaatgcatcttatgaggtagtgtttacaaaccagtcatattttagatcccaccactcattctgttgaagaaacttgcacttaagatgagagtaatacaaagctcatttaaaaattctttatctttataggttaataatcattctgatattttgtttatttttcagaaaaatatgttactcgataaaacatagaaatagtatgattctggatatattttatttttgaatttaaagcagtaagattgattccatcagtagtttaaatacaaaataaatctgctcaagaagtagatcacaaaaaagacaggtagactgggtaaacaaggaattcatacaaatactctttgtccaaagtgtccaaaatttacttgctatcaatattactacattgctctcgcttaataaaatacacacggaagaacagatacattttagtgattgttttattaactctataatacctctattatgcccaaggaactcctgtgtgcaatttattgaaaagcattagtatgataattattcatggaaaaagcagctctgctctgaatcttctacatccactggcatctacattctacataacactgaacaaagtgctaaagaatttcatttttctgtgtatatggacccaatgaaacaatagtatttttgagcacttattctattttcagtattgttctaatgctgtaagagatgtaaaattaaaatgacatacttcattcatttaatctattagtaagtgaattaaggctttaacatatgaaaatgatatcaaatgggcaataatgaagtgagcattttaggtggaggaggctaaaataaatatggagtagcatatttacctttcaaggagtgtatcatccaaaaagtaaattatgctttaaaatataagtagaatattaatgagctgtaataaaggaacatttttcctgggagaaagaacattaacaaagtaaggagatcttaatatgaatgctatgtaagatgttatatgagtgtcatgtatgagatatttttgatctatttagataaaccataagactcttgttagagcatagtagaaaaaatgatatgactcagctttctaaagccttgaatattgggcagaagaggttagagtttatagaaaagaaatattggtttcttgcagattcttgatcaatgaataaaaagtattaaagtttgagaagatttacttaatagtcataaatagaaaagacaaaagagatataggtgagagaatcaaaagatagggagatgtgttggtttggaggtaattagagcccaccaaaaattgtagtaataaggggagtgtgaaataaaaatggaaaggcaaattcaggaattattttgaaaaaaatagacaataaactttggtgatatactagatgtggatatttaagaaaaagatagatgattttaagaattctaatctggattgtgggacaatgcttggattacctgccacattggttgaatatagacaggttgtcagtttggtatggagagcatgatcaatttgatattggtcatgctgagtatgaagtatagcattacccccagttacatctatctgtggtcagatgtaatatggaatgggttgagcactggtgagataccagtgaattcagctatatagatattctagctaatccaaaatcggcaaggggctattccaagaaaagagcaaataggctagctgtatattagtatggatgataatgactatattaagaatctgtcgacattatagtccttgcaatgtgggagttactttggtttggagtgtgagtcgtattactgatcctgacgatgtgttgcccccccaccacacccaagtgttactctttctaattggaaaccttttggcatagtgctaactagctaatatgctgcattcacttttatttactcttatcaaatgggattatgagtgtatgatatcaggtttcttgagctttcagttatattcaattgaaccaaatatatttacattcagttgtgtttattttatttaaaaccatcttcctaaattgtaaactgatatattatttcttagcttacataaaagtgttttctaaatgttttattactttcattcctttcttaaccatagtttaacttcatccaacttcaaaacatcaccatatcattttacattatgaagccttttacatctaagtatggaaaacgcaatatagccttaactaacatcctgctcattaatgatttggaaggtaactgaaattaattatagctaggaaaatcttttccttagaaactaactctaaaagtacttaaatatgtacaattaaagaaaaaatgatacgggctgtgtgactcaaaactaatgcacacacaattactttttaagtaatatgggtaatttattgaacaataaaaatattttgggatatatgttatttataactaacaacagaagatttataatagcaactgataacagaataacaaccattcttatttaaagaaattgccatgcaggttacataaactacgtatttggaatgatgactaaaaattttcaggctaagaagattgtttattattcattaagaaagtaaaaaattaaaaaaacaagcaaacaaataataaaacctaaaagtgaagtggtacttgctgaatataagaagatcacacagtttcacaggataatttggtatgtttgcagagcatgccactgaaaagaaacctttattttatttactatggaataaaacagtattttaggaaattatctctatttcttagacttgtaataacattataaaagataactgcacagactaaacttcagggtggcaaggatatttttacagaagattcttgtagtgaatccttgagtttcatatggatattataaaagaatgtaatggcagtgtgtttgatatggtgccttccccaaagttacatgacattatgtttgataattgtttatcgtagacacatacaatgttttaagcttacttcttaatattttattttctgaaatcaatgtcaattaaaaattaatggttttgaaaaataagcaatctatcccggaaggtattttttccccctctcttcaaatatgtttagttaaattcctttaatttgatttatttcatttgagagatactgtgatctttcagaaaaattgctggggctcttgcttttagtatttcttcatggatttaaagagataactttttctaacagtgtaaaaaatagcaatattctattccatgtgaaaaataattcaaattcaggtggcaatgttaaaatatagtacaaacataatactgtaaagtttaggcttcaggtaaatttgaatgttccttaaggatttcatatctatgcatatattatttaattttaacatttgaaatatttatattattaggcttgatatggcagtaaataaaaaataacatttattccataatatttttaatagaaattagttaatacacttattaactaaagcatgatcttttcttgagcatttgtgacgttttttgtattctgataatatcacagactttgtgaccaagtcttaattattgaatgctctcagtgtgcatgatttggttctacatagtgaaggatataaatatgttaaaaagtgatgaagcaggaagtcttctattctgagtgaaaattaaggaattactcattgattggaaagtaggaaaaactagaaatagtattcctctataattaggaataaattagatcataggaattcccttttcttgttttatgggaaatgataaagattgaaatgctgactggaatggattgcaataagagagtaggaacattttcacaggcgatctccattacagacctgactcaaaccttctgtgcacttcagagatacctgatttatacaaaactgaatttttatactaatgtaatagttttcttaagtcatttgttacagttcagaatgaaacaatatagctaagtttgtttcataattggcaagtgtgacacaaacatcaggtgatgttattattcattatatgtaacattttcaatagtttattatttaaatttgccatctctgtaatgcctcaccttattctttcatggcttgttttaaacaattttagtcgcaggcaagtctgctttacaaaggcttgagatgttcccattttatgcctgatcccactacagatgtcatgaaaatggcataatttcagcagattgtacttaacagatatgtggtaaggttgtctattatctgataagcctgtagagacctcatttcctttcttcctgacatttaatctaattttctgccaagtatgatagtagttataactggccctcctcaggccatttatgggttaaactaatagtaatttcataccctagaagtagagttaccctagcaactctcagtccatctagatccaatttctaaaaatactctctcatttctggctattttctttcgtactggagacacaactatgaagtccatttccacattctgcttctcaagaaaatgccaaacacaccagtggatccatgctcacttgtgttggcaccaaactggcctgatcacctatgttgaaaaagcacatggctcatttaaataatgctgaaaagttgagcatagctgaagtgtaggatgattttaaaaaaatccagagttgagcctgaaaacatggcttatagtcattctgtgaaagtttttaacgtatatgggtttttagtgtagcaattacctgttttccatttctctcctaaataaccaaattagcattaccttgtcacttgcctttttttttttaagtttggatgatgtaacttctcttattaagaaggactactgtattttcttttgagaattttatatttttattcaacaaaatgtaccactccttagcaaatagtaatcatccttcaaaatattcttttttccccacaaatacagaagtaacaattgaaaatttgaatatcaaattttgaatttttaaattactttggaaattaaagtaaaaagtagtaagagatcacgtcttcacattattagtttaactatatgcccatgaaaagaaaaacaaagtcacagtaaatatgaaaatagtatgtaatgaaaaaaaaaactttgtattcctcgtactagaatgtttgtttatacttgattttgaaaatgattgtgtctattttgtttaagacaaattaatgtgaaaagctatttattttccctattccaatccatttactcccatctataaaatgaggtggggaattaatatgtcaacaaagcaattaagtagaacaaaaaaaccagaatattaccgttaactgctgttaaatttttaaacaagatttgctttgaatttttcataacacgtgaaagttgaggattgttatgtaataataatcatgatgatgaaaaaataaacacatattgaatttaaattctgacatataaataggacacattctagaaaggccatttcagcttaaggaaaaaaagtgttcaaatgcgtaaaatatatcactaattggcttaaaattatatatgttataaaaatcatttttgtactcttcattagttgtaatgtagtttgcctgtgatatgacaaagtgttcaaattaatgttgaattagcttttttttcaaaaaatggtaatgtattccctcaatgagtagtagattattttatatattttctaaattatttctttgctctaaaggtctagagtaagaaatctttaaacaaggattatatactttcagctaacatttatgtagcaatatgtagtttgaaaacggctttgcacatattatctctcatgctgagttttcccgcctcctctttagaaataaatattcagctcagagagatttagtgatctgtcaccacatacaaagtatgtatttggctggaattcaaaccttccagtctcaaaacttgtagtcattctattatgcctcttttaggcactgaagtaatgcaagtgctaataataatgaggaggaggagaatgttttttaaaagtccatctctcaaaggcctcatgaaactctggaaatacaaaattgatacatgaaatcgcattagtgcagcaaaagacagtaggtgataaatagatatttgaaacagatcaacttttgggcaaaagcaaacactatggaatttcagaaaggagtagcatagaagccagttgggtgaattaactgaagaggaagaggacttttcacttagtagaaacagcataaacaaaggcataatgagacaatgggccagtctacataatagtttgaataaagttaaaaatattgtgtcatattatattgagccttgaaattcagagacagagaaagttaaacctaataattcagtagttaatagatattgattctacacaaggggagtttcatgatgcataacttaatatgaggatagttttacaagacaaaaatggagaaaaggagaatcaagtagagacagttttagaaagtccgtgattaagaatggaaacaaaagtgcaatgaagtcggtaagatgaatcaaagatacatttttaaaaagttgacatgtcttaagcatagtttgtatttaagtaaaaatagtaaaagaagacacactttaagtctcaagagctcagagaagtgacacatcaatttagaaaaggagaaattgggaaacagagataatatgggggaagttatttggttcaattttaaacattttaagcatgaggtaatggtgagctacctaggtaggaagttacagagatggatggaaattcattgagggagaatttatggctgtaaattaagagagttttgtaatcatcagtatagaagttaaagtcatgagtgtgttaagtgattaaggaagaaggaaagttttgagagctgaaacagagccatgacagattatctgttagtggggcagagagtgagaaacaagggtgcatgtcagaagttcaaagggaaggcatcattcaataataatggtattagaagttcaaaaatggttaaaaagtagatttgaggaacaagacaatggatttaaaagcaagattttaaaacaatggaagtttaggattaaggagaaattaggtgtaaagatataggagaataatcattttagatgtttggccagaatttgaaaaagaaagagagaagtaaaaggaacatacaaataattcaaatatgtttcaaatgctcacttttttaaaaaccttgtgctaaaaatttgaggagatgcaaagataaataaagaactctattgggatgtattcaattacaatataatggaaaagggaaaagatgtgcattaatttatagtgaagaaaccaggctgtgataagtatgacttgaccctcttcattttataaatatggagaaaagaaagatatacttgggttacacaagtagtggttaagcgtctctaatgaagacagcccaaaataaaatagcttgaattagtggacatttatttctctctcatccccaatcgagagaacagtccagctctggtgggacagctctgttttcctcagcaaggggcttctaatacttctctatttagcaccatttcctaaaatgaggaagattccagggcaaatgtctttaatgagaattttcagaaagttgtgcatattgcttctaatcatatgtcagtggctcaaattgggttgaataacaagagtagatgagaagtacagttttagctgggcatcaatgttactactaaaacccaaggaggaaaacaaatactgagccatagtcatcagtctctattatagatatcctccatgaagagagaatgaggaaagttactgaatggtagtactgggtagtattgaaggatgggtgtaggatttgaatatctatggagtgaagagtagggaattacagggtaaatgacaatatgagcaaagaaatgaataagaataaatacagggctttttttttttttggaaaggggggtcagagatcacatttgctaagaaaagtggatcataatcttgaaatgtttttgaaggaaagtgtgaagaatcttgaattccatgtttaaagtctggatattttatatatggacaatggacacaattaaagatttttaaaatagagatgtgatattatgggaattattccacattaaaatcaactgggaagcggtatatagagattagaaatttgaataaaaagtggaaagtccagttaggagactactgctatggatatgacagcctgaactagtatagtgccaatgggaataaacagaaaatgggaagggcaagaaatgaaaaagacattctagaagtttaccgacataatttgacaactgctggagttttgggttatgaggcaaagaaatataaagaatggaagttgattcaaaggatattaagcctaagtgatttaagggctagtggcagggccactgcaattgttcatttaaggatgctggcaggtgatggtattaacagagataagaaatgtaataaaagaaaaattaggagtaaaaattgtgaattaatataggacactgtggtattggagagtctactgtcaggacagtggaaattcactttaagtcaagggagtgaataggatttaatatatatatttggggaaacaaataattgtatgagcagaaaaatattaatttggaggccaattgatttaaattatgatttaaatttaaaaagtgaatccgaaagagttggaagatgaggacagatactgaagcaagatctggaaacagggaagatagaattcagtgggacagtcaatcttagaggggtgagatgatttagcttaaaaaaataaataatggagctagaataagagttgtgttcacgttaatgtgagagagataaggtagaccacagacaaagcaatgcaaggccagtgagtaagagtgtgtgtgtgttgggagatattgcttgaaagtgggaatcggagataaaaagaattgacttacctttcctcactattagaggaatggtaatgaatcaaattgagaaagaggaaaagcttcccaagtattgccataaagagcaaattggaaattcatattggagaccatttttcttagcctgtatttgtatcttttggaagctttatccttttggatatcttcagtttaagaaaaaaagcagagaatgtgaggtaaaacatgtacattattttaatttaaatatcaatttaccaaacatttatttttttctcttttgaataaattatacaagagacttccttgaaaccagtgtcagtgttcccagattcttccttcctacctttctccatttccttccttccttccttccttccttccttccttccttccttccttccttccttccttccttccctcccttcctccctcactccttccttccattctttccttcctcttcagattatatagtctgagaaaatagaaaataaatttttcaaatgtatatgtataaatttggatatctccccaaccctacaaccacgtctcattcctctcatttcccatggaatcccttgaaacatctatataatacttcagggcttaaggaactctatgaaaaaactagtgatctcagtcaaacaaattacacagtctcactatctttagctatgtttctaggagttgtcatatgggaaaactaaatctagcttttatagaccagtttcatgttaatagctaatatacttttaagagtaggaaaaatatgttttaattatcaagaaattaaaattggaggttgaataactatagttgaagtcatagcatctaataatatttacttgctattattgtgtcaaagtattgaatatttgccacctgctggcactacattaacccatacaatcctttagaatacgcttatgggttaggtcttcctatttttctcatgctttgggcaggggaactaatggcatatggctgtgagggatggagatgggtgctctagcagcagagcccgttcatgatctaaccactaaatcacattgtctctcatgagcaatcaatgttttagatagttaatttaaagcggtaatattttttaaagaacacattcttgtataaagactgatggccaacattctgttacttggaaatactttaaaaaacgtgtataaactattctcattagcatgaaagtaataagggaatttaaatgaaaataaaatgtctaaaaccaaagctagttctatttcagtcagacacaacaaatcaacttactcttcaatcaacctttctgtttagtgtgtcagtttaacttagagaaccaaacaaaacacttttttgtttgtcaaggataggctattaaaacaagggtgttctaaaattgcattagaaagatgaaaatgatttgtttaatcttctgaattttcatatgtcaggaacattattgtgaagaaaattgagctctctgaagtgacggatacattattcaaataactttgattggatgtaagattttttttaatgctttcacaaagcggacatattctaatttggtttataaaagagtggctttaaaatttgaaatactgggaaaaatatttttttagttcaataattagacaaagcatatttaattgtgggtgtaatgtttatggataattccattaattgataaatatatctggattataattagcataaattatttgcaccttaataagtcctcagtttgaactacattagagatgttaagatttctaaagtcatctacaactggccttaaaaattagatttgattttttaaatcttaaaatagtggttcagataagttatagatttgaaacaaaataataaatggaaaacagtgagcctcagtatgaattcctgcttctaaaactgctttgatggctcggcgcggtggctcacgcctgtaatcctagcactttgggaggcccaggcaggcggattgtctgagctcaggagtttgagaccagcctgggcaacacagtgaaaccctgtctctattaaaatgcaaaaaattagctgggtgtggtggcatgcacctgtagtcacagctactccggaggctgaggcaggagaatcgcttgaacccaggaggcggaggttgcagtgagccgagattgtgccgctgcactcactccagcctgggggacaaagggagattctgtctccaaaaaaaaaaaaaaaaaaaaaaccacaacgctttgatactttgatatcatgctgattggcatgttctctgaaacctataataatgtcagaagcgtgtattagaatgcagtagattcttatttttttgtttctttagagttgagattttacacataaatatgtaaattcatagaatcattttgttagatacataattctgcattgattattttaatctctgttactttggtggtttctattatagcatgcaaaattcttatgatgattttatatttttttctgtctttaaaatactctacggtctttaaaaaatgtttcacaactaagtttgttttctactttaatgactttctagctttcaaatttttataaatcctgtacatacaatgcctaagtcttaaaaaatgttattggtttactgatatacagattttcctctaacaaataatgtatagtaagaaaatgcaatttcttactgtggaaattagctgataaggacagggatctttaaaatcgaacacttgcaggcacgtatatgaaatcttgtaaaaatgtctgtttctgctttctacttaaacttatctgtctttttgtttcttttgcagcaaaaaatgctggatagaatttcttcccactgcaatttaaatgtattcttttttctgtcaattaccacaggtttagtccttatgagtggtataatccacacccttgcaaccctgactcagacgtggtggaaaacaattttaccttgctaaatagtttctggtttggagttggagctctcatgcagcaaggtatacgattcagcctgctatttcctttgggcaccatgtcccactctttgctgggggtgacagctcttgctggcacaagtcgcttgcatgggtgcctctgtgcatgtaaccataatccagcttttccatcgacctaatgcatttaggccttctcaaatcccattcaagagagattctgagaaaataattagcttttgcaaatccacatagagtatactcatctatttttttccttaacctacagtagatacattatttcatagataaccaagctaacctgatcattagccagaagctgcatttaaactactacaaagattacatctccttgagacaagaatacagtgttatgctcctgtttcttgtctcattttgatgtaaaatcttctctttcatattaattcttggtgattagatgcatttgtattgcatgattagtaaatttactgcctataaatttgaagagttaaaatattaaaacatgaactttttgagtaaaatattagctgcatttgatagcatataagaatataaaatattgcatgctcggaagtgcatgcaaaaatactttttcgtaattatttaaactttataatatacatgttaaaattaaggctatatcttagaaaatgagataatacatgtactaatacgtcttaatggtttatatgtaactatgaatctactattttagtctcagtttttttcaagcagaattttaatatttgatgctatggtttcttttattaatcttttcacatttaaataaagtttaacaaattgctatgctagacctattactcaaaataaaatattttattagtcaaggtctaagactagttttgccaatttaaaatgtaacattttaaagttttaaaattagtaaataaagcaaaaaaatcccaaatttgaaaaactgacagtaaaggaagaaaaaaaaccatatttcttcataagagttatcatacctatcataaggtttgattttaagtttttgttgtgtatttaatatccactttgaagaaattcatttagtgattgcattacagatctgaagaagtggaaatttatgttgttataaaatgttgtttctaaaaaaggcatcgtgctattgcatgtttaattttatgcagaaatgcattaattcattactgtttcatttataaactatttcctaaagtgaaaatacataactacatgtcaaaagaaaaagtttaatttaccaataaataatctttaatacatattgtaagcatggcctactaaattgaaatgtttattgtataattattaatatatatgtaaactatatttttatatatagtttatgaatatttaaacctaaaacttgaaaatccagaaaacttttacatgagctaacctaagtttgtggcatctctttctaaataactcaaatgaagaatcagtagttatatttttcctttcctacattttcttacattttgggtccaagggttttttgtttttttttttttttttcccttaggcttactctacccttagaagacattattgtagttctttcaaaataacagaagtgaatgaaaaagcccgtcatatggcacaaggttattttataagtagtgttgagtaatacaagtcacccaggcaaaactgctagtcgtctgttaataattagtagtctggagggagttatcctcataataaacatctgaccatagcaagactttcgttttaaaagtttcatatctctttgacaaagaaaacattctttttttctacttatattttaaaaaaatatttggaggtctttgagaatttgtatgctcataggacaaacttgctattagtagtatttaggaattagaggtaaaactctatgttattatctctgaagataatgacaagcaattcaagcaatgaaaaattcaaatatacatttgcttcgccacataactacgtcactgctggtggatacatgaaagaggaacccatactattctggctgatgcccagcttcccaggaattagtgggatatagtgctggacatgacgttaccttgagtacatgacagtcagcccctaaccaggctctgattcacaagactaggaggtactcgctttaagtccttgggtaagatatgaacttgtggtaattgggccatttatgtcaaatgtctccactattcttttctttcccagtcttgtttgactttattggtgttgttgtttaaacaaaacaaaacaaaacacaaaaaaagcaaaataggcagccaatgctgctcatcatcttgggagtatttagtgtttcagtgtccgagtgtgtgtctgacagggcctaggagcaactacatcagaaaggtacttttctgtttttttttccttacagagctgtaggcagaatctggagctggagttggctgtcatgtccaagtttgtctgcttttaaaattttgtttgtttgtttgaaattgcaatggtaagatgaactgcagtataagatgggctgttttgatatagtgcagtcataataccacttatttttcaagcttcacatgaataatttgttttattttttattccatctaaagatgtgttaccttactgcatcagagattatactaaagatatgactgtaagtccgtctttgcttcattccattttactcaaacacaaataaaattaagtacttttagtctatgctttcttgatagattcaaaatgattaaaagtgaacagtaatatatgcatatctacaaatttagtataccttacttataaaaaaatcacacatactgatatatgtttatttaagcattaagaatataaacaatgtggtaagctgtaattaaaatttaaataacagaccaaattttaaattggtaggattttgttttatagtctaaatgaattaaaattaataatagtcaaaagtaaaatataattctcagatcccattcttttattaagatcatgagcaggcaactccagccgtacattctgatatagttataaaagatttatatatgtataaaaataaatgtgacaatttagctatatattcttattctaatttttttaattgatgctaaccatagtgatgggagatccttgcttatacaggagaacataatttattatcttattttaaaataaacattacactaaaaccccacatcatttcaagaaatgtgggcaatagtagttattttattattatacgtaacttttaaaaataacaagatagacaaaatgtttgagctacatgcacatgaaaagtgaaatttacaaaaagcttaagaaatggatccaaaagtatatttaagcacttcctctgaaaccctcataactaacaaaatatgaaaaaacaataaatgtggtttataaaccagaaagcctaaaaaatctcttctaatgctatttttattaaaaatgtttactcattaatattttaattggaactttgcatcatctcaggtagaacgtgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaaggtaagttctgctggttacctaaaatttacaaattaaaatgatagagcgcaaacttctctcgattcacaaatgtaagagtgtaacaacgccattatttgtgcacaattcttaataatagcatatacctcaaggggtggagaggtgtacaactgaacgtatgctcatcaagaccaatcattttaatctctgaaaatgctaaggaggttttgctttacaatattttgttcctgttttgaggaaaatcagcccaagggtaacattttttcccagtaagcttttctttttgaataaaacaaaatgtattttttgaaactgtaatagtaggatgttcagattctacaaaactttgctattccagaagaatagaataattactcggaaaaatgtttcccatacgtacatttacttttgttgaaatgaggcaagatttaagggctgaaaatacagagacagtccttattatctatacgttcaccaaggtaatagtctgggagacacagagttgaaaggggctgtcccattgaactcacagtggtttccagagagacagccctgtggaacatttaaatgaaagtgtgcttgtaaaaagtttctgtcatatagagtgccttgccctcgtctattttttctctcttctccttactcttgcctactcactgggccaaagtagaccagttgagggatttcactttaggtagctattaccactttataattccttttgtatcttaccaagtatttttacagtttttgtaggttgggcaaattttaaaacattgatattttctttctgtgttcacagaaacacaactggcagttcaaatgtacagtggaaatagtattttttttaaaaaaatgattaattcaagctataaaataaattatttcatgaagcattcatcaggtttctatcgagtgccagaagttacacgacacattgagtattctaattctcactatcgaggagattatggtttagttggagacagaataataaacttaaaacatcactgaatttggttttatgtgacttaagtcagtattttgtcaaattatgcaactttgtaaaaatttttataaaattaactttaaaataaatttctggaggacatccaattcccccaaaaataagataaattagatttagtcaaatatttaaaatttaattattttcaaagtgaatttctcatatgactagattaagtattggatatggatttcacatttacttggaaaatcactgttatttaatcaaatttattgaataatcaaatataagcaaaacaatacgttcagtatggtcctatttgactatattaattgcgatggatcagtttttcttaattgaatattgagaatttataagatttcctttcttatcaaacgtgttaatatttttgtgtttttataaagaaataagctgctaggccaggcacgttggctcgtgcctgtaatctcagcactctgggaggccaaggtgggtggatcacttgatcccaggaggttgagaccagcctccataacatggcaaaattctgtctctacaaacagcccaaaaattagtgtggtgtggtggcatgcacctgtattcccagctacttgggaggctgaggctggagaatcacttgagccggggaggcagaggttgtagcgagctaagatggcgacatagcactccagcttgggcaactggagtgcaatcctgtctcaaaaaaaaaaataaataaataaaataaaataaataagtcgctgaaattgctaaacgtgcgttgttagtgtcaacaacttgaaggaagtgaatgcgtgatgcatttaatttattccaatatccaagtgacttttgaattgaatttgtaaaatataataatacaacctattgtacctaacacaaaaatttgacaccagaagtgtttatttctggttcataaacatttccgttttaattttattttttccagaagactcaaatattttgttttaaagttcaaatatactagtagcaaagttcatttttgaaaaatcagttaccaaacatatgtattttttctttataaaatttttatttttaagcttattttcttaattctttgtcttttcattctttcgttctttttttaatagttcaattgctttctgctatgcaatttttgcctactttcacttttccttgctactgacttttcttcttactcttttttatctcttgtttttctctcaaacacgagtgcctctagcaccttgagaaagtcgacacgacacagctttctatttccaacagcacatatattatttctttagaattgtatttggaatgtacacaagtcacaataaaaaccacacagtgataattactaagttgacaactaccttatgttgctaatattatcacatgctgagttctattttcctactgaaactaggaaaagaaaattagaactcacaagactacattaaatgttgatatttttggtattttaatgtagccttaaaagattccaatttcaatttcatgttttcactttttaagtgtatagttattccagctatggtaagaaatttaaaaaaaattctagcagtctggaattcaaaaactacctactcattttgaaactgtacagtgaaccagagactattttgtagtgtatttacattttatacaattctttcatttttcatttaacagccacacatacaaacactctaggaagcatccctaagacattgacttctaaaggaatctctatcttgtttttactaatttagcaagaccttgctgttaactaattgttctggaatacttccttccagaaaattattataaaaaacgatacagttttgttactactagcaagaagagctggctccagatatctggtgttaaagggtgtaaatcctcagcattgcaaagacatagcagagttacatagctgttcttcaacatcgaataattccatttccaaagaccatgattgattttgttcactgagctcaaggtgctcaaagcatattatcttcaagaaaaattcttccttctttttttctatatccattacacaccacacagactctcctcagagataaatgtaaagccatgactggaaaaaataattcaaaataggagatagtggttctcacattattttcatgtaagcaatagaaaactgcatggtatcaccaatatgttcttaatcatatttagatagtaaaatggatgacagtccaagaattttattaagaaacattaaaggaggagtcaaaacctacttggaatctgggaatttagtgtactagaactgaagtttcacccccgggctaaccattatgcaacatgttaccaagcaacaggaacattcttttctccctgaagtataaaggctaggagaatggaagcctatacattataggatcaaaaatcactcagctatagcctgtaggtgttatggctttttttgagaatgcttgtatttttgaagtgagtcacatgttttacaaaatgataccgagtgcccttgtttctatgaaatccatgactcaagttttccagtttttagaaattatttgtctggatttggcctacctgaaatctctgactttattatgtgcactaatacatatgtccatctaaaagatatagtatcaaaggaagaaacatgtgctcttttgtatggtcattaaacaaaatgttggcacatattttaaaaatgtaagctccatccaaattgatgtattcctagtcctgtgttgcattctatacctttacatctctttctctaatgcccattatgctcttttttcatccccatccacctctaccaacctaattggttatattctctttattccttagattctaatctatacatcacttattccagggaaactctcctgacccttttcataccaaaatctacccagtctgggtacagtgctcctcttttacattctttgaagttttttttttttaaacttacattattgttaaattactaatccaagatatgttttcttggttcctgtatgtttccatactctactgcacagcaggagaatagggattgaatgaatctatatcattcatttttgtatctctagttcttggcactgaacttacatgtcttgagcttgtgttaattattaattgccaccagaatattgcttaacaaacagccaaaaacttagtgacatgtaacataaacctttatttatcttccaagtcagctgtccttctcacagaaacttgagagcccaagtttctacatttacagactcagttccttctacaccagggtgacagtgcttttaccagtacaatttcttcttaacctttaaatgtgtctaactgaatctacttatactgtaaaagccacacacgccgttcttttaaaggcatgcctctcttcagactgaatcgttgctactttgggctagaggatctttatccaaatgagaaaatctacaaggtattgccttgacttttttagaggttctaagaaagcatctaaggcatcacgcttaatttgattcttaattaagccttgtggccacgttgagaaaattttaagaactttcgctggcagaagattagaaatacgtttgttatccaaccatgcaagttttatcccctctacatcacctctaaattcagcttgcaaagtggtcagtacttttaaattttcttttcctctcctcctcttcctcctctttttccttctccatctccttgctgttgtactgattactcgtctatctctttcttgtcctaccttacatgtagctaaaactagccagctgatactttgaacattttgtcattttgtttggctatcttttggctaaatccaaaagattattagttcattttctatctttcaagtcactacaactacaacgtgtaattaaaaataatattttcccctgtattcatggattcctattttcccagcctccccaaatgatgatttgattattatctgctatgtgtgccctaaatcaatgccacagcttttctttattgcagcaccttgttacttttgtcaaattccacacagttatccattggcacaatgaattttacatttactgatggaaaacatatgacagaggctttcaggtataacgtgattatgtgcaaaattttattattctacagggcagtcaaaggtttattcaaaacatagagccctctatagctttcctattttaattatctgttaaaagtcattgattttgaagtgtaggtaatgaagttaggaatgaaaagcaagtgggttattccatcctaggtagaacgttttaatttttggtactgagcaaaagaggatttttcttgggagatttttctctttctttcttgttttctctgtctctctctccctttctttttttttcctttaacttttacagccttcctctgcaaagtacattctaaattccagctcatttatcttcagacaacttctaaggaaggtaggaagcaattatcattatgctcatttaacagatgaggaaactgggccacaaagaggttaagtgacttattaattataacggctataaccaaggaatgcatagtatcacaataaaggtaataaccaaagatatcgtcacataaaccatcgttactcaaaagagctaagtgtattgatcattttggctcacccacatgacctcaactgcttgattatattaagtttctaaaacatttgccttacagcattggggcagatacagctataacatgttctttatagtctgccacttattctgatcttaccagctcaatagtcttctaaaattaagttatgctggggtgattgtatatgatagtatatggtggggtgatagtatatgttttgaagtctgaattgctagtgtggcatgcctgcaataatttttttgagagcttgagtgattttgctttcagtatactacaagaatgtaagtaacttttccattgagagataaaatgtaaaaagttggtagtttactgcaagtccttattagatctaaaaacatatactattcattagagattgctcctaattttgtaaatataggcaaaacagaattgttgtccgtttttatttagagcaatggtggtaatataagtataatatatttactgtgaagagatttactcattagcagagtaaattctcaaaattgcaacgatagtgtgcttttcacattgaaaaatgtcttctgaaatgaatgtttattttcctcttgctatattggtggtaaaatattttgaaagttccactttgcatatgcagaaaattaacctaaaaataatatttaaagatgagaaatattatctagaacttttttgaattttagatatgtttggttttagagcttattctttaaatgtttttcatattttatatagcaagatttctagttaagtgtagttgtctgtaggaaaaggtttaataattatttgtcagcacatggttagaaatcaggttatgtcttttagtttgcacatgtttactattacgcggattctaataattttccaccactatccagaaggaatgcttttacaatatgacaattagaaattctttatggtacttcagtaagtatagggaggatgtgtaaatagctactcacttgagttggcttgtttatttaggtgctattaactagccacatagctttttctcatgtcatttttatttattttgagttgaatagggagtcttttcccttttgagcacttgtgtttctcagagatgtattttattttgtatgtctaagtgaaaattgagaaaatacatgttctcagggacctgaggaatgaacattcatcttttctttgtaaacctttatcgtaggtttttctatcatggggattgaaagcataaaggtccatatttgagacttgggagaattgtacatgagactttgtgtttacctaatggagactgaattaagaagagatgacttttaagtgatattaaggacatggtattaattggcctactctatagatttatattgaattgggttctgagcaagagctttgagatttgtgttcatgtagttttcttgcctgagcttattttactaccctataatatttagtgaactacttctgctcctttccttgttgtgaaaaaaagcgctattttaactggcaaaagtaaattagtacacaattctaatttacatattgctttgtgttacttgagaacccctcaatattcctttgcagatctaaactaaaacaaaatgttcctcaaacatgacatactgttctgacttggaagatgaaatacctaatatacttaggcttctaagccaaaaactattcttgccaacttgctcacaaattactgattaggaaatagctatggctgtttaggacacatagaaactttatttttaattttttgtttgtctcacatattgaagtttatagataatcttttttttttctttgtgctttaatgagttaaacaaaacataaaagcttgatgtggttgatcaccaatgtatctgggcagtaaggttaggttaatggttaatattgttaatgaaatttttgtttgttcatgttgctgtgttcttcattgtccatcagacatttttttctagaagtctggaagaaatatcgcagtaaagatttttatagtcatataattttcctaacgctcccaaattatttttcctttattaatggtgttgaaatatcgaatgtgggaaattcactaatgttaacattagattacgtggtagtattttgttcaataaaataaggttggtattttaaagtgtcattatatttttattagtgtctaatacagttttaatataaattggtcatgtttgatataaatatttaaaacatgactatttattatgtctttgatttatttgtgtagtaaggaagttatttttactcccagaggttgtctccctccccctttcctcatctaacacacaatttattgtacgtgaggcctgatcctatgtttattacagggatttgcataaggactacaggaaaccaacaccattttactatgttcccattgcaagaaataaaatggtgcctttgagtaaagctgcttcatcagacactagttcagcatgccaagttaaagccatcaatggtgaaacagcagatgtgaaggctagttggcatgaaagcatatgagtcaaagactttcctatgggaaagaaagtgcttcattacactttatctatagtgagaacattgggtttatcaagctgtctgaaaattagaatatgatgagttttattactcttgctctgccagagtgaattcaatggttaaaaagaaagcaataacaccattttaggaattataagaagtgattaggtttttagcgtatttaaacttggaaggagcagcaacttttatcttcgaaagtagcctctctaaaatatctaagggacagaagtttaatccttttctaattgctacatttgcaatatgtattaacgcagctttgggcgctttaactgaataaagaagttgtatgcttgactgaagtgtaaaatctgagaaacaatgttttaattgccttggaaaacatgtgcatgaggccctgccactccagcatacactagtatgctatggttctctccctcccttgtcctccctcctttactctgtgcaaggaccattcctgctgtttgtcaagtcaggttggcagctcaaacactgtgtcccaactcatcagtcttaggagagagggccccacagggagtgagaaaactcaaaagtcagttaatacagtgatgttgagctaacatgtcaagtgctggataatggataatagttgtcactgcaagagttcatagccactggttaggcaacattctgaaggaaattcaagaaggacatattttggatgcaaaaaataggctgagataaatattatccaaaaataccttgacattctaaaaattttagtgctttatatcttacataaaaaaactaaaatgacaaattccatttcttctatataaattgctgaatagaagcatcatttggtatttttaaaacaaacatacaaacaaaaaaacccagactctactttgttaatgttttgaggaaattatacttattgacattgtggctatgaaatatctattgatcgttttgggggtggggggtgttgctgctctgacttttgagtatcagcaaagacatattgttctcatttcttagatagcccattaattacaaggtgaatatcctgaaatttgtacttaatttaaaatatccttggcagtttaatggtcttgattttccacattattatgctgtcttttcagggagaagctattcttttgttgcaaaggcattttagactaattagcatctttggtcagctgaattttcatttgttcatttgttttcctgtctctttccaaaagccacattattctaaaaacagtaatatcactttgttgtttgttattaagagctgattgaagataccacatactagttaagttttttttttctttctttatgaagcaaaaggagatttactattatttgctgctactgccatcttcaatattagactcttatttaaagataatactgtactatttttccccttgggagcaagcaagatgtcaagtgatgcacccttctgatgctcaataatcttaccactttatcatgcatatttgcaaggatgaagcacagtttataaatcatctctgtttattttacattcttccccttaactccagatagatcaggaaaaggacaaaataaattttggtgcttgttcataagtgttgataactgcaaactgaatataataaattcctcaaaaatactgctttaagaaattaaacttggtcaaacattgatggtaaatgtcttattcttaaagagatcttattctgaaacaacttgaatctttgtttttatgctgtgatattagtggctgtggcagtgcctagaattgtttaattgcctaatgcacaaaggtgagcactttgattgatgtgtattcagagaagtactttaataattttataaataaagaactctccagatgactgaatgtgtctgtgtgtgtatgtacatgaagagtgtgttctgtaagaataaggtatgctttcttaatttgagttaaattatggatggttatataattcatttttctatacccagtttccatcttaaatctatttagagaaagaatagttcagggttggcgataaaatgtacttttacatttcctgatagtatttgaattatgcttctgattgtcattagcctattgtatacaccatagcacaagtgagttcagtgaaaagatttgattatctctaaaggtaggtgtttcatttattaagtattgtaattacagctaattagaagctacacattatattagtttgctttgtaggtcccttgactgttttcagaacactatgagcttatggttcatttcaatttattacaaaaacaatttaataaaagccaaagaattgggaaacagcattactaatggatataatttattgttgagtcaatataatagtttaacataattattaaaggcatagaccaagttgtggcgtgaaatcctacattcctcaatcaatacagatttatttaatttctctgggtttctgcttttttgaatttatctcccatagataaatcgagagtatatgtcttatatattgttcgtattaccactgaacatgtactaaattcccaatatatatttgctattatccttattgtgaggagcttaaatgttgaattgttaaatttcggtagcagatgaaaccatttcccccaatatgaataccgtacttttgcaaatacaggttacctatggttaatgctacaatctgacactcagttgcattctcatttcattaataatttggtcctgattttagattattaataaacaaatattctggattactctctaatctcactgaaaagataaagtacatcaggaatctgtttccatgtacacattacagatagtcaatcttttaaaacggattttattattttagtgcagttccatggtcacagcaaaatcaacatcgtgggactttaaatatatcaattcacattcttcaagagtttttgtcagccttctctttcaaaaccagaaaataaaaacccagcctgactccaacaaatagatataactaaactgagggacttaggattccatattgtcagaatgaaaagtggtgacaacccaagatggttatgactgagtgaaatgaattttattaaacacgaccttttttatgatctacctggaaaattttaacaattagggaggtgtttcagaaaggatgcccccaatttggtggtgatagttatgatgagagttgtgttgaaggaagtgttgattgtgacagaagcccccttggaaatttagaaacaaatgtatgtttgtgagaaaaaaaataattaactttcagataaacagcaaaagttcttcacaagaagccaaatatactagtattagcaaaaggataacacttccaaatttagaaatatgtctgcctttgaagctggctgagaactaatttttgtgcaggcaggattcttgagatcactgtttgtggcttttgttttaatgaagcagcttatgagtagcatcaagtcttccaggctttactttcaggactgctgtttccctgggggcctaacaattgcaagtggccctttcattgatttttattaccaatgccagagtgtacataatcattttagtcaaactcttacagctgaaacaagtaaatctattgcattttgaaaataaaaatagtggctaacctgtttccatctttatttattattattattttttctgcattgttagtaaccatgtaatagctgtcacgtctacctttctcactcatctttattctgggtgatgtttctttcctaatctcaggcctaatgtgttgcccctgctgtgtcctggaaatgaggttgcagtgatttacttttactagccattagagaaacactttagtattttgtcttatttcccttctttgaattccacaaacttcgaaagtatcaaaagtagtagtgtactctaaaactcttccaagaaattttactatgtaaggctaaggaataaactagatttttattttcttatggcttctaataaaacatgtgtggttatagagcacatgtaatacatctagtgcactgaggagtaaaatatgaaatttcaattatttaatttttattaaattgaaattttaaaaccaaagcagtgcaagacatttttgcaataaacttaaacatatatttcattttaacctttgcctcatataagatgttgtattatagagcatgtgatttgtgcatgagttgtttccaacacatcagtgatgtactcagtggcaatgatttgattcagtttaaatgatttcttctatgtactactgtaacattgtaatgtgtttatttgaatattttatgtaggtgaaataaattacaattataactatctaaaccatatgattattaaattgaaatgcatactattattttaatcaaaatataattaaattatttttctagtttaaaaatacatatgggcaaatttctaatttaaaatgaagttacactattaagaagaattaaatgaaaatgtagaaactggtactacaactggaagagtaaagaataagagagtctggataaggatatgttaactggtttcacaatgaatgaacattgcaatttgctgcaacaaagcaaaatggaaaagttgtttgtcacatatatatttttaagatattaaactggtcattatcaacatacattctcagaaaatacaaactgaatttgatatgcaattttttttttcttaatagtaaaaaaaagaaacaaggaagttaaccaaagttagagtcaaatgttcaatacatttaaaaatatgttttgacagagtctgaagttacacttttggactgttatacaatggcttggatttttaaacaaagagaccatttttggatggaaagatggtaacatatgttatttcaattatgattagtttgttacaaagttgtaaaaatgagattaaaagaaatattgtaaataagcaaaagatctttaattaatcaactaaaaaattgcccatagtttacaatagctttctaaccataggaaaaatcagttgatcctaatttttaaaaatggcaaaccagtgccttttttaagattagaatgaagtatacaatatgagaaactgtccaattaatactttgggtacattttttcctcaaatgactcccagatttaggagaaaaatttcaatttttgaaataaataaagaactagtggcataggttttttttgtatctcttacagctattaaatattaatttcagctagaaatagaaaatttagtttattacaagatggtcacgatgatggatgctctagctatgttaggttaaaaaaaaacacagatttattataattttaaaacaaaagactgatgtttttccttgatgtgatttggctctgtttccccacacaaatctcatgtcaaattgtaatccccatgtgttgaaagagcggcctgatgggagatgactgaatcatgggggcattttctaatcgtttagcatcatctccattttcaagtagttctttatagcactgtgaaacagactaatatagaaattggtaccaggagagtaggggactgctctaaagatacctgaacatgtggaagcaactttggaactaggtaacgggaagagatttgaacaattctgagggctcagaagaagacaggaatatgtgggaaagttaggaacttcctagagacttgttgaatggttttgaccaaaatgctgatagtgatatggacagtgaagtccaggctgaggtcgtctgagacggagatgatgaacttattgggaactggagtacaggtcactcttgtaatgctttagaaaagagactggtggcattgtgctcttgctctagggatctgtggaactttgagcttgatagagatgatttaggatatttggtggaagaaatttcaaagcagcaaagtattcatgatgtggcctggcttctactaacagcatacagtcatacatgttcacaaagagatggtctgaaattagaacttatgtttgaaagggaagcaaagcataaaagtttggataatttttagcttgaacatgtggtagaaaagaaaaattcattttctgaggaggaatttaagcaactggctgcagaaatttgcataaatgaagaagagtagaatgttaatagccaagataataaggaaaatgtctccaaggcatttcagagatctttgtagcagctcctcccttcgcaggcctagaggcctaggaggggaaaaaaatggattcatgggccaggtccagagctctgcagctctgtgcagcctcaggacatggcaccctgagtagcagccactccagctccagccatggctctaaggatccaaggtacagctcaggccattgtttcagagagtgcaagccccaaaccttggcagcttccatgtggtgttgggcctgtgggtgcacagaaggcaagaatgaggtttggaatcttcacctagattttagaggacgtatggaaacacctggctgtccaggcagaaatttgctgcaggggtgaagccctcatggaaaacctgcagtaggtgtggaggggaaatgtggggttggagcccccacacagagtctccactggggcactgcctaatggaaatgtgagagaagggccactgtcctccagactctagaatagcagatccaccaacagtttgtatcttgcacctggaaaagccacagacactcaacactagcccgtgaaagcagctgcagaggctgtaccctaaagagccacagaagcaaagctgcccaggccttgggagcccacctcttgcatcagcataccctgtatgtgagacatggagtcaaagaaggttattttggaactttaagatttaatgactgccctactggattttggaattccatggggcctgtagccccttagtcttgaccagtttttccctgttgcaatgggagcatttacccaatgcctagatcttcactgtatcttggaagtaactaacttgtttttgattttacaggctcataggcaaaagatacttatcttgtctcagatgaaacttggattggacttttgggttaatgctggacactgttggaaaagcatgattgcgttttgaaatgtgagaaggacatgcaatttgggaggggaaagggtggaatgattggtttggctctgtgtccctacccaaatctcatgtagagttgtaattcccatgttttgaaggaggggcctggcaggaggtgattggctcatgagggcggtttttaatggtttagcaccgtcctcccaatgctgtctcataagtgagttctcatgagatctgataattttaaagtgtgtggcacctaccccttctctctctcctgctaccatgtaaggcatgtcttgcttccccttcaccttccatcatgatcatatgtttcctgagctctccctagccatgtagaactttgactcaattaaacctcttttctttacaaattactcatttttaggtagttctttatagaagtgtgaaaatgaactaataaatccttttagctttactatatgacactgaaattatttgtgttcagttttctgaagcagactctgtgacaagtgtcatagacacagttgttaatattatttagtgtatatgtgtaagtgctatgactcattgccagtttgtagaactattgaaagaaatagaagataacaaatgttaatggttttgtaattttttgccaaattgctctttggttgagtcaaagaatacaaagatttactgtattgtctattcctactcaaagatgcatgaaattaaattatttctagatattcaataatcaaagataaaaataatagtttgttttatgttttttgtgctaatatcacactgaacaaaagcaaactaaattgaatttcaaaagaaaaaaatattttttatctagaaagctgtaataattcattataataggaaattatcataataaaggtcaataaaagtgatttttcacatttttttaaagagtcaatatacagattttagttgctgtcagcagtattatagcaaacttgtagtctcaaaaactacatgtaaaatttaaaaactttgttttgagattgataaatttagagattttcagtttatacaattttcctttgacttcagtgttaataattcttagttgatgtaagcattagtaaattacttcacttggaaagataaacagacataacttttgaacaagaatatgtgctttgaagccaaattaattcttaaaaagttaagaaagatgaacaagttttaccaacatgttgtgtatattacaggaaaattgcttttagtacttagttcaattattggaaatttgtttgaaacaacttgggtatatggaactagtattttaactgatttttttttagctttttaggtttatgcaatcaatacaacttaagcgtcttaaatgaaaatttagtgtctgaattgagatatgttttcagtgtaaaatttacgttggatttcaaaactaaaataatgtgaaacatctctctaataatttttatattgagaatgtctcatagtcacttaaaatccagtaaattcaaaatggagtctttatttgttcccagtttcatcattccatgattattctccattctaacagagggcaatgccatcaatgctgttgctcacctctcatatctaacccatgagcatgtacttttggttgtaccttcaaaatacattgcatctaaaagctattcacagctctccatatctatcgccaacaccttaatctaagtaatcagtaagccatttagtaagctcaacaccttaatttaatcagtaagccatttagtaagcttataagtttactactattttgtctgcatcatcagttgttccatttcaatcactttcctaagagtatttaaagggatcacaaacaaacaaataaatcaacataactcctctgtaaagtgagttttctctttactttttacttataacacatgttccttccatgataacattctaaattcattgttttcatttatgttattcttcttgtgactagaatgtgaatttcatgaggtcaaagacttagtaactagagcattctggtagataatagattctctatctactgttttttttttttttcatttttatgagatagcaaattaatccttgtaagtaaattaatcaatataagattattaatcataatctttaatcatgtttatgatatagtaaattaatcaatataagtaaaataagccaggataaaccattttacataccctaattgttacaaaatataacatatacacagaataattttccaaaacataatttgtataacattaggtgttttgagattagtaaagttagtatgttaagaaaaatttagaaagtgaagaaaatggaaataagacaataattattaatgagaacacaaacatgcacacatatcttctgatatatataatatgtatgtgtgtgcatacacacacatacctatatctgtaatgaaattggggcaatgctataaacataacttcagaagattttctaagcctgggcaacaacccccatctttacaaaaaataaaaacattagccagggtgtggtggcacatgactgtagttccaactacacaggaggctgaggtgggaggatcatttaagcctgggaggttaaggttgcagtgagtcgtattcacctcattgcacttagtcttggattgctgttgaaaaaaaaaataagaaaagaaacattttgatttttaattagctattatgaataatgcttatttgtaaatacgtaacaaactatctaatcattgaattaaaggaatatgacagtgtcttcatcgaagccatgactgcaccagaacaagttaacacaggcaaggcgattattgtagtaaagaggagatgccaggattcagtctgaactcaattctactgctcaaaggactggagggtgtttaaaagttggagagggggatggaggcagagtggtattgtaaaccatttatttttgctagttggtcctacccaatggaaaacaaactttttgatatcttcatgacaggagatagttctacaacttggagcaaggtacccactgaagttaaatttctaccctcccacagagaatgttacacagggacactagcttcctagatgattacagttcaaaaagggctcctaggaccttgagcaaaacgttgctaccttgtaatattagcaagaaacttttaaaaagatttacattccaaaagagtcaaagaaataatttacgattataatttttcaaaggtgtgctctgagaaaagagaggtcaggggcttagagtccagaagaagcatgcctaaagtttaatcaagctgaaatgaatgaaattgtcttgatcacttgatacaacaccctttagagacattgaagtaatttttaatactaacaatatgtaactgggtgattcttcttcctattctcatttttagtgtgaattatagagtattgagaatttttaatgagggaaatattatcattattttattttgaattgttttgatcataacaggaattaaacattttaaaatgtttataacaaagaaactttaatcttacagacttaaatgttggaatatcattattttaatttggtttaaaaaattgtatgcagtctgcattccactaagtttcttaacctataaaacaagtattttttaaggagcattataagtacagagattcatgctaatggcattcagctcattaataattatgttgtagtaaagctgagaaaatgtgatataagagaaacacttgcttatttaaatatgtcagttttatttccttctgtttgctttgttaaaacatgcatataattttggataaaaatgtgttggatactgaaagcctgcctcttattataacaaaggcattaattagacatgagaggtccgcaccatgatcccaaatgttatatttcaatacacatgttcagaaagtaatctttcagacattagtaggtgtgttaaatgactataatcctgagcacctacatcgacactttatcctttgatatttgtcagacatgcttaaccccaactaggagaatgttgtttttattaataattatttcaggtaatacctgattaggtctaatgagtgcttggcagtcttcatattggaatgaagtctgtgtgaacgtttaccaaaatgtagaaaccttggaatatttgacaaatgtttatttttaaaaaatggcctctaatctcagtttgaatttacacttattttatttttcagtttatttgtttggaaaatattcctattacctttaaattgactttttagagaagttttacaaatacattatttttaaatacaagaacaaacaggaaaacggagttaagttttatatggcagtggtgatagaatggttgggtaggagcatgaatactgagtaattatatttattatgtccttattcctgtgtcttcaaaacagaaaatgatttgaagaatcttagaactgtctttttttttttaaagtctcttccgtttacccagtaagtgacataagccacaagttactattttttacatctaaatcagagccagtgttaaccatcagtgccattttaacgtgtgatcagttccttaactaatatatatatatacacacatatatagttatagttatatatagttatacataatatagttatatataaatatatttatagttatatataatatagttttatatagttatatatatacacatacacacatatatatgatacaatatatatgcaagcagatttttcagacccagaataaaatgttaaaaggtttttttattgttttaattaaatagagacagggtcccactacgttgcccagactagtcctgaactcttaggctaaagtgatcctgctgcctcagcctcccaaagcgttgggattacagggatgagccactgtgcctggcctaaaaagggttttaaagcaaaacaagaaaacaatcaaatttcatttatttattaaagaaagtaaataaacagatatcaaattgccaatatgaggcaaactcagggcaaatttaatttgcacctgggcacatttacagaattttgacatggcagttacttgactattcatcaaatgtgtaatttcctccagtcgtagcacacccactgtttaaatttgtgttctgaaaatataaacccaccacttaaaataattgcttattttattaattcaaatatacacacccattgattcataaattatcaacagtttaactttatgataaaaataatgtatatgttctatcttgtctcatcatttcttctggctatccatgatggaaagggagaataagagagcttttgttgttgttgttgtgtttttgcgattttttttttttgtgggtaccaacacttttcttttgcctccataggatttttaaatgcagccttataaccatgttaaatgcctagatttgattataatagaaatttatcaaattcttttaatttacacactcaggtttcttgtcaggtctaggaactcctctttgattatcttttttttgttatccttttaagttctggaatacatgtgcagaatgtgcatgtttgttacatagatatacacagtggtgtgctgcacccatccaaccgtcatctacattaagtatttctcctaatgctatccttcccctagtcccccatccccaaccggccccagtgtgtgatgttccctgccctgtgtccatgcgttctcattgttcaactcccacttataagtgagaatgtgtggtgtttggttttctgttcctgtgtttgctgagaatgatgctttctatcttcatccatgtccctgcaaaggacataaactcatccttttttatggctgcatagtatttcatggtgtatatgtgccacattttctttatccagtctatcattgatgggcatttgggttggttccaagtctttgctattgtgaatagtgctgcaataaacatgagtgtacatgtgtctttataagtgtagaattatttataatcctttgggtatatacctagtaatgggattgctgggccaaatggtatttctggttctagatgcttgaggaatcaccacactgtcttcatctttttgaaaatattatatgtctcaatcatgctgatttcatgttcaggaacagaacagaaatgagaaaatgagaaatgagtgagatctgacattggttttatgacctctatttattaaataactttctcattttttatttctcattttaatctcctgattttaagaaaatcagcctgttttgtaagttttttctacctgtttcaaaaagtcttataggcttgtatcacattgggactacaaaatgtgtttccattttgttgttgttgctggtaataaatcattttctaaaatctcttctccctctaagttatcaagataatactccttttcttgttttttggaccaatttttatagctttatgtttatctcaatctttggtgagaggaatttgattgggatttgtggttgaccagaggtcacttgaataaacctctctctctactaaaacttgaaagcaggcctacatgcaaactttgtagtccagttatcaatctcaggatccaaaattgttgttttgtgttttaacatggctctttgggcctgagatagaatggactcttaccctcaggaccttaaatctgatactctgaatgatgaagcagccccctttttagggcttctcttatcttccccacattttcatgacaaatgaagactattcccacctgcctctggaataggacagtcttccctgcccactacttgcttagttatttcctatcagttgtagcctctatttttttgtttttcatttttttctttatgtttttttattttgtctttattttttgtagcctctaaattagcacagaatacaagtactaacagtagtgggagccaggaaacacattccactggattcaaaattaatatctacaaaggtgaaggataactgctaagtgtactggatcagggagaacttataggtggcatagtgtagacaaagaaacaatggtatgcctaacacctttcaacatggtagtagcatttgacttcaagcaagggcgggccatagattttatttttaataaagtttaagcgtcattgtagttaaggacatttatttcagacttcagcaagaagttgtgtgtcagttccaatgttctgttgtgaatcgtcatttgttgtgtcttaccatattaatatattttactgtgatgttagtagagaaatcattgagtgcagtcatccaaacaccttttaaaactggaaatacataatctttaatgctttaaaatgtatttgcatatatgtgaaagtatcatctaaactgcaatcattataacccatgaagtgtgaagaaatcctgtattttctattttctttaacatgatggataaaaggtatttaagagagttgagaaactaacctttagtcctgtgtcaaatctgatagaattcatctttcaactatctgttaccactttctagacactgccaatagtaaaatcaattgttggagtaaatggaatggcttttggtataatgcacaaatgggtttaaattgaggattcaatatatgcgtgttttgtttaaatatttttgctttaagtgtaggttcatatgcagctgtaagaaataatacagagacattccatgtagactgatatggtttagctgtgttcccatccaaatctcatcttgaattgtagctctcataatccccacgtgtcatgggagggaaccagtggcccagtggcaagtaattgaatcatgtgggcagatttttcccatgctgttctggtgatagtgaataagtctcatgagatctgatgattttataaagagtagttcccctgcacatactttcttgcctgctgccatgttagacatgttttgctcttcttttgtcttccaccatgattgtgaagcctccccagccaagtggaactatgagtccattaaacctctttttctttacacccagtctggggtatttcttcatagcagcatgagaagtaactaatacatagcctttaagagtcccacaatgtaatatcatgaaaagcaataggacattatcacaacgatgttggcattgttagagaaaagacaggtaacatttccgtcatcacaaacacatcatgttttccttcaacagtcataaccttttttctcccacatccccttcgttagctcttgacagtgcctaatctgttctccatttcagcaattttgtcacttcaagaatgttacataaatggaatcatcctctatgacggaaccatccagtatgtaaccttttggtattagctttttccacttagcttaattctctggaggttcatccaggttgttatgagaatcaatagtctgttcctttttactgctgagtaaccttcaatggtatggttttaccacagtttatttaagcatttactggttgaagtacaactgggttgttttggggttttggctattttgagcaaagctgctatgaatatccatgtacaggttttgtgtgaacattagcttttctttccatgtgaccaaagcccaagtgtgcaattgcagagttgaattatagttccaagttttgttcagttttttttttaaataaaagctctattaagatgtaatttatataccatgtaattcacctgtttaaagtaaaaagttcaagaatttttagtatattcagaactgcataatcaccacaatattttttttttttttgaggcggagtctcgctccatctctcaggctggagtgcagtggcacgatcttggctcactgcaagctccgcctcctgggttcacgccattctcctgcctcagcatcctgagtagctgggaccacaggtgcccgccaccacacccagctaattttttgtatttttagtagagacggggtttcaccgtgttagccaggatggtctggatctcctgacttcttgatctgcccatctcggcctcccaaagtgtcaccacaataatttttaaaactttttcaacattttgaaaataaaccatgtactcattaacaatcattccccatttacttaaaatgtccactctccaccatacctaataaaccactaatctgcttctgactataaaacttcttagtctgaatatttaatgtaaacagtgatatagaataaatgctctttggctttaactgaactttcatctgtgtttcagtgtgtatcaaaattttattcttctttttgcagaataatattgtactacattgatataacaaattttatttatctgtttatcagaggatggacatttgaattgcttccactttttggatattataaataatactgctataaatattaatgtatgagttttggggtagatgtatattttaatttttcttgggtctataagcagaattcatgggtcaagtggtaaatatatgtttaaccatttgaggaaaatcaaactactttctaaatggctgcacaattttacattgcctttagcagtgtacaagggctccagtttcttcacatcctcaccaacacttactattttctgtttttatgattatagccatcctagtgtgagaaagtgctatctcctcatggctttgatttgtacttccctgatagctaatgtggttgagcatcttttatgtgcttattcaccatttgtatatctttggagaaatgtttattcagatcctttgctcatttttaaattaggttgtctttttatcattgaattgtaagagtatttttacattttatagatagaaatccctcatcagaaatatgatttgcaaaagttatttttccattcttgggttatcattttactttgttcatcgtgtcctttgatatacaaaagcttttactattaatgacatttattataattatttattgtttggatccttgcttttgatgttatatcaaaggagacttttcccaacccaaggtcctaaagagttactactatatttttttctaagagttttatagttttaacttttatatttagttctacaattcactttgatttaatttttgtgtatgatgtgaaggacaaacacaattccatccctttgtatgtagatatcaaagtgtcccaacacagtgtgttgaagactattctttccctctttgaattgttttggtactctagtaaaacaagaaatgaccataatgtaagggtttatttctgaacctttaattcttttcaattaatctgtatgtctatccatatctacataccacatggtcttgcttactgtagtttggaaattaggaagatcatcagtttccttttttatttcaagattgttttgactatgtcaggttccctgcatctataagaattttgggataactgacaaatttctgcaaaaagccacatgaggtattaattttatgtttatttgggaagtattgttatcttaacaatattaagtcttttgatccatgcacttgagatgtttttcaaattatttaggtcttctttaatttctttcaaggtgttttcacttttattattagatcttgcacttctttaaagaatagatccctctgtattgtattctcttcaatactattataaatataacaatttttataatttcattttctgatagttcaattttatatatagaaatataagtgatttttgtatagtgattttacatactgcagtgggttagaactcttctattaattctcaaagtgttagtagatatatctggatttcctatatacaagatcctgtcaactacaaagagagatagtttaaggttttctttccaatctggatgcctttgtgttttttttcttgcctttatggcctggcaatatgagaattacagtataatgttgaatgtaaatgagaaaggtgtacactgttatcttgctcctaatatcgggggaaaacatttttccttacaccattattacattaggtgtggatttttcacagatgccttaaacaatgttgaaggcattcccttccttcattgattgagtgcttttcaatcactccagaggtactgaatttgtcaatgcttttcctgagtttactgagatggtcctctgatttttcctttattttactgataaaatatattatatttatttgtttgtgcactttaaaacaacctcacattatttaattaaatcccacttggtcttggtgtataattatttttctgtgatgctggagtcagtgtgctggtattttgttgatacattttgcatctatattcataagatatattgatatgtagtttgtttttcttgtgatttttttggggggttttgatatcaggttgacactggcctcatggagtgagttggaaagtgtccctgcctcttttgctttttggaataatttatgaagaaatggtattaattttgctttaaatgtttgacggatttcaccagtaaagccgtttggtcctaagcttttatctccaggaagtgttaacaattatatatccagcctgggcacagtggctcatgtctgtaatcctaacactttgggaggccaaagcaggaagtttgcttgaatccaggagttcaaagctaccataggcaacaaagtgaggtgagttcccatatctaaaagagaaacaaaaaaaagcagacaggcatggtggaatgctcccacacacccagagtcccagcctgagcaacagagcaaggccttctctctctctctctctctctcccccccatttcttttacagtcagatttggtagtttgtgttttttaaggaatttatccatttcatctatattgtctaatttgtggccacacagctatacatattattcccttttaatcctttttttttctgttagattgtaggcaatcatctcactttcatttctgatattgataattttgttattcttgctaaaagtttgtaagtattgttgatcttttcaaagacttggctttgtgtttctttgattctctctctttttcaagttgttgcttcattagttttcattctagtttttattattttcttccttctgctttattcgagtgtactttgctcttctttttccactgctttatgttgaaggttaggtcattgatatgaggtcatttttctttttaaatataatcatttacatttataaatttctctctaagcactgctttaacttcatcctacaagttttattatgtcacgtatttttattcagctaataatatgtccttatgtcagtgtgatgtgttcttttatctttaaattactaacgcattttaaatttccataaatctatttctttctgttattaattctttgtttttaccctttggcctaagcaaaaaacttatgactaagtcctcatttctatcagaattttgggataactgaccaatttctgcaaaaagccacatgagatattaattttatatctatttggagaatattgttaccttaacaatattatgtcttttgatccacgaacttgagatttttaaatttatttttaaagatttcaggggtacaagtgcagttttgtttcatggatatattgcgtagtggtgaagtcttggttttaatgtgctcatcgccccaatagtgaacattgtacacaataggtaattttcaatcctcactcccttcccaacctcctaccttttcatagctccggtgtctattattaccctgtctatgtccatgtgtacccattgttaattcctacttttaaatgagaatatgaggtatttgactttctgtttctgaattatttcacttaagatactgatctcctgctttatctatgttgttgcaaaagacatgatttcattcttttttatggctaagtagtattacatggggtgtatgtgtgtgtatatatgtgtgtatatatatataaaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcacttttttctaaatgtgctacaacatgtgttaatatttgaggttttaataatagccattctgtctggtgtacgatggtatttcactgtggttttaatttgcatttctctgataatttgtgccgttgaacatttttgtcatgttttttggctgcttgtatgtcttattctgaaaaatctcttcaaatctttcacccactttttaatgggcttgtttttgtcttatagagttgtttgagttctttgtaaattctggatattagccctatgtcacacacatagttttcaaacattttcttccattctgtaggttattagtcttttgattgtgattttcttatttatttatttttattatttatttatttatttattttttactgtgcagacactttctagtttaagtcccttttgtctgtttttgttttagttgtgtttgcttttgaggacttagttataattttttgttgtttgttttggccaatgtccagaagacattttcaaaggttcccttcaggaatttttatagtttcagatcttacattcaggaatttaattcatcttgagttaatttgtatatggtgagagatatggatctagtttcattcctctatgtatggcaatccagttttcccagcaccatttattgaataggatgtcttttctccagtgtatacttttgtcaattttgttgaagatcagttggttgtaggtatgtggctttattgatgtattctatattacattccagtgatctatgtgtctctatttataccagcaccatgctgttttagttactgtaaccttgtagtatattttagacaggtaatgtgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctctagctagaaattccaggactatgttgaatatgagaggtaaaaatgtgcatccttgtcttgttccagtttttaaagagaatgttttcaactttttcctgtttagtatgatgttgcctatgggtttgttatatatggcctttattattttaggtaagtttatatgatacctggtgtgctgagtgtttttatcattaatgggtgctgaattttataaaattattttttctgaatctattgagatgagcatatggtttttgttttaaattctgtttatgtggtgaatcacatttattaatttgcatgtgttgaaccattcttgaatccctgaaataaaacccacttgattatggtgtattacatttctgatgtactgttgcatttggcttgctagtattttttagaggattattgtgtttacattcatcagggatattggcctatagttttctatttttgtggtattcttgcctggctttggtatcagggtgatactggcttcatagaatgagttagggaggattctcttctcatcaattttatgcaacagttatagtaaaattgataccataaaattgattgataccatcaataaaattgatcaattttatagtaaaatttatactggtatcaatggcttcatgtggcaatcatatggcttcacatgtctggtaacatttggctgtacatccctctggtcctgggctcatatctgttggacaattttttcattactgattcaatgtcattactcattattgtctgttaaagatttctatttcttcttgttacagtcttaggagaaattttctctagtttttctagtttgtatgcctagtgatactcatagcagtctttgatgatcttttgtatttctgtggtatcacttgtagtcacacctttatcttttctgattgtgcttaagacttctctccatttttcatggttgatctagctaacaatctatcaatattgtttatgatttcaaaaagccaatttttattttgttgatcctttgtatttttttgttgttctcaatttcatttagttcttttctgatctttgttatttcttttcttctctgagctttgggtttggtctgctcttgaatttctattcccttgagggacttgttagggttgttaatttggaatatttctatctttctaatgtaggtttttaacaccgatgaaaattttgttgagagtccctttagaagtgattagacacttctctcttgctgcttttaggatttttttccttcatattggctttggataacctaataactatatgtgataatgagtttcatcttgtaaagtatgttccaagtattcactgagcttgttgtatttggatacctaattccctggccagaccagggacattttcctggattgttcccacaaataagtttccccagctttttcttcttctccctcaggaatgcctataattcataggtttggttactttacgtaatcttttatttctcaaagcctttttttagtgttttgtttttttttttttgtctgacttggttaattcagaaggcttgtctttaagctctgattatttttcttctacttgctctaatggtaaggcttccaaatgtatcttgtaattatttcaataattttttttattttcagaagttctgtttttttaaaaattatctgtaataatttttaattaacatcctgatttttcttctgatttctttggtttttagctttctcttggatctcattaagcttcctcacaatctatattttgaattctttatctgtcatttcagaattttcatttagttttggatccattgctagacagttagtgtgttcctttggaggggttaaagcactctgtttttccatggtgccatagtttttatgttagttccttctcatcctggagaaattgtcatttattttttaatttactttcttttagatggtacttttttaaattttttctcttgagggcgtaactgtaatgtatgttgtgtagggctgtttggcttcaattctgggtgctttcaggggccaagcctctgtatgagttccttggttgtagataaccttggttataaatacagttcctttatgtggtggctttttcaaatgctgattatagtagcaatgtactcggcctatgagcaggactaacaccttctgtgggactgaggttatggaagtctcaggaaacttaccttattccgcagcacaatgctcttctgacagaagatttttaatttgattgtgcagtccaatctccagttcattaggtggtagttacgggtaacagctgtctgtggtatatacttgatctttgtttactgagaagggctctgttgtcacatgtagtgggctggtctgtcaaatgactggtgtcctgacttccctgctgaagggtacaggtgggacaaagctgggcagagctggaccaccaaactcaccctcagataccccaatgataagttaatgtatccaccttgactggagtgacagggagaggttatagtgaaagcctcccatgtttctcccagttccacatcatgggcaggcaggaaagtggtcaacctccacatcacacccttcttccagggctcaggactttcatttcagatagacattgtagttcatcttcaggactcaatgtaactgagggttccagcaaatccctaccccatagctaccaacaaaatgacctcgggagaaacctctttcctcaaccccaaacagacagctttgtggctcactcacctgtactctgcagcgggaatgctgctgttctgtgtagagtgagggatggactccaccattcttgcaagctgggctaatggacataccaggagtgggagtgcaactcctcctaatagtcctataatagttctccctaggcatacccatgccaacgccccccacgaaagaacagctagctgcagctgcatccgcagctgtgggtcggcaggcagaagtccccctatccatctttgttcccaggcaccagtgccacctgctgctgggatggaaccacactctccctgacatagcctagcaccatgcccacatttctcatgcaatgggcgcagtaatcttcagctcacaagtggggagctcttgtgcagaggagagtgcacactccggtttttgttgttccaagggcacttcggcatgtgacactctcccttcccctagggagagctcaccctgaacgttagaattccgggaatcccacagctcccctttatcctgctggtcctttctggttgctgctgtccaagtagattctaaggaatgtctataagggatctactggtgttgaggcaagagctgagactctttgggtaggatagagatccacaatatgtgcccaactggtatggcacctactacctcagcttgggtcttgagagtggagggatggtaaaactgcatgagctagcagcctagtgctttgccctcaagaaatttgtaaacacaacccacagcagtacttgggttcatgagggcagaggggctctctgacattccagaaatcagcagtatgacacaggggtgaggggagcataaagtacccccatctaccttatccatgggactccaagatcttcaggggtcaatctctgccagactcttgcttccttctttttgtgtgccccagctttttcccatgggttctttaatagactgtggcactcttccctcggtattccactcaggatgtgattactaactggcaactctggttcttctttatgaaaactggcattcaatgcctctagtcagccatcttgaaaaaaaaacctcaactctgttattaatttgtaatgttattccattgtagcaaggcacatgctctgtgtgctttgaattatttcaaatgtattgaggcttgtttcatggcctggaatgtagactaccttggagtaccatgtgtacttgagaagggtgtatattttgctttattttgggtggagtgttccataaagacttcttagttctatctatcctattgttgttcaagtcttctatttcctaatagaacttctgcttatttgtcttatccattattgaaagtgagctactgaagtcctcaactctttttgctaattctccatttcacattttaattctgtaattttttgcttcatattttggggttatgttgtttggtgcatatatatttataattgttccttttttgataaattaacattattaaactagaataacaaaattgatctcaatataactataaaatatattttttatatctagtgattgtttttgtttttcaaacctactattccttatttctgtatagcctctctgtcttgtgatggccatttgcctgacatatcttttgctatctttatttttaaccttcctgtatctttgaatataaactgggttttctagataaaacaggcagttgaattttttttttatttttaatccagtgtgataaactgccttttgatttgattgtacaacagattagaatttaatgttattattgatatagttaaatttacatctgccaattaatttttatctttctaatgtctcttttgtcctctctcctttaccagttttgcattaagataatattttcttgtgtaacattttaatttaatgatttttctttgtattttttgttattttctttgtggttgatttaggacttatatatcttaatttataagaatctatttcatatttatacttatttaggatttttttttttttttttttttttttttttttttttttgagatggagtctagctctgtcgcccaggctggagtgcagtggcaccatctcagcttactgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccacccgcctcggcctcccaaagtgctgggattacaggcgtgagccaccgcgcccggccacttatttagtttaatatagaaacaatcctagaaagctctatttcctcttatccattttatgctctaatttttgtacatattatatgtatatatgctccaaacccaaccatacatcattatatatgctgcaaacccaacaatacatcatggagctagcagtctccacttaattgcttaccaataaaatttccattatttcagagagtacccttcaacttgaacttgcctacattcttttctaaataaagttaactcttttgggcagaacttcagaattctcagttcttattacctggctctcttcttgggcaaaatatgcaccactgctctggagctaatgggaaggagggtatgggttaaggttcaaattacatagatgcttgctattgttactgagatttgtgtttcttgaaaaaaaatacatataatttgctgtatatcttagaacaatttctggagactttaaatgtagatatataatatatacataattatatttcattaatgtataatatatacatactatatcattacacatataacatcatatataagattatagatacatgatatataataaaacaatgctaacacatatatgtataattaggtacatgattttgtgtatgatataacatatatgtatattattatattattgttatcaattgtgaatgtttcactggagaggaggtttgtgaaggtcctctgatcccagttagaagtggattttccttgtgttttaagagcctctagctattggggtttcagtaccagacctgttagcaaccctgtcctattgggaaatgaaggagaactagacatgggtgtttacagtgtgacttttgtgggatactacttctacctgctaggcagcctaatgtctagttctcaaacccgtgaccagggggtctcgcacacaggaaaggtgtttatattggaagatgcccttgtggctcttgtttgatccctgttcagtttatgcctgcctaaccattgctgcagcactgggatcctgactttttgttcttcctggcatcccagggaaattctggcctggggaagctgtagttctttgcatggaaggtgcaaatttgatacaccaccacagtaagaaacaagctcaaagactttttacttatggatcctaggcagggagaacacaatgagtcaggaggacagttctctgtctccaggtcatgcaaggcagaaatgtagagtcaggcatagagagagagagaacatgtggcaattagcaggatacataagggcatagggtgtagattatgttaagtttgcgggaaaatacctgaatagtttttttaaaggaagtagccggaaaatggataacctggtctgctaggcaggagagatgcatctaagctcttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcaggacatgtgcttaactgctttgcatcttaggtgtcctcctgtaaaactggataaagtaccaggtgtatagtgctgttttgcatattggcttagaaaaaatttgtaaaccttattttttcaatgtctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgtaaaatgtttcacattagtcttaataaaaaaagtaatgtttatttttgtaataatttatgtaagatatagctcagtgaaaacatattctccttgcatgttatcacacacaattgtttttgaatgacacaataatgtattgacattttatacttctgatttcacagtatatttgccattacttgttagtaacaaagcatcagtcataaatttgaagtctgtggaattggttaattttacctcatttgagtaaatctcaaatgaggtaaagtataggaggtaggaggaaggaaggaaggagaaagggagtataataactaattggagaaaaatatatttgataaaataatccttgtctgtataaaacaattttcaataataactgatatgtttccctaaaggtagtttataatctattattctttttataataattatgatgttatgtggtttggatttctttgtaatccacattagatagcatagaaactagtatataaccaataaatatttcgtgactgcatgtactttgtgtataactttatgtgccaaattcttgatacaaataatctgtaaattttctcctcatcagaaaattgtattctttgtctaccgtcattttgccattatcagaatgtatattttacatggcattcccaaattaaagttaattattctcccctatgaaacaatgtactttgtattttaacaaattgtttagctaaggaagaaaacaatttatttaggtaatgcaaatatgtcaacagataattgcattatagcagaagtttaatataaaagacacaaaagttttaggtgtgtcctgagaagtgattgatttctgtagggcagaagtaaaggagaaatttaaaaaatatattatgaatgttgcgatgcccaagtagatcttgagagtaacagaagtaatagagtttgacaaggctggagttcctgtaagaaaataagcatattactaaatccactttattctaattaattatttgttcagatcttaacttttataacaggatatgttgaggacctgaatgttctagtcatctgtttcccctgagcacataatgcaatcaatggcctgtgataggtgctcaagaaattgtcaatgcataagtgattcaatggataaaggaagagggacgaatatttgacaggcccatcccctcctcacttgctctgagctgtgtcctgagattatgattgataggatatcttatgaataaatccatcaaaactgagcaaactgggaaaatattaacaatttaatggttgatttttagctaagtcttataatccaaggcaaatacaatttcctcttttatactctccagtacttgttatgtactcatgttttgtagacaataaaaataaacttaattttatgcttggtaatcaataatttatagtgttttattgtgatattatgtattcatgataagtaactcaatgtaatattaagctaagttttaagttacctaaagatcttgaaaattttgttcaagctgacaaactataaaacaaaattatagttgaaataaaaagattgagagaattatgattcaacttctttaaaatatatttttataatattaaacatttttataggaatacatttttattttattagtaacctagtatacaaactttcaggaattcagattaaatagacttttcatgaggaaccaaacctaaatcttataaaaattaaattgcctacttgtatattacttaacattgatactttatataaagtcatataactgtttttcttctttaaatcattattaaaccagttgcgatttgatattttatagaaaatgcctttggggaattttttagaggttatcacaattcatgtattagaaattattttaaaatattctatgtatttgggaatattcaatttacataagcactttttaaaaataaattataacagtgattctttagcttaagagatgccacaatttaatgtacttttatcctctggatatagaagtgaagacctttctcaatttcaaacacagttgcatagtcacaaagacgacttgtacctgcagtctcatcacttcagtcacgggtcaaaagtgaacacgaaaacccaaccaaaaactttctagtccggatatcaggtgttttccttcccagtgggcaggaaacactttcccagttgatttgagatctacgcaaacaggtaaacaaacaacaagccaacaaaccagaatctcattcatgtttaacccaataacgaatagagtttcattattcatctcatagaaattaccaagtggtcagaacagaaaaccaaaatcttagtcattgctctcactaatgggggataatttatgcaccaacaagatctagaaataaaaatcaaaacaacaacaaaccaacaacccctcccaccccccaccatataaacagtaggagaaataggaggaaaaaagaactggagagtcaggaaaattaaagttctattgacgcttgagattctctctgagaactagaaaagatgtgacttcactcaaagatccttgaatgtgcccttctccagtaatacaatttatttggctctgtcaagtgaaacaataaaatataattttcaaaagttaaaaaaaaaccatgcatcttatgcaaatataaactgaacacatgatgaagattttattcaattattaattatggttcaaaggagaattttaaggacataaacacataggtacacacaatcaggaatgctgaaatgcatttgctaatagatgcaaagctttttaaaaccctttatatgtgataaaataagatgtttaggagttatatttcctacagagttaaagcaatttttttctttactgaataaaacaaatttgcattgctattaacaagaataatttgcattagtgtcagttttttacatgacaacttctactcctacaaaattgctactagtctggtcaatagaaggtcagtcaaaggagcatatcattatggaatcagacaatccccggagagtatgcaggtaatatccagcactctacaatatgaaacaatcattttaatatttctagatcctcagtctcaagatttgtttcttcacattgatttggctgagaacataaagatacatactttatgttcgccttatcttctcactttcctttcacacttgcacttcttgaacttggtaaacataaatcacactttcatccacccatcaaaaatgtgtgttctctgaggggaaaaaatcactgtggcatacacaaaaatattaattagaagtattgatgtttaagaagacttctaaaatgaggatactgtaaacctaccccttatcttcataatagatgcatttccaatataaatttattcattgttcataacacaatgaatacatttgtccaattgtgggctaaaaatagttttaattgtaactcaatagagaagaatattttaaacattaaagactcatgacaataaattttaagtaatatttaatcttaacactatataaacattttgaattataataaagtgactgaataaaatatttgcaagcataaaatatatttccttagaataacatgttatagaagtagggaacaacaatataaaagaaaatgaaccacatataatttataactgttgaaaagaggagttgggttgtgtattttttaaatgcatgattgtgggtggcaaacagctattgtattaatattctacacaggatgcatttgaagaagaatgtaacacttttccttaaaatatgaatagtgaaagtatgctagaagttatgtttatgcattttttagttcaatgataaaatatttgaatttgtatagcttcaaaatatttgttctatagcctgtttaatttatgttatttctcagtggcttacttttaatttcaggttcatttttccccaaattttcacttgttattttttaagagaaaggcctatgaaaatatgaacaatgacctcaaataattgatttcaactcataaaaataacaaagaataaaggagtaatactgagacaattgccgctgtttgacaactatgatagagcatatgaaaggataatttccgaactgatagtttttgttcactaatggaattatttttgtcttcataggatatacttttagtcttaatgcataatatttaatccatcacattaatctttgtagatgaaatgtcaatgactacatatataggattgtgtgtcttagataagtccacataaaacataaattggagtaatcataaggagcagcatacgagtttggtcagcaactgcttggtttgcaaattgtatgtgaaagacttggagttataataatggctctaggcttaaaaccaccatattaaccctcttgtttttactatcttcaatttattatatggcttggagagtgtgttctgcatgtgtagctctgtctctttttcctataatgttctcaaccatctcacctaattcaattttgtcagcactttgtaaaggcctgttagaccaatcccactgaaatcacatgcctatttttatatctacagcattttatgccctttttttggtgtttgaaaccttatacacagagattttcctcaataaaaatttgttgaattcattaataaattaaaaaataaaccaatcaatcaaatctaatgccaaagggccagagtaatgatttttttttttctctaggatttttggggcaaaaatgtggccatctcaagcagcttcaacattttaatttagggcaagcaagccccaaaatttgggcttggcccaggatggttcttgccatcacccaggaaagaatttaggcagccagtgttattagacaacaaattttattgaagtagcagtatacagcagctgtagaggtactgctcctttcagaccaggtcaaccccacagacagtgtgcctaaagtagcagctcagaggcagtttggctgtcgtatttatacccactttttattatatgaaaattaaatggtggattatgcagacatttataggacaggggtggtaatttccaagtcatcaggtcattgtcatgttctttaaagaagcagtaacatctgagtgttgttctggcaagggtaaacgacatggcacactggtgggcatgtcttatggaaagctactcatgccccatcccaatatttacagatgtgaacatctgtaaacattctttctgcaaatacatcctgcaattgtatttagttggtcctcaatttcatctaatgtctgagtcctgtctctgcagttaagtcctgcctcctgagtcaagtcccacctcctacctcaatttgagtttaagttgaaaaaacaaattttgcagaagtgaaggcaaaaaatgaaggcatatccaaatgatacaaatgacaatcattgtcaattaatcttctgtttttataagggcaaatatgattccagaagctcagcattattttggcataatgggaactgtaggaaaggcagatgatttccatagtatttatcactgcattccttgctgtgtatttcaaattctcttggagtttgtacttctaaattttagaaaaagttgtgaattttgaaattttttcagaaattggaaaatatttgtagatcaaattaaacagaaagccaatgagatatattcacatctgtaaacattcttttttatttcaaatatattttgttagctaaaaagtactcctgttgttatattatttagttttacaaccatttttctaattataacaaaaatgtatttctgcaacagtgatatatgtgtttatattaagagaaaataaatgtaatcttcttgtaaacattttattttgaaacaccggtctaacatctgtaaaccaaggcagtattatgtttccatatacttaagaataggtactcccagtgggagatgatataggatagaatggaaaatgtattatccattggaaagattctgttatgtgggcatgtcaaggttattttctaaacatttgtgtcacatccttcaaaaattcttatttttttcttttatttttataattgcaacttttattttagatacagaggacacgtgcagatctgttacatgggtatatttgtgacatttgttcagtggtagatacaaatagttttaattgtaactgaagtttggggtatgatcctgtcacccaggtattgagaatagtgtccaataggtagtttttcacccattgcctgtctccattccttccccttctagtagttcacattgtctattattcccatctttatgaccatgtatactcaaagtttagctctcagtcatcagtgagaacatacagtatttggccttctgttcttgcattaattcaccgaggattatggcctccagctgcatgcatgttgctgcaaaggacatgattttgttctttttttggcatcatagtattccaaggtatatatgcaccatattttctttatctgttccaccattgattggcatctgtgttgattctatgtctttgctattgtgaacagcactgtgatgaatgtatgaatgcatgtgtctttttggtagaatgatttattttcttttggacatatacccaataatgggattgctgggttgaaaggtagctctgtttttaagttttttgagtaatctccaaatggctttccacagtggctgaaatattaataatttacattctcacgaacagtgtataagcattcctatttctcccgagcctcaccagcatcattgttttttgtctgtttaataatcaccgttctgacgggtgtgagatggtatcttattgtggttttgatttacatttctctgatgactagtggtgatgaacattttttcatattcattgtctgcgtgtatgtcttcttttgagaagtatcggttcatgtcctttgcccactttttaatggaatcatttgtttattgcttgttgatttattttagttccttatggattctggattttagacctttgttggatgcagtttgtgaatgttttcttctattctgtaggttgtctgtttactctgtcgatagtttctttaatttggtcctacttttattgcaattgcttttggggacttggccaaaattatttgccaaggtcaatgtcaagaagagtatttcctaggtttgtagtcgaaggtcttatatttaaatctttaattaatcttgggttgatttttatatatggtgaaaggtaggagtatggttttattcttctgcacatggctagccagttatccctgcaccatttcttgaatagagagtccctttcccatggcttgtttttgtcagctttgttgaagatcagatggttttaggtgtgtggttttatttatgggttctttattctgttccattgatctatgtgtctatttttgtatcagtaccatgctgttttgattattgcagccttatagtttagtttgaagccaggtagtgtgatgcctcaagctttgttctttttgcttatgatcactttggctctctgggctccaaaatctaatacacttttctatgtctagtagggactaactctctgcccagagtttaatcatgaaattagtgagccagtgttactaatagaaatatgacctatctctcagacataatagggcataaaaacttcagcggctgaaaaatcatctgaaagactttttaaaaatgtacaatctgagccatttttttctgatttactgtatcaaaaactctagagttggatctagaattcagtatttttagcaagcacttgaagtaatgtttctaaacactaaaatttcaaagcaataactccttaataaatgacaccacttttacatacatttatgactatagttgtaagtatgcgtaataaacattcaatctcaataatatccaaaaatgcaagaacataaagatcttctacaatgaaagacacattaaaacttataatgcaagacatagaaagattctcactaccataacctttcaggagaaagttttttgctgccttttcctcagaaatttagaatcactatgatattttgaaatctttatgaacctcaagatgtttacttttagatcttgttttaaacatactaccaattataagattgtttatattaaatgataattttaaaggatcaggaatgtgataatattgtcaagtattggggggaaattgccctaaatagcattataaataaatcatccaatcatcagtgttactcaaagttcattctttggaaccctattaccttcagatacagtacgaactaaaagcattattgttatcaaataggtgtgagaaatgatgcattgtatagcacatctgattgcagtgaatcacaatgcacaataacatatctaaggctctggagaggtcttacaagtgctcaaccttcccaatacagtttagcccaactaatacatagtaatatattgagaagaaatatacatttggatatactaatttatatgactcgtacaattggtccctttaaattggcaatcaacatatactttattaaattatactacttccaagttctgaaagttatttttaataatagagtctctactatacaaatctaactggttatgtctaggaaaatttagccatcttgtctttttgtaaataattgtgaataaaaattcattttataaaatgtaaataataccaatgagtattataaagtaccaaacaaaaaaaagacatgcaaaatcttttatactttattttaaaataatttttgagtacgtactatgtctgccagaaaatgtgcaagattctgtggaaattgatcaatagtagatatacgtcctgccctccttgaggttatgatatcatagagaagataaatgttaagatactattaggcatatgttgaatgctagctaaaaaagtggcgggtgctatagaaactgcattagtcaaagttctacagaaaaacagaacatacacacacataaagaaatttaatttaaaggattggctcacacaattatagggacttcggaaagtctcaatctgtaagcaagccagcaggctggcaactccggcaggggaatgctacagtattgaggaagaatttcttttctgagaaatcttagattttgctctcaatgcctttcaactgattggtcgaagctcatccacatcatcaaggacaatctcctttacttaaagtcagttgattgtagatgttagccacacatacaaaatagcttcaagcatcacctagatttgtgtttgattaaatagctgggtactaacctagccagattgatacataaaactaactatcacagcaatatataagggggcatatataaaacagttaatcaatcaaactgggaagctcaagataggttttatttaaaaatcgaattgaatttaactgagacttgaaataaaaatagagttaggtaaaaattaagggtaaattatagggtaaggtaggatcaagaagacaaaaaatcttatatagaaatattcaaacatgaaaagaatagtgctgattattttgtttctttcttttatataggaagcacaaaaaaaggaaggagtcaaggatgattttttgattccacagagtgagttatagaaccacaaaaaggaaaatagtagagaaaaatcgtagtttcagtttggggtctgttaactttgaaatacctatgagccctccacacagagatatctagtaagaatataagaatatgggcctagagagattaggtttggtgttgttaactcaagtaatctaaatcttgggaatagatgaaatcacctggggaagtgtagggtgaagagacaggtatttagtcagtgacctgtggcacttaattcaccaagatttaataggaaaataacccaaaaaaggagattgagagagcagccaaatacataggtaatgtggagtgtgatatcagggaaaccaagaaaagggcttgttgtaagaaaagtgttgtggtcaagaatgttacgtcctgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctatctgtctatctctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaagggaaaggtagcaagatccgacatttcaggaaaatggaaagtgtttaaagatctacagtgagaaattggagatgaactcactgggtaacagtaaacatagggcaattttgaacactcagtggaacttggagaccactgaagaaatttatcttctgttatgtaatatatttttctcagtggaattgagtagcttatatatactcatggaataaatggctatattttttccagattgtttagatgagtgtgacaacaggataacaaagctgaggaatttaggttactggaaaaaaagggcagtttaaagtgttctgtgcatctgggtgtggtggctcatgcctgtaaacccagcactttgtgggcctgaggagagaagatcacttgaacccagcagttcgagaccagctgggcaacatggagaaatcgtgtctctataaaaatattagccaggcatggtaacacacttgcattcccagctatttgggaggctgaggcaggatgattgattgagcccaggagtttgaggctgcagtgagctatgatcatgccaccactgcactccaacctaggtgacaaagagacatcctgtttcttaaaagaaaaaaaatggtctgtggaatatggatttagaatagaggtaagtgacattagaaaatagaggaggcatagggaagagaaaaatgtctggtggacagaaatttcattgtttaaaaaaaaaaaacaactgtagtgggataaaccaaatagataagtaagaggacagaatttgtagttgtgcagtagaatgacttactgaagagtgggggaatagtggaatagtggaatagtggaatggaggaaaattttgcagaagacaaagaagttaagcctttaactagctgtccatgtgtacatgtaattgtcatggtatcaaataaaaaattggagtggaaaacatgatgacacaggtactaatgacttaaatgagtgaggaagtaaccaggcaagtaggcaatgacagtaatgaagtgacaaaggaatttataaagccatatgatgtgaactaaataggagagggatttattattttttttttacaagagaggctataataggaaataaatagaatgtagtatatacctatttattagtggctatgttatgttatgttatgttatgttatgttatgttatgagtctgagtcttctgtgaaccagatgccaagatggaattagaagagccaagatttattgggaactatctatgggggataaagaagaaggggaggaagcagaagtaggcaaagaatgccttcagacagcaattcagccctgacatgtgtgaaaggagataaggaaggaagggatatttggtaggaaactcatgactacgtgggcattctgcaaaagcctcagccagaccaatgtggagtccccaggcaaatgtttctccttggaaaaatcccacatcaggcaggcatggcccagatttatagacctcaccatatttagtcattggctgtgagcagagcataggatgtgtggctttggagtaaaagccattgtggaccccaaggtgctggaggctgtcggccaactctgcttccacggaggattttctggaagggagattttagtggaagacttctaaaacctgcgtgcttcatcttctcaggcatcccacctcttccacacaatcctctaagccttttttgaccgcacttattttatttggtttgttttgctttctttcctagaaatactctatttagaaaatgacacctactaaataaagctcctcgagaaactttcctggaggtggactatatgacaaacatacttgaaatggactgaacaaagttattcttgtgagttagatgcagcaatccatatgcttacttgtagaagaaaaaaagtggtttaaattataatctggatgtaaaaaatcttaaaatcatgatggttacattcctgcctgataggaggtttttttctgagccccacatatttctatagtcagagactaagtccataagcctagcttccaggtggcttctgatcttcatgcagagtatggcttggatatcagtgtgttatggatcaaatttgatgggttaaaagtctgtatatcacaggtgtttcaagattaaaggcaggggagtggtctcttcatcagggaactgagagttgttatatgcacttaattatacatttctatatgtaattataaagagttttaagaatagtatatgcacatctctgccatggatgatctggaactttaaaaatggcatttgttatgaaatgactaaatatagtaatataattgctattgagttgtccttttcttgactgtcaggcagtaacctcatcatatcatttaattctgattggcagctgtttggtactattcatcttacttttttctccttgaacattactcactttgtaatcattgtatctttaatatcttgtgtcatacatttgaagcaatctggcagtttctgacagaaagaagttagaaaataaaagccaacttccctgtgtttttttctggtagaattgctgatatacctacaaccatagaaatattatgaaaaagtagttgaattaaacaatgtcagtgggttataaataataattggctcacttttataaaagctatgtatataatatttagaattatttgctaatgatcagttttctattcaatagaaaagctgtatttatttactaacaataaataaatgacaattattttgcagcataagctgctgtctctaaatctcccctctcccccagtttctaatactacttaatggcagacaaatggatatatttctcaactgctattttattcctatctccatatgttatcctaatcatgagccacaataccccactttccatggtcagttttggataacatatcttattttcaaccaattagtgtatccagttatcatataaaccattttttgcatagtaaaaaacaaacaggaacaagccagttttatgctcccaaattcagttaatatgatagcaaacaaagggtaagagaaagcaagaaagttttaggactgaaagattgttggaaaaataggaagtagtagtcagagagtggactacaggaaactattatggaagagttgcagtttttagtaatggcaatgctcaggttatgacctgataacatgagattttaaagcatgttagagtttagagatgaacagaggaaaatggtgtgaaaagggcaatgatagaaaaagagagtcaatatcccatgatattgaaacaaatagctaccgctgcaaaggatggtggaggaagcaccaccttcaggacttatctgttaaaggtggaaggtgagtagaatgttcacagaagagattgagcatgaaaggacatttgctgaatgccagagggcaccctggaaaacttgtgagtgttggagtataagcagaggtgggtaagaagaaatggctccctcttaatccctcttgatggaggtgaggttgtccagggttcactttggattgctgtgggaggaatgtgcaagagctctaacttggtaggtaaagtctattggtgaagctagttcttctagcatgcacacccccttcatcttggtgatagagggacacgaaaaagtgtaatttgtctaagttagacattttctatatgttaagcccataaatattttaccttctctttattcactcatcaaatattcattgagttgctgctcagcatcaggtgcagcagcgagcgcttagtctctgtcctcctgctgcagcagagagtacggtatgggaaagagacagagccagttatttcacaagcaagaaccaattaaagctgtggcgatttctgtggtggagaagtgcatttggcaggaaagtatgtaactggaggcttagatttgcttcagttgtcagaggggcttctttgaaggagtgacatttaacattttttcgaaaggatgctggtgagcgggtgaggaaacatgtcagacagaaggaaatgaatggataaggatctgaagcctgcattctacatagtgctcttccactccctgttatatcccataccctcccaaaacacagagcttctgaggctgttcaaagagcaaatatttttggaaatctttaaagataatttgaaaagtacaaatgattctttccagtgggatgaaggaagaatgttttaccattttacttatccaactgcttttcttgagtctgagagaagagggagagctcttttttgagggaagcaatattttagagatctatcagtagaattggagtttcttagatttataaagtattttttgttagtgtcagaagaatttgaaaagcaggggaggaatataagagcagtattatggctaacttaagactttttacaacctttgctcttatctctataataaattgtacaaccaacaatctttaaactattagtaagtcagtagtatttcctatttcattactatgtgccaccaaactatgcacatttctttggtcagaactttttaaggatatgatgtgtatacttgtataatattaatattgtataaaatgcctcatttggatttctaaatatctaataagatcttttcaagtttctaatacagcttaatcatggttttatgaaacagttataatgccacgtggagtcatttaaaagatttgtattagttataagaaaataaacagagcatatagtaaataataaaaattacagttcttaaaagtataagcactgaagtaacaaattaaccattaccctcccattttttcctttttttttttttttttttagaacaggcaacttagattagtttctgatcagtcaactatcttttcctttttgttttcttggatccctacttggggagctttttataaggcttattcccaggcaacagaattccacttaatctgttatgtgaaacagtgatccaagttccattttgccaccttgcctggaacacatgtgttccattaaccacattagctgaattcccagccatgcctgcccagaagcagacccaagcaggttgatgacatcatcccactcactccttctattttgtttcaagtttataaatatatttatcttttttgggcatgaaggacttaaatttttctctttgtataatactattttaacaaaaatattctgatatgcttcttagtttatgaattgatctaaatgaaatcatgatataaggcagttttacattttagatgcctgggataaaccagctgagatccttcacttggaggtacagggatgtggcaatttaaaaggtaatacagtgcattgattgtatcatcttcatcattcagcccaaagatcaactgagcatcctcactatccagagtctactaaacactaatagtcaagttaaagagataaattatcttttaattcaaagattttacaatttagtaaaggtttcagctatgtaatacagtggtattaggaaaaaagaaagttagtacaacgatgacgcactttttctaggaattcaaaaaatgatggttaaatacaaaatgggaaatcaagaaaggagggagatggggacagaattacagagcatctattatttgaacaaggccttgcatgagagaaaagtttttaagggaagaaaaaatggaaaagaaagtgctttctcttcctctgagataaaatgggcaaaggagaagaaagtggaggtaaaaaaaaagtatatttcaagttgaagatgagaaagtacaattctcttggatggccttgattttcttagttgagcagatgaaagatagaagtgcatggttaggcaaaatgagaaagaaaatcaaaggtagaataattagatggatgcatagctggttagatagatgggaggaaaaatatagaaaatataaaaaacaaacactttttgaataattagtccctgccaggcactatattttcacattcgctatttgaagccaaatatgaagaacacagtgatactagaatcttacaatttgtggtggagctagggaaatccacttatatcaatttgtcatcaaacttcagcaaatagaattggtgggtggtctttttaatccttaacttttgtggttgcagatatcttgagtatagtcttttccttttagaaggcaaatactgtaattttcatgtctgtctcccatgtctttctctaattacttcattacctgaatggtctcttcagaaatataattttctggtaaaaataaaattatatggagttaagtgacaactctgtgctttttgtatatgcagccactctatcatgcagatatggtagttaagttgctcagttttaatttggggcaatagactgagcagccatttaagaagctgaagagtagcttctctttttcggttttgtgtgaatcgtgggtgtaatttaaaaggcaaaaatggagaaagcctttctggtcctggatagtgaagcttacaggaataagaagagaaaaattgaatttaaaaacaacaacaacaaaacatctgtttcctcagaattagctgctactacccccttcttctttttttttttttcaatgtgtacgagaatccagaatttcttcagtgccacaactgaaacaaaaggtgtctggattagacataagtgtagactacagcaaaatgcttcaaaagatccaagtggcaccacttacataagccctcaggtacccgttaccttacaggatgaatggcatctcattgcagcatgtaagaacttagagacagcatgggagccaaacatggtttggctcctctctttacttccacaaaggtaaatcagcttctttctatactctgattctatatttggaaaaaggaggaacagggaagttcccttagaggggaaaaacatgcctaaaagatggaatccatatattcatttttcctaattttcacctgctatgaatgaagtaatgtctttattttagcaaaattatccatttggacaataaatggccaccttattatcaacgagcttgaactttcaattgatttaatatgtacagtaaactgacagttttaaattggaagataataaacttggcaagtctactcagcaatttgcctttggttggttttctatccctactcccaaattccctacacatgccccattatcattggaaataaaaatttccagagcaaaatgaagttagttagagaaaatgatggttgtttttgcatgttagtttaagcatttaatcttaattctgccataccaatcttgagtagacaggtctgtgtgtaatacaagcagagtattgccacaatgtctctaatcaccggttttttattcacattggtgaatgtcatcaacttttagatcatccaccaaaaatccttagtgtaactgcaaacctagagtttttctctattttacaaacacactaatacatgtcctcatgttttattgaatttctaatgttaaatgacccattggcatatattattatctgggatagaaaatatataactcaatgataaaaatatattttaatggcagatttacttggtattcctcttacatttcatacaaggtatgcacaaaacagaaattttaacttttctcacctgaaatatctacaatttcttatcaatctcaaagaaaatacattatgtttgaatagggttgtcctaggaatgtacagaaaccatgtatttctaatcccttaaactaggtttgttgactttttggaaaccttagacttccaatacttaaaattcatacactggtctttacttttagaaaacaaatttgagaatcaccatatatatatttttgaaaattttggaaatatgtttgcttatagcaaggtaggaaaatagattgcttatagcataaacatcgttgacatttattttgaagaaaaaaagcaaactaagtaatttcacagacagaacaaagccaggctttcaaaaaaacttatgtgctctacatatactacagctacatgaaagtaacttgtaataagttttaatattcacatgtcaaatggataaaataattaaaaattctcaaaatattaaattattaatttatgaattaccttataagtgcttatttaatgggaaaagaccagcactttgaacctagagctttggcccatgttcaatttaaatgataacctgtgattctaaactagagggtttaacatccccagtagaaaggtcaatgggaaatgtaggaaatgagattttttttcagtcaccctaaggaattcttaactaccttgcttgggtataagataagtgtctgacaaggaaagaattgtcccctcaaaaaatccatctttattagcatccccgttgactggaacttaattaaatttatttatacttgctggacacaactgaacatctaagattccttccagctctgaaatactcctcaacagttacttaggaagaattaaactgatgcagttactctagtagaatcagatatacttgtggtttatatgtgcaggaatacacattaaaacacacacacacacacacacacacacacacacacacacacacccttcaactttaacagcatcttttctgtaaaggaagtcagtaaaaggctgctctatttcagaatcaatctaaagagagttatgcaagtaaaaatggtcttttcataacattttttcaggaagatgatccctatatcggaccccaataatgaaattaaactacattttagtacagcaattacaaaacatcttttttctttatagaagcaatgcatgctttttaaaataaaatagtaatacatagatagccaatatatacagtgaatgtaagttgagttcttcaatgccccatgatctgctccttcttcacatcttatcttcctctctggtggaaccccggagacttctttgttaaacccaaggcttcacataacacagtggaaaacttattgctataaattagacataactaacctcggttaatagagaataagcaattgaagtagattgtgccagtcctggacaatcagtagtggtagaattgaagtaaatttaaaacttcataccattccctcaaggattaaaattcaatgaaaaaaaagtaggccaaagaaaacacttctataaattatattttgtccttgaggggtatttttgtattgtattctaggctacatgctgttacatcattaaaggaaactttgtttattctttctaactagaacatttatcccagaagccagcaagcacctcaatattaggtcttataatatgataaagtttcacctccttttatcaatgtagagaagtagtttcttatcttccctggtgacattctggcttttggcatccttcttgaatatagggtataaagtctccttttgatttgaagaacttgtgccttctgatatatccctgcaagtttgggaccatatttggtatgcattgtgtgtaagctttgcttagtgaagcacagtttgtccataaacgaggctcatccttaccagacaaactctgggattataaatacacataatactcttagcccttagtaatagaggtcaaaagataatcactgggtgggataaaatgtgaaggtataatccagaatagtcttaaaagaaggttcttagaatagttgcagataatatacattgtagtagaagggtgtggaaaataaaattaagaaagaaagtaataataaaatagagaaaatggtgaatggaagtcaatgataaggtaaacatatctggaaattaattcatgtcaaattttgtgtatatataatattttcccctcattacaaaattatgccatatacctttctaaaaagagaaaataatataatgtaatatattgtaaaactcattgcatattttgtcctgatgctattaaaaagtatttcccacctaaagtttatgccacatgcattttatactatgagaaactgcatttgaatataaatttatgcacttttatctcaatgtctggatttcaacctcttgcaaattagcaattaaattgaactagatgcactcgtgatgtgatttaaatgccatttgactctttcagagcactcataaatatgattttattttcatggattataatgataaatcccccaaatgtagacttattttttatttcttcaagtaacaaaggaatatagaatttagaattatgaataatggagatttattcttaaagtattcttttaattttacattcattatattttgtgtatgtgagagagttatacttcacactcagaaaaagtgatatagctactagttaatgtggtagtgtgattttactagttactttacctgagctagccaaacattactcagttttcatattttcttctgcatagtttgaacgtgacagctctcttttttaattgcattagctttgacagtcataaggagatgaaagcattttaaatgataccataatgaaaaatacagaggtttgtttgctttttctattaggtatggttgagcataaaaactcatattttcagttttgttttgatgcattggtacttcacttccttgcatgaactgacggaactgtggaagagtattatgtctacacctgattatgagtatcggcaccagacaattagtaaagcttcattctattacagttcatgcctgaaacagtccccagcactcactggttgactaagtgaacctttcaaaaacagaagttcattacaaagatgaaaaacatttaaaagctaatcttagttttaaaactggccggggacagtggttcatgtctgtaatcccactactttgagaggcaaagccaggaggattgcttgaggctaggtgttcaagatcagccttgacaaaacagtgagaccccagctatattaaaaaataaaataaaattagctgagtctggtggcacgcaactgtagacttagctacttaggaggctaaggcaggaggattgcttgggcccaggagttcaaatttgcaatgagctatgatcatatgatcaatccacggcacttcagcctgggtgacagagaaaggcattgtctctgaaataaataaataaaaataaaaaagaaccttagtctacatatccctacaagagatgaatattatcattccctttatactaatttttgggaacaattttttgtgtggacggcattggtgaaaaaacacttgtggctacattttacattggttctttagaatcatagcaaataaattctaatagtatgcaaacaaaacgaaaacaaagaagtagtaatcctttattaatcacatagttttgctttagtaatttctatcatgttttatttgcaagcataatgcagttatatctttgatctttttaatagtaagttcgctttctgtaaaagtaatgaaaatttaactgccttttcaattcttattaggtgtatgatatttaatttaaacatataggattaattaaatatatactaagcctattaatgacatcctattaaacactattagcttcctgtattacaattaattagatgtatactaattattaagacaataatatataagtatatagttatatttaattatattaatcaatttatggaaatttaaatttatgaatttatattttaatatcttcattttttaaactagtaattatagatttgtaacatttgtaatatgtgtaggtaatcaacataaatacaatttctataacttttctctgtttctaacagatttaaattttttcatttgatttacattcatttttctgaaatagtagcattaatttctcttttttcctgagcttagactcctcaatacccctatttatagattccaagtccataacgtgttaccttggaaactatttaaagagcatcgtctctttactatttgtttttatcggatcataaaactgccttttttctccttcagctactgcttcaaataactcagtactgtgagaactgataagctcagggcttatgccagtattatagtgtgtgtgtgtgtgtgtgtgtgtgtgtgtgtgtgtgtgcgcgcgcacatgcaagagcattctcatgagtatgtgtagatatatgtgtgtttatgttttgtgagtgactactaaaaattaatcattatgtcttatacatttcctcacaccattatgattttgggggactacctgtgtgttgaaaaactggtttttgaaatgacttcttgtatgaatagtctaatatctgaatctgtagtatgtagtattttaccagtacaagatatatagcattgtaatactttatctcaggcagtctgaggttatttttagctctaattttctctataaaaggcagcacaatacagtgacaaagaatattagctctggggctgcactgcctaaattgaattctggttcaccacatactagttgtttgaccttggacaagctacttaatgctctgtgacttatctgtaaaatggggttaataaaagtgcttgcctcataggcttatcagtcaattcttgtaagtacctagaatacgtggttaatggatgccaggggtctaaccaactggcttgaaaaagattgatcttaaactttaattaatgcctgtggatatacactcctgatgatctaaagagaaatttaatttacatcaacaaattcacagtctgggtgttaaatgtgaataaaatcaaatagttaactgcataaatactatagatttcaagatttatttttcagtccaaattttgaagtcaaagtataatgaatttataccagaccctcaggaagttattagcatagtgtctggcatatgataaagtctcaataaagagtgaaattaataatcattgtgtgattgagactcactagcactagtaattaggatgataatatcacatggaggaaaactatcagagtccatacttgttatttttgtcaatcttgttctattatgaatcagtaagagcaacttatggaatgaccattcatgctttagcatgtgcatcttaacatctatagaatctttccatgatatgttttgttgtaaataaatatttattgacataatttattatttacttgtaataaggcatttagtatgcatatttactattgaaatgaagcaacattagggttttaaaatgttcctttataccagaccctcaggaggttattaattatttttggatatccttgcaaatagtccacttcacagtaattcacactggttttgatattttaagattcttactgtacgaaaggtatttattaattaagttagagtctttgagtatctcatctgcattatggattcagatatgcttgcccggataaagcattagatttttaaattcttcatgtcacttaggacatttttacttgatatcactttttaaggtgaattcatttgtaggaaaaaaagcaaatgaaaagcagaaaaattagttaattagcttgggattagccatggattttgtccatatgagaaaattcagtgaccttaagtaatgatttattttataagaactcacagacctttatttattactatgttacattgtaaaaatgcttcacctgagccttggtttcttcaatacaccatggagctaaaaagttttattttgcaggattctgtatatattgcagttttattataaagcacacttaaagaaggctaataaactcctcattgatatgcaataaatattagtttctctatttcctttgtggaaaccatgaaattatatatatatataatttttgaacactttcatcaaattaatttttaaaagcactcatttactaaatatgactacagtggaaagaaggacttaatagtaatttagattatgcttcatcaatcattagaggaaatgtgagattggatcaaagaaacaagtcatcttccaagaatagttgctctgaaactgtcattttttatttcagtgtgaatattacattgagtaattgcagtatattttgttctgtgtggcccctaacatttgcattccctcttattgggaggaaagatttattgctgccaccctaatagtacagtgagtctttattcagtgagtgttcactgtacaccaggcactgtgttagccactttacaggcattttttcttacaattcttacaaccaacttgcaatgtgagcattcctattatccacattcacatttaagcataaagaagttaaggtttatgggatgtaaagacttgcccaaagtcatacagatttaaaatgccagacccagtatttgaactcaggccttatttcagagcctctagtccatgcctctatgtactatatctctgttcattttctcactccaatttccacttaatattttgttctttgaaactaatgaatgaacctcatcacttgtaactgcacactttgaagcctgaatatctctggggcaggaaatgaaaacttagcatgagagagacagaacatgctatgaaaatgtaagtctgtgtgtcatgtcaggcaacttcatgagcagcaattccttcaaaattcttattctaatttcattaagggaagtgaaagggaggattttgagggtgcttctagttttcagctggtgccttagtgtcttgttttggaaatcactttcttatgtctaaggaagtaaataatgaaaaattacaatggacataaataataagttaataggatcattgtggggatacttatttcattgtcattaatttcttaatttttttgaccttccttagagactatgtcataaaaaggaacattttaaaaccctaatgttgcttcatttcaatagtaaaggtgcatactaaatgccttattacaagtaaataataaattacatcaataaatatttatttaccacaaaagatatcatggaaagattctatagatggaagatgcacatgctaaagcatgaatggtcattttccataagctgctcttactgattcataatagaacaagctggacaaaaataacaagtgtggattctgatagttttcctccatgtgatactatcatcccagtttctaatgctagtgagtctcaatcacacaatgattattaatttcactctttattgagactttatcgtatgccagacactatgataaatagcttacacataaattatttttttcagctcttcattcccatttcagaagtgaggaaatttaagcttgaagaagtttagtaacttgttcagtgacaggcaagtaatagtatgaagttggaatgtctgactccaaagcctagtatcttatttgctatgtttttttttttacaatttgttgcatattttcttttgttttgtaaataataatattgaaaaatatgaaacacaaataaatagaagtgtttgttgtatagctttttataagactaggtttttatgttagcaaaataaatataatattaaaaagaaaatattttacacctttaatgtaccaatggaaaattctttcaaaaaaattcagaaaattatagccaattgccccctaattatctgtggtgtttaattcaatgcctaatctattatctgtgaaatagaaaaaacaaaaatactttcatattcataattagactttagtactcagtagtaagaaaaaagaaaatattgcatatatgattctgttgttgttggtagcagcatgcaaatttctgcataccttgtttataactgacattaaaagttctatgttttcctcttgcttctttagcaaccatatcaacatgcttttggggaataagaaatgccaagttatatcatgtatgacagagttttcctggaaatatttgtacatgtgaagcatactatatatgtcatggggaaaaagaggatatatgtaaatgtatagctttacgtttctggtactgagcttggaaaaatggtagaagttttcagggatgccatttagtgttggattgctgcacagtgtatttgcattatttgcaataactgaagtatttagtatttgtgcaggcatccttgtatttaatattgttaatatttatgttaattaagagagaactataaagaagcagatcagtcagttgcagaaatcatctgtaaacagcttttctacaaaggttcaggatgttgctcccaaggaaagacaccgttacatgacctctgattaatctcttccctcttatttgatttctttgaataaatagattgctctacgttctcaaagtaaaaagggtgatatattctaatattgctgtaccattttaaattgcatagataaaagcctatttagtggggcataagatcaccataagcctcttggcagttttcagcgaattcatacatatcaaaagggactcaaagaaaaataacaaagagcaaaaataatgagcccgtcaaagcaaatgcttaatgcagctccactttggtattaatcagactgtatgtgggtgagggtcaaaccaaccgaggtcaatagagaggattttggtaaagacgaaaaaagaactaagctagtgatttcagacagattgaattttttttaaagtgaaataggaaggtcacaaaatcagattcagtttgcagaagcacagtgggcaagttttaatgacttctcagtagagctttttaagagaggcacttgagtttgaactatctaaactaaacttttaaaaaatcaacaggaaaagggaaggaatatttgtaaagattaaataaacttataaaacttgcttttattgaagaatttcactactttggaagattaaagtagcttccttaaaaaggagattttaaatgtgtgcagattttatttaacacataatttagatattgctttatgtcacagaagagcagtatgtgcatatgtgtgcacatataattgtaaagatgtctttataagatactttccataattaaatataggtgatttgaatatttataagactttaaaaatgtttctgtaaattgtgtattctgagcttgctaaatccctctttgacaaatcctgaatgggagagagccaataacattcttttcctctatcaaaccattcttactctacatattcttcttctgctttctagcagaagaagaaaaaaaaagaatgaggaggaataagaagaggaggaggaaggaaagaagaacagaaacacaaaatcttactgtgtcattacatgacctatgattaatctcttccatcttatttacattttggataaataggtgactcttttctcaaagtaaaaaggaagatatatttacttacttgccaattatcttattgaagtgttaaagttttatttttctctggattattttaagatgtacttactattaattcattttattgaaagttaacatggtaaactatatttccaggactatagaagattcaaagatgataaaatatgtatggccttttcttcacaggctttaaaatctaatgacaatttcataagcaaccataaatttgaacatttttgatatctgtaacaatatagtactttatgtaaatggttatagcaaaaataatgccatagttctatgaggaaagaaattttaaaattcctgattcttctcctttagaaatatgtacatatttatctatctatgcatagatactatttcttgaaatatagttaaatctattatacttccatcatattaggctatatatgcatgcttctatatatatattaatatatatgttaacatacagaataaaaataaatatatatgttctactagcaaataatgtatttgctctattatttaatataaataggtacattgatatatattatacacacatatattaatatacattgtatacaaatatgaatatatacattataaacaaatgtatatatctatatatacattacatacaatgtatatacatacatatatacaaatgtgtatataaatatatacattatatacagatatatacattaatatacattatatacaaatacatacattataaatgaatgtatacatatatacattctactggcaaatattacattctgtccattcataatgccacccattacttcactcaagcatcctagattattgtataattggactttatgccaatagtcattcctaatctctccatgatacgaagttcaacatctgcttttttaggttccaaatgataggacctttaactacatttctagcctcattttatcttcctttgtatttttagtacataatgttatacatagcagtgttcattaaatgaaataattcataacaaatgaaatgataaatctttttcatgcatatgtatggttttcaagcaataatagtgaataatttgtttttctcttgctcctgaattataaaaattatggtagaaatgaactagcattttaaatactttttttatatcacaaaaatgactgaattcttattaaattatgtgatttttaaactcacaataatcttggaaattagacacagcaagagttagtattctgacttataaaggggaaattttgtctaagatagataaaggggtttgtgcaggatttctcccctagcaaatgatgaactagcactggaatttaggattcctgaccatctgtgctttgtctttttccattagagctaggatgaacatatgccccattttttccagaaaatttcacttaatacatagcatcttgaattgataattaattgtgccctatttcactctcctgtcctggtttaaacaataaattatagggcaaccataactatagctcacagtaagaaataagagaaaaatagaagtaggctatacccaggataagtaattttgatatcaaggttgatcagatcatattaacttgttaccatcaaaatatgtcattttaatgattcacaagttggaaaacttaccttgtgaatattgatcactactgtgacatagattcttattattttatcttatttgaaaactactaaattgtctatgaatgtttctgagtgttgtctacacaaatttaagacactacactatgtgaaaatgaacccatggtagttccaaactactcaggtttgacatgccagccatcacatgagatgagaacagagagtaacttgcttgatggaaactgagtcagattgggtgcttaatcagccactgattaatcagaatgcaggtctgactaggagaaccacaaatcaaaatgggcattaggctgtgttccctattaaattaataactgactataaagccaagtaacatttcaaatttcatttgattccatagatttaaaattggtggtatgacaactgaacgtattttaaaacatgccttttttttgaaggcaatgtatttctctgcagaaataaactcttgacattaatgatattgactcttttatccagtttcaaaactctattttgtcaagaaagttataattattgatactacttgacagcaaagagcagactgctttaaatgctcatcaacgtcttttcaaaatagatcattattcttctaatttatttccaaataagaaaagagctgacagaggttgagatttgttcaaatatttcaatcctagagtatgtatatataatacatatgcgagatgtgatggggtgtgtatgtgtgtgtgcatttatgtgtgtgaatggcacataatctttccaaattacctggagaaaattgtatctgacaatcctattatagaatgcaaaagacaggaatgaaaaatctatggtcatacctattcacaaaattgtttaagtctagtttaaacaacatactaacatcactattatttctatataatcccaataactatttgggcttaaaatttatacaattctatttagataaattcatagtatgctagaaatgaagatatttcaaggagaatataagaacggcaaggtctttgtagcatcactgcatgtgactggactaaaaatccaccgtgagcttgctgagtaaattgtttcagatttgatcccttcaagtgttattgaagattctcccacatataataccttaatgttactcaattcattgttctaaggttgttctaaaattgttctaaatttctggctatgccgaagttcatttctaaaataaaaggtaatgcaggcagttaacattttgataaatactacttcatacttttgatctcatttcctgttttttattacattagattttctatcaaaagaggccattatagtttagggataaatgcttgacaacagagtgtgtatgtcaggatatttcaaacggtgaagaaataatgtttttaactactttaattatgcttctttctttcctattggatttgataatcatggccaaattattcattaattacttttacagataaccaaaaaaatgccaaaaagtgctgtttctactaaaatctcttagcaggaggatcttcatgtttggattgtgcacaaaggtattttcatttgttcagagcacttaaacaaaatggacaaaatgtgtattttttagaaaattacccatatatgacagagcatcaccagtgacaaacacgttattgctgaagagtagacgtattttgcatctgcttatgtcttaatctgatgtactttattcaagaagcaggaagtgagggacagagtcctgtagttggccttaaaatcctgccccacaggtctgtgccccttacacttactcaccaaggcttggccgtgggtttgttatattgaatcactacttagaaacttagtttcctccaccattggccaattttcatgaatgttgtcaatgatagaatttctcgatttttcagatatctcaaatggctttaagccctggatgtaactcaattaaaaatattactttcagttatgttgttatctgttcacatttgagctgctgataacatctgttatttgagttgttaaaaaataattatttgttgatactcttttccatgctattttacagaaacgtgtaacttgttaaaagtgttagttctatcttttttctctgtaaaaagtagaattctaagaaaaaaattacaataaccaactaaggtaaagaataattaagtttgcttttgtttcttttatttataggtatagtgagttggattaatctcactcctaagttgcactattattagtctatgcaaggtctttcttttttatttgaaaaatagttttaaaaattttaattattaccttctcagccccattgagacccatgcccccactatctttacgtaatgaaccactctaacgtacattagtgtatgtcctttatcatggttatatcctcaaagaatatatgctggtacttttaatatgcatctttggtatttttaaattttaaatgtatatatttgttttagttttcactcaatgtgattattaattgttaattgtttctaatccacaagttttatacagtacctgctcatcacatagtatttatttcctagtgatggaaacttcattgacttcaacttcctgctgtcagaaactatcctttaataagagtcaccacacagtgttaattcattcctaatcaatttgtggtgccagttaatgtgtcaaagtatctgtctgtctatatttgtctattatctatcatctatatatcatctacattgatctgttttccaaagtcttaattacattctattgattttttttctatttagctccacttatttttactaaaaattttagtaggatatttaatattgactaattcctcttttttcttctttttcaaaatttgctcttctatggaagtttattatgatatgtaaactttggaatacatttgccaagtaactaaaaaaatctgctttatttttagctttcagatttattgagataaagttgacatacaataaacttcacaagtttaaaatgtaaatttgaaatttttaacatacgtatacatcagcgagaaaataccacagtgaagatagtgagcatatctatccactcccaaaagcttccttgtatcccttggtaatatggaccacacaccttttctcaatactgctcctaatcataggcaactactgatctgctttttgtcagtacagattagtttgcattttctaaaattttatataaatcaaattgtatagtgagccacaatttaaaacttatgaattgttagtttctgaaattttccatttagtatttgtggaccacagttgactgcaggtaaccatgtaacagcagataaaggaacattactgtgtgtactcaatttgtgctcctttttgtctttcttttttcattttgcttaaatattttagatttatctatgctactttatcttagtctatgacttgtcttttgatcctcttaaaagtggctctggaatagcggaatcactcaagtttaatgaaacctgatttatgtagggtttttttgctgtttcggattgtgtttttgttgtcttatttaggaaatatttgccatattcaaacccacaacaatttcctgctatattttcttctagaagttttatagggttaggcttaaaaatggttctaagattcattttgagttaattttttgtacacgataaaggtatagatgaaagtttttgcttaattttccttaatgtataatgttacatgacagtatttattttgaaaagattatcctttcttcactgaatttcctttgcatttagtttaaatcacttgagcgtatatgtgtgagtttttcttttttcttttctttttttttttttttttttgagttggagtctcgttctgtctcctaggctggagtgcagtggcatgatcttggctcactgcaacctccgcctccttggttgaagcgattctcctgcctcagcttcccaagtagttgggattacaggcgtgtgccaccacacctggctaactttggtgtttttagtagagactaggtttcaccatgtttgccaggctggtctcaaactcctgacctcaggtgatccgcctgcctcagcctcccaaagtggggtttttctttaatctgctgcatttttctataacaatactacactgtcttgttgactgtaggtttgtaataattattgaagtcaggtagtatatatccttcaactttttttctttttcaaaactgttttcactattctagatattttgcatttctatgtaaactttagagtcagcaagccaaattctataaaaatacttgctgaaaatttcattggaatgtcattgaatttatagatcatttggggaataattgacatcttaaaaattgataattttactatataaacagactgtatttcatcattaatgtttaatttctcttagtaatacttttttagttttcagtttccagatcttacacaaattttccagctatcctcaagtatttcataattttgatgctattgtaaatggtattttcaaaaacttcacttttgtagaaacacaattgattgttaatagtgatcttgtatcctgagacatgtgttaagctctcttattagttcaagaagatttttcttttttttgtagagtaatatgttgtctatggaaaaaaaaggttttcctcttccccaccaatccaaatgactatataagttttttgtgccttactgtattgactggaaacttgactaggaatagtaagaaaagatgtattttccttttttcctatcaaaggggaaaacattcatttttacataattaagtatattagcttcaggttgttataggtaacttatatcgggttggggaattttcctttcttctttactgaaatattcttttttagtgttttaaaatcaggaacaatagctcgatttatcttatactttttagaaatctattgggatgatcatttgtgtatatgatgaatgatattcttttttattctaatgttaaagcaaccttgtattcctgagataaactcaaattggtcttttttttgtatagtgttgaatctacttgttaacattttctgaaaaccttttacatctatgttcatgagggatattggtctaaagtttgcttctgttgtttgctagttctgttttcggttatgtttgttttatatcatgttaagaatattctatcctcaattttctggaatagtttatttaaattttttttaatgtttggtagaatttattatgatactgtgatatcacctgggcatagagttttctttgttgaaggctttttttttttttttttgatacggagggtacacatgcaggtctgttacatggaaatattgcttgaagctgaagtttagggtaatggtcctatcacctgggtagtgagcatagtacccaactacctgttggtactatgcctcctccctacctcacccctctggtagtccacagtgcctattgttcccatatttacatccaggggtgctcaatggttagttttcacttagaagtaagaacatgaggtatttggttttctgtttttaatgacaagttctgtttttcataactacaggattacttaggttatccatattatttttagtgagctttggtaatttgtgtctttcaaagtatttgtccatttatctatgctgttgaacttattggtttaatgttttttacaatgttgccttattagtatttttaaaaatatatctgtaaaatctacaatggtgtcacttctcgcattcctgctactggtaatttgtgtttctctcttttgtttctgatcaatctagtttaagcctgataaattttactgacattttgaaagagtcagatttagattttcattgattttctctatatgtctgttttctagttaatcattttccactataatctatattatgtcctttctctgcttactgttggtttcatttgtttttctttttctaattcttttttttctgatatcctgacattctttacctcatattatttccacttccaataaaatatataattgagctgaattttgaaaaaatatagatacttcaggatacttctaaatagtgagtgagtgaaagtcattatttgccataacataacataacattcaattagttaatcaaaaacccaaatgcccgctaggtgcccaacactgttccaggcattcttcttctttatttttttttttttttcattttactttaagttccgggatacatgtgcagaacgtgcatgtttgttacacaggtatacatgtgccatggtggtttgctgaacctatcaacctgtcatctaggttttaagcaccacatgcattaggtatttgtcccaatgctctccctctccttgttccccaccccccgacaggccccagtatgtgatgttcccctccctgtgtatatgtgttctcattgctcaactcccgcttatgaatgagaacatgcggtgtttggttttctgttcctctcttagtttgctgagaatgaaggtttccagcttcatccatgtccctgcaaaggacatgaactcattcttttttatgactacatagtattccatggtttatatgtgccacattttctttatccagtctatcattgatgggcatttgggttggttccaagtctttgccattgaatacttaagtggaagttgaagtactggatttgaatcttttcttatcttttccagtctggtcgtgtagtgctactgcttcacatagtgttactactgtacctaaaactgatatattttatatattttattttcattttcattcagatcagaatgcttttaaatttctcttttgattttttccttcacttgttatatgaaattgtgctattttctaagtaatcaatgattttctagctatctttctgttaatttgattgctaatttaattttatcagaaattaatttcaaagtttttcgactctttacttacaaggcttaatagttttaatatattttattaaaatgcatataagtttgttgagagtggatacctaaaaaaaagtgaacttatcttggaatgctattaatgtctatctccttcaggttttgtctaagccatttaaaagttttaaagctttcttctttattcctagatatttgataatttatattattatttatatgatactagccctattgatatttgattattactatttaggggaattattttgattttattggtctaccttctatcacaatgagcttgattttttaagctaaatgcctggattatgtgtgtgtgtatgtatgtgtgtgtatatatgtgtgtgtgtgtgtatatatatacatactatatatattatatatgtatgtagtatatgtgcatgtatatattatgtatatatttatgttatatatatgtatatatgtatattatacatattagcatatacatacacagtatatacacatatatgtatatataattatatacacatatgtgtgtatgtatggatatatgtttttagctatttttattgcattttaattctatttaatgagtcactgagaacatattatctgctcttgagtgttgcaatttattaatgctttcattgtattctttacaaggtctatttttgttaagtttacttatgctataaaattatttttggttattttgggtaatgtacattaacatattgaatacaataatcaaatatttgtacacttctttattgattccttcataattattcagtcactgaaagaacaatgataaaaaaaactctcattacaatcccacctattatcacagatgtattcatttttacctataatttcatcagttgttatttataaatatataaaaaggctacatttttagatatatatatagatttatacttgttatattctattcatctatgtttaaatattgcatggaatttgactttatcctttatgatttgtatacttaagttctatttttaattatacagtggcttgaataggattctttgattttaattgtcttatttaaattgcaatgcttttatttttaaactttctttgttcttctgattgtatctcttatagatttcagaaacctagaatattttttcttatccaatctgaagttagtgccttgatataagtttaacttagttgtattagctttaatgacatttgtgttatgatttactacagcttttccattttatattcatttgtttatcacaattccatttatcctatgtttattcatatatatgtatatttatatatgggataaatggaattgcacacatatacatatatgtgtgaataaacatgggacaaatggaatgcgagtgcatatatacacgcactcatgcttatgtttctattttgctatttacttcctggaatcatcttggaatcctctggctcactgatatcacaacacccaaaacacatatcatattgatattatataaatttcttgattgtaataaacatactacaatcattttaaaactttgtttcttatttatgttgatggcattaatctttaacaaataatttagtgattattgttattcatatcccaaatatatgacatattgaaattattttttctttctatagtatattgtttattaacaaaagctgtccttgcatgacaaaggctgttttattttgtcattgcatatatctgccagtttgctggaaaaaattagactacaatattttctgtcaactattcaacaatattattcctttgacttctcacatctagagttgctgttgtgaaaaccaataagtatctaataattgttccttttaattgatataatttcctttttaagagaattcagaactttctgtatagtgtaactagaagttaattttaaaaattctatagtgcttagcagtctgaaaactttataaatctgatttataatataatcatattgactaggtattaaagttttatttttgttaactatattttcttttttctctcttattaattccatctatgtttctgtagatttgtattcatgtaagctttctttaattttaagtgcacatttatttctttcattatttcaactaccatattttatcatctagtatcaccaatgtattttatatttgcatttatatttgttcatactccgtttttgagttttatttatttgattatatttgtatgcttattttatattacattcatatttttcattaattctaatttgctactcttgttcagtatgctgtcctttatagttctttatgtcccttatatatccattttttttcctgtaagttcatttttttttttttttggaaccattatctacctcagatcataataacaaactgaggggagggagaaaaagactagtttctggtttataccttataaagcttttaggatgttagagagtgaggtaggggatgcctcaaagtacaaatctactgcttttatgatctggtctcatttgtccacacacctccttatattaaaatataacatgtccttttgaaaatgtttctatacctccacttaaggcctgcttaattctaagatttatgtttcaaagttaaaattactaaatccatacaatgaccatatgatcacagagggtcagaagcaattcaattcttgggagtgaaagcatcatatatacctgttgctcatccttcattccgtctgccctctagtgcaacattgtttttgttctcacttctcgatacaaagatcagctaatgttatttcagctccttagaatcagagtataatgtgcctactatgaaggagagaaatgtatttatatagaatagcttttcacattatattgttatagttaaactgcccccccaccacctttctccagtgcattttttttttctttctttctttcttttgtccacagcaggatctattccttttgcatttccaggaaattattaagattttaatattaatttctggcataaaaatattttttaatttgtgtaggtggcaggagaacagtagcctatatttattaatactcttgtcaagaaatagcagcttctcatgtacttctttttacatattttgttactcctgaatttttaatcttttggtttatgtttgtactgactagaatagaaggataatatttcatatgtgcagtatatatattatgtatatttatataagtatatatacacaattccctctaagatatgtacatatatatgtgtatagacataatacacacatacaatcatataatcttataaatattcacaatatgagactctgtgaaagaagttctttaaaatgctgatcttcaaataaaagattaatatataatctataagttgtgatctttattttggctatatatttgggacttcttatttataaattagcataattttattgatattatacaatttaagtgagtaaatgccagagtccaatcattgagctcgggatctatgcctaagtgtgattcttggccaagaagaacaattgatggttgactcagtcttatgcataaccctgagggaataaatctctttattggccttcctatataaatctttccatttatataacctttccataaaaataagctttatctttggtatattaaacacttatcttgttcattaattttttcattgaatcattgtttggaatgcttaaagcataacatttagtccagtaaatttgcttttacgccaaacctcaaacgtaatcagtgaaaatatattttatttcttatccaagtgtattatattactttggtatggctactataacagaatattatagattgggtaactgaaacaatagatattaagtttctgtcagttttggaggctggaagttcaagatcaaggtgctgacagggttggattcttctaaagcctctctctttggccaccttctctgtggatgcatgtggtctctcttctgcatgcacacgtgtccctagtgtctcatgtgtgtcctgatttcctcttataaagattcaagcttagttagattaaggtgcactgcgatggccttattttaacttaattacctgtttaaaggcatctatctccaaatacaagcacattctcaggtattgagggttaggacgtcaacaaatgaatttgagggggatacaatttagcccatagcaccaagaattctgctcagtaaatatttttcataacattagtgcagaaaaaaatataacattgtgtaataaaaaataaatactttcaaaaattatttaattctgtagaatagaatcccagagcaattcaatgaaaatgaaggaggctatcttttatttcttggtacaatagttaggaaatgttagtagaaagggtatttgatttgagaaaagatgataaaccttttatatatatatatatatatatattttttttttttttgagacatacagtggagtacagtggtgtgatgatagctcattgcagcctggatctcccaggcataagcaattctgtcatctcaacctcttgagtagctggactacaggcatacacctccactcctggctaatttttgtattttttatagagacagggtttcgccatgttgcccaagctggttccaaacaactgggctcaagtgattctcctgccttggcctcccaaagtgctgagattataggtgtgagtcattgcgcctggtccagcatactgtcatactgagataatgatccttattaagccccttgacccctacaagccctgtcattttttttcatggcatgtttatggaataatgttttgggagatcaaatgaattatatatttgcaagttctaatataataaaatcgcaaataatcatatcttattgtttgatattactatcataattatcatcatgttcgtgtaacatacatttgacaaaaaataaatgcatattttctgggtaattttaaatggaaataattaatattaattttgttgaagaactttatgagacccttttcagtaatttagaaatactcctaattctgtgaaaattaatgtatatttttaagaacctattatgtataaaaagctagattgggtgttgtgcatgatacaattgtaaacaaaacgtattccagtttttaagacaattgtttccagtaacagtaatataccaaattgaatatggatggttccttaaagataactctacatgaagtgtggttgtagcccatgagagtttgtagaaagtcatgattgtaactgttttgtgcagagtgagaagataagaaaatacattttgagaaggtaattgaaaaggagagaaatgggaggaaatgagacctatgtaagaaaattcatagtgtgagtttgagtgagaagtaattaggtcctgaaataaagtaaaatttgaaaactggataaaggaaagataaatgacataaatatttaaatgcagggtttgcaagctgttagaatattcttttcctgccaccttcactttgtgacagtactcattctaccttgcatcatcagcaataatagttgtattcttcttttgatcctgtatttatggaggtggcaatactacattttgttttcctcccaccaaatagcatgagaacaattacataaaccatttgtattaagcttgaagaattgaattgcattgaaacaatgcaattgttgaaacagatggaatcaaaaattttcatattagatgatagtggtggaggaaagtaaaaaagggtaatgccatttatataaatacaaattgcaaaaaagaaagttttcttaggaaagaggtttaattcactctgggctgggtctagtttaagaggctgggattaagtagatggcaatgttaaataaattattggacattttattgtcccttaggggaatacctctatccttcctaaatgtaggaaaaaatctccctacatttgaagtataagtaagggaaaggggttccattaacacattattattctagtttttaaactgatggtcttaccaaggtgaagttgataagaaaaggcaatggtagaatattaagaaaatcaaaagttagaaggcagggaaaaggaaaaacaacaacaacaacaacaaaattttaaagtagattagaaaggtggaaccagaaaagtaaagtgttttatgccaaggagatgggcagatgtcatgaagtctagctaaagaatgtgaggaaaccattggtctgtgactttaaagcttcagtgtacaaatagaaaggaacaacttgaaaggtcaagatagaaaaagacaagaaagagaaagcatgctttttagaaagaggacttggaagacacaaaacagcacatgaccaggcaacagaacagagagggtaaaaacagaatggagtagttttgagaatttacaagataggcataagctgtttgatggaaccaattttaatggcttcagcaaagttgaaagcaatgtcgcctgatgacagagaactagtaacaaagtatttcaatgataaagaaaagtaaaaaatattttatatggacacaccaagaggtaagcacaaattacaattaacaaagaagactcgtgtgacccatcattaataataaactctgggaatttaaagaattgaattctagaaggaattttgcctctaaaacatgagatgctaacactaagtgaacaatttaaggcttcacttttgtcttttccaactgtaaaatattttctaacagtatttatctgatcgaaataattttatgattcctaatgaatccatagcaaactcctagtgaatcatagtgactctcactgaaagtgagtgcttcaggactttgaaaaataatagttactatacagccatttataaccagaaccatgctattataatataaatctcaaggaaaaaacttcaaaatgttgtgttatacatattttgtaaataaataatatgtaatatacatgtatacacacatgtccatagttaaattatgtttaaagaacaaactttttagtgtcgttaagtaacagaagaacagatttagatcaaattacttaaaattaacatcaaaaagtattattggtataagttaattgaaataaatttgtacaaccagttattttgagaatgtatatctaagtatttattagattgttttttattatggttactagatggtttatgtagatatgtactttatgttttctgaacacataaattgaaaaataattgtcaggtacaactaatgaatccttttgattttgcattttgtggttctgtatcacagacttacttttgtttgctccattttgaatggtgccttactttattattattacaatgattatttcttgttgggcttttatataaatttcaagtttattcagtttctacttctagttgtttaaatttaagagattatttgcatttcctgaaactatagctctttaattctgtaacattacttgtcctggattattaaaatgcaggttcatatgacttccgttaaggttcttcatgcatctccacttctctctctgtgaaataccttcaacagaaactgttaaaaaggaagaacttctctttccccaagtggctgcagtaaagggaagtaatagactgacaaggcttttagatgtaagaaaatgtcttctggattaattactccctaaaactttatatacaaaaagtctttgatactctaagtttccttatcaaactaatgagtttactcttgcctatacctgtttccccatccttgattttacttttccaaactcttacggtgtaaactgcctaattttgctatgtatgagatacatggacacactcaacaactatactatattaggtagaaaatcatattattgtgtgtgagatgcatggtaaattgagtgtatgcagtcttctgggaaaaaccattaataagtattaccttgttaaaagattttagaaaccatgaaatacaaaagcagggcatgtgaatgtatttatgcttttaatgcttgagtgcaatatgtaactacagctttatgaaaacttaagcaacatgtatatatatacatatataaataataaactttattttagagcattttaaagttcacagcaatattgaacagaaagtagagaaagttacagtatactcaccagtcaacacacatgcgcaatctctcccactatcaatatgctgcaccagaatggttatatttgttactattgatggacttaacactggcacatgattatcacccaatgtccatagtttatattgtttcactcttgatattgtattttttgggttttgaaaaatgtctaatgatatttatctaccattatagtgtaatgcaaaataatttcactgccctaatcctgtgttctccctattcatcccgccctcctttcctcctcctcctcctccccccacttcttctttttcttttttcttttcttttgagacagagtctcactctgtcgcccaggctgaagtgcaatggtgcaatctaggctcactgcaacctccgcctcctgaattcaagcgattcttctgcctcagcctccccagtagctgggactacagtcatgtgccaccatgcccagctaatttttttgtattttttagtagaggctgggtttcaccatgttagccaggatggtcccgatctcctgacctcatgattctcccctctgcctccccaagtgctgggattacaggcgtgagacactgcaccgggccccctcccttcttcttaacccataacaatcacttttttttttttaatgactccatagttttgccttttccagaatatcatacagttagaattatacagtaagtagtctttcaagactggcttcttgcactgagtaatattaattttattttctttcatgtgttttctttcttgggtagagagttcatttctttttaataaatagtacttattccattgagttggtgtacctcagtttatttatccacccatctcatgaaaaacatcttggtggcttttaaatcttggcaattatgaataaagctgctgtaaacattcatgaataggattttgagtgaacctaagttttcaactcgttagggtgaatatcaagaaacatgattgctggattatatgagaagagtaagtttgattttataagaaactgtcaagctgcctgctaaagtgtcttctaaaatggcaccattttgcattcccactagcaatgagtgagagttcttgttgttccagattcttactaatgttagatgttgtcagtgttctggatgttagccattttaataggtatgtggtggaatcttaatgttgttttagtgtgcaattccttaatgatatatgatgctaaaaaattttcataagcttactttctatccatagctcttccttggtaaggtgtctgttttgatctctccatttttaaaatgcgttgttcataaattttaagagttctctgaatattttggttaatagttctttattggaaggttttttgcaaatatttttttcccagtctgtcatgtcttctcattctcttgacattgtcttttgcagagcaaggttttaaattttaacgaagtccagcctatgagttatttcttttttttttctttcttttcctttttttttttttttttttgaggcagagtctcactctgtcacccaggttggagtgcagtggcgcgatctcggctcactgtatgctccgcctcctgggttcacgccattctcctgcctcagcctctccgagtagctgggactgcaggcacctgccaccacgcccggctaattttttttgtatttttactagagacggggtttcaccatgttagccaggatggtctcaatctcctgacctcgtgatccacccgccttggcctcccaaagggctgggattaacaggcgtgagccaccacgccaggcccaagttatttcttttatggataatgcttttggtgttatatctaaaaagtcatccccatacccaaagttacctagattttctccattgctatcttctataatttgtataggttagtattttatatttcactctatgatccattttgtattattttttgtgaaacgtgtaaggtctgtgtctagattcatttttctttttttaaagtttttctagcactatttgctcctttgtattgccttttttcctccgtcaaagattaggtgactatatttatgttggcatacttctggtctatttattttgttctattgatcaacttatctattttttcaccaataccacactatgttgatcactgtaactttacagtaagtgttgacactgggtagtgtcagccctcttactttgttcttccctttttttatttgaattgagtattatgggccttttgcctctccatataaactttaggatcagtttgccacaatgcatataataatttgctaagattttggttagaattgtgttgactttatagataaagttgaaaaaaactgacaccttcacaatattgagtcttcctatccatgaacatgaatgtctccccatttatttgattcttttttttgaaatcattcatcagagtattatactttttctcaaatagaccttgtgcatattttgtgagatttatacctaagtatttcattttggagggtcctaatgcaaatagtaatgtgtttgtttttaatttcaaattacatttgctgctatataggaaagtaactatcatttgtatattaactttgaatcctaaaaccttgttctaattgtttattggttccaagagggggttgtaggtatgtggccttatttctggattctctgttctgttccattggtctatgtgtctgtttgtgtaccagtaccaccctgttttggttactgtagccttgtagtatagtttgaagtcagtaatgtaatacctctagctttgctctttttgcttaggagtgccttgactattcaagctctttttggttccatgtgaattttaaattttgtttttttctagttctgtgaagaatgttattagtagcttgatcagaagagcatgaatctgtaaattgctctgggcattatagccactttaatgatattgatttttcctatctatgagtatagaatgtttctttatttgtttgtgtcatctttgatttctttgaggagtgttttgaaattctcacggtaaagatcttttacctccctgatttgctgtatttctaaatattttattccttttgtggcagttgtgaatgggattgcattcctaatctggttcttaccttggctgttgcttgtgtataggaatgctagttattttcatatgttgtttttgtaactgaaaccttgctgaggttgtttaccaacttattgagcttttgggctgagaatgcagagctttctagatatagaatcatgtcatctacaaacagggatacttttaatccctctctttctacttgggtgtcgtttatttttttctcatgccacattgctcttgtcacgactttcaatactattttgaataggagtggtgagagagggcgtccttgccttgagccagttttcaaggggaatgcttccagctttttcctatttagtatgatgttggctgtgggtttgttagatagctcttattattttaaggtatgttgcttcaatatctaatttgttgagagtttttaacatgaaaagatgttgaatattattgaagccttttctgcatctattaagataatcatgtggttttgtctttagttatttttatatgatgaatcacattagttgatttgtgtatgctgaaccaaccttgaatcccagggaaaatgcctacttgattgtggtggatttgtttttgatgtgctgctagattcaatttactagtattttgttgaggattttgcatcagtgttcatcaaggatattgtcctaaagttttcttttttttgttgtacctctgccaggttttggtatcagaatgatgtcagcctcatagaataaggtagggaggagcgcttcctcctcaattttttgaaatagtttcagtaggaatggcaccagctcttctttgtacatctagtagaatttggttatgattctctctggtcctgggcttgttttttggttgacaggctacttattactgattaaattttggagttcattattgttcttttcagggaattaatttattcctggtttagtttttggaggttgtataattttgggttcattattgttcttttcagggaattaatttattcctggttagtttttggaggttgtatgtgtccagtaatttattcattaatttaccaatttcttctagattttcacatgtgtgtgcaaggaggtgttcataatagtctttgatggttatttgtattcctgtggggtcagtggtaataatcccttcattatttctcattgtggctatttggatcatctctccttcttctttattagtctagctagtggtctatgtattaatttttttttcaaaaaacccactcctgccttcactgatcttttgaataggttttcatatctcagtttctttcagtgcaggtctgatttcggttatttcttgtcttttcctagcttttgtgcttggtttgttcttgcttctctagttcttttaattgtgatgttaggttgttaaattgagttctttctaacattttgatgtgggcatttagtgctataaatgtgtcccagaaattctgtgtcccagaaattctggcatgttatatctttgttctcattcatttcaaagaacttcttgatttctgccttagtttcattatttactgcaaagtcattcaggagcatgttgtttcatttccatctaattgtatggttttgagcaattttcttagtcttgaattctattttattgtgctgtggtccctgagagtggttggtatgacagggggttcttttgcatttgctgaggattgttttatatctgattatgtagttgattttagagtatatgacaagtgtagaagagaagaatgtatattctgttgttttggggtggagagttctttagatgtctatcagatccatttggtcaactgctgaatatctttcaagtcctgaatatctttgttaattttctgactcaatgatctgtctaatgctatcagtgaggtgttgaagtttcccactattattttgtgggaatctaagtctctttgaatgtctccaaaaacttgatttaggaatctgggtgctcctatgttgggtgcatgtatatttattatagttagttcttcttgtttaattgaaccctttactattatttaatgcccttcttttttttttatctttgttgatttaacgtctgttttgtttgaaattagaattataacccctgcatttttctttgtttctcttgcttggtagatttttctccatccctttattttgagccagttactgtgattgcatgtgaaatgggtttcctgaagacagcataccattggatcttgcttctttacccacttgccactctgtgccttttaactaaaggcatttagcccatttacattcaaggttagtattgatatgtgtggacacacacagtcctacaccagagccctgccctactgctaacactgctacgagtacagatgtgcaaacagttgctatcaggtcctttgccccccagatcatactgccactgttgctgcggccaacacctgtacagaggccagcaccctggcacccactagcaccccacagcagctaaatgcatgtactccaccgtgctgctgctgctactgcttctggcacatgcaaatgagtatggatcccactgccactgccctgcaaagtgctttggctggcaccacccttcagagtgttgtgaccagtggtccaggagcacttcaccgcctccagcacagcaggtccctaaccttgaggaaccagaaatcaaagctataacctaatatcaatggctccccaatcagatttagaaaatccagtccaggagtcctgatctgagccttggcacccttaaatcttccagtaatgaagccagttgactgaacccaccttatatcacaatcaaacccccaaggtcatcaaataggataaaagaaaaaaaatccaaagggcagcaactttaactactgaaggaacatcagcccacaaagatgagaaaaaaacagcacaagaactctgacaactcaaaaaactagagtgtgtttcctccaaatgactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgcggacagataaaatagccagtatagaaaaagaatataaccaatctgataaagctgaaaaacacactataataattttatattgcatttgcaagtattaacaccagaatagaccatgctgaggaaagaatctcagagcttgaagactgtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagatatgatccatgagaacttccctgatctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatagagaaaggacaggtaacctacaaagggaagcccattagattagcagtggacacctcagcagaaactctatgagccagaagagattggggcctcatattcaacattcttaaagaaaagaactcccaaccaagagttccatatccagctaatctaagcttcgtaagcaaaggaaaaataagatcctttccagacaagcaagttctgagggaattcattacctctagacctgccttacaagagttcccgaaagaagcactaaatatggaaaggaaagacaattgctagtcactacaaaacacacttgtatatttagaccacacaaacaagttggcataataaacaactgaaaacatgatgacaataaaaccaccacacaagcaaggtggcaggagatggagagagtgaagggggaactgccaaacacttttaaaaccatcaggttttgtgagaactcactcactgtcatgagaacagcatggtggaaactgtccttatgatcccatcacctccccaccaggttcctcccttgacatcttgtgattacaattccagatgagacttgagtggggacataaagccaaaccatatcaattgcatatgatattcctaggtatagtttttttgtttggtttggtttgttatctgtcctgctttgtgttctctgtactttctggatatgtagtttgatatctgacattaacttgaggacaatgcccaggcattattgcctcatacactttttctgcccctttctgtctttcttctccttttgctattcttattctgtgtatattatatattttatagttttcccacagttcttagatattttgttctgatattattttcagtatatttctctctttatttttcagtttgagaattttccattgttgtattctcaagttcagagattctttcctcaggtgtgtcccgtctactactaaaaccatgaaagtctcattattcatttctttacaatgcctttgatctctagcatttctttattagaatttctatccctctgcttacattgtcaatctctttttgcttgttatttactttttccattaaaggccatagaaaaataatcatagtttttaggcgttcttggccggataattccaaacttactgccatatctgactcttgttctgacaattgttcagtctcttcaaacttgtgtttttgcattctagtatgccttgtaactttctgttggaaggcagacatgaggtactaaatgtaactgtagtaaataggctattaataatgtagtgggaagatataaggggagggtaacttttttccagtcctattattagatctcaggcttttggtgagcttctgcttctggtctacaatctcgcagatccctcctctgtttcaggtgaggcagaatgactggaaggaactggaattgtgtatttcccttctactccatggaagaatagacagagcttgagttgagtattttccttctcgccaaatatgttaggctctgatataacaccagcaatttaggctctggtaaaagaatttctcctgaggactggccttgttaaaaaggacagtaaatatatggtgaagtatttcaaaataggtcctgcaccatgactgggttcccctagagtttatcttttagtttccccccacttctggcacccagcaattcatcaattaattatcagcttaggattttccacctcagtgttacttgtccccattgaggtttctactcatggatatctgcttcagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaaaaatggcactgttgctaggaaagaccaattaaatcttaatgtttaatgattgtagtaagaatgcagcttgttttctaaaagtaagcaacacaaaatattctgagacatgtcattttcttttgtttaaaataaatttttaaattatttttttctgcgaaggggtttgaaataatagttttgtattgtgttttcagttggctatataaacttttaaaaatagataaaatttgacttggctttatttaaatagatttttgttagtagcatttgctctggcaaatcagttggttatgctagcagttctgcttacttttatcaagtcaaaatgatgcatcagctgaaatttaaggctagagtcagtcaaactgccatctcaaaactagtctttaacatctggtttgataccttcttaacatggtatcttttagatggatggtgttacaggaaaatcctcatagcaaaggcagcattcctggacatctgcagcctttttagaatcaacagaaatgctctggtgaagtagctgtgacatttacctcagcaaatactgaaattatgctaactgtaaaatgcacttcctcttcctactgcaactgctcttttgggaaaatttactatcacaatggccccagactaacattcttactcagatgctcacattttatcctgagtgttcaaacacctctctgcctttccagaaaggaatgaaaggagtgcagttgtttttcacaggtgggcatttactcttcagctttcctaactgtatgaggtacaagctttctttgtgtcaatctatacatgagatttgtgtcagtcttttcagtttatcacttttcaaccagtttaggattatgagctttacttttacacacataccaaccaaggcaaaggaatattgggaatcacagcaagagcattgctctcttctaacaaatcatccttgacatatctactcttaatcttttaaaatcatctttatatatccctttttaaattaaccatctaactgcttctagatctcctactatgaaatgtctaatggttgtctatttcatatttacttagtgtattatgctcatgatttctttgcgcatcaattgaaatgtcaaatttatcatcatattacccatacagttgctaaaaacatttcagacagatgcagcatttttaaaaatattgttttctgctatataaataaagatgtttagttaaaaaagtcctctttaggttaaaaagactatattgtgtagaaataatgtagagtccttacaggaagtaaatgacattccacagagtaagtatctcagggtcctgtctttgatatgattgctaagaaaactcttagacctttcattctgaaattgtttttagaatacccttgcttatgacataagaattagttgctttatttatagtgttaaagaaaaaaaaatcagtgatacatgttaaaacattgtatggaagactttcttcaggacctttgctatagctttagggttcactgcaatgggatattgtagtagggaagagatattgggatcaactcagaatacatcatgggcaagtagaaatttatagccatggagcagagtgaggctcagtaggtgaaaaattagtaaaaggaaacatcagggtaaggagattctagctaaaccatcctaagaagattctgctgaagacaggccaaggtgatcagacatcccttgccggatgatgaagaatgaggaacccagtgagctattttgggtcattggacattaagaatgggagcttcttgctaaactgacttaacagggttctttgctaaaactggattttataaagaagttcatagatgtgcctaggtgaaggttcgaaagccttgggaaagtttgatcagagaatatttgtcaatagctattcctgcttttagaacaattacaaaaatagtatataacttatgcattattttacttaaaataccgtgacatttttcaaaaagaaagactatcctaatgtgagaattgttattaataaggatattccgaaggaacaatataacatctgaaggcaatttcaaaagaggaacttgaaacattcaagcaaatttaaaataaagtgactattttaaaaatggaacagcaatttatatgtacatatttgagaatattcatataaaaagaagttgttttaaattttcattctatagaaaactatgtgcttcctagacatggtcacaacactcatatgggaagtaaagatggtaagaaacattctaatgaaaatgataatgctttttatgaaaaatttcacattttatgttagctttctcaggaaggatagaaaatctgaatgataaagacaaatagttaaagtaaaagttcaaatactattgtattacagtctaagatgttgttattactggcattgattccctagttattaagtgtcagagtaaataaatctttgtttttataaaatccttataaggaaatgaaataaatgtgagtactgaatttttatttcatagaaaactgagggtaaactagttcctttatttttagtttatctgataatagacagttaaaataatattctttacaagataattatgtaaatatattacaaataaatcatctacattatgttgactgaactttagttttatttcagataatttttatatttaatactgttttcactaatgctattcaatagctttcaggtagtagtttgctaattaatatttgaagtaaaatattaaaacccattaataataatagaggtaatgtcctagagttttactgtttgttcttttagaggcttattagtattttttcagactcgtatattatattcagttttcagtttgcaccatattttcaggtgatgtttcttttatttaactaaattcatccatatctaattctcatacatttttagtcacagctgagctaccctgcttatgtattaagaaggttgaattataattatgatttctttaaagtgtccttgaaacttcacccagtctagaatgaattttgaattttaaaatgttagttttgtgagcgggtgtcacttttgttttaaatagtagcgtagacctttcttcacttgtttcaaacacaacgtggccaggatgctgatacattcggaaaaaaaaaaaaactatggatataaatatgcaaaaattttatttttagaagggtagatttagatattaatataaataatttatattatttttaaacttcactggctctatgaagcatagttctcttggttcctaaaattcattctttttctttccttttaaatgagtctgtctatataacacacacatacacacactcacacacacacacacaacatatatttatatataaaaatttaacaagtaacttatatacatataactgtgtagtatttcaaaacagagtccataaatcatgaaaaaaaaactccatacacagttgttaatgaattaaaaccatgagtcatttctcagtgaagtagttatttcttattctaaaatttgataaaattggctaaatacagacatacactcacaggtacacacatacattttctgtgactatactttgagagcctggtttcctagttacttttgcatactattgtaccttacattttggtaatccaaatgtgagtaagccatgattgtgccactgcattccagcccgtgtggcagagtgacggcatgtctctaaaaacaaacaaacaaacttatcttaatgcaaaagaaattggatacattttcatgattaatttgaatgtttccttcagctattctataataactttatgcaaagttcatactgtcagaattaagaaagatgtattattgattttttttctgaagatacatcttcaatattatattttttataatctagtgttccattgccattgtaccttcatcacttgattcagtcacttcattcatttcttcaaatatttatagagcaaatgggtagaaaactagctgtgcctgctagagctttggcatcagttattattttcttttttaatctttagcataatagagagccatgttttctatcttaagagtaacagagctttataagtgagttaataaagtaagagttgatatgatcaagattgagatttaggaaaatcatcctgtctcagtgtagtgaacagattgaaaaggacagtggtggatgtgagaagttgttagagtgttgcaagaatgcaggagtggttaagagaatggcatactggagagtggccaagtaacctgtgtccaaaaaaattaatttaaatttaaaatatatggtgatcattggtatattttctcagatttatttcactaaggaatctagtgggctaattagaaaataagggaatgaaattatgaataaaattctttgattaattctgttgtgaagggaagagagaaagtatggcaactactgtggaaagtatgttaactagaggaaagaaaaataagacctgaaaggcttgaacatgtttaaatgttgtcagtaaaaagggaggggtaaaaaaagaaagaaataattatataagattcctgtaagtaatgtaagaatgtgatggaatttaaagcagaaaatgaaggattcgctgtggcttgtagggtaacaaacagaaggagaagaggagagattttgacagatggtctttgacataagaaggttttggattgatttttgagtgtgtttccataaatggttttatttttctctgtaaagtaaaacccaggtcaactactaaaagtgagttgagtccacagaaagttttgagtgtcaggaaaggagcaatttgaaattgacgttgtagagaataagttgaaagagatactaagctttctgggcagggttgaacatgtgcttcagtttcactcttgttagtaccactttttccagcaatgctgtgctgcttcagattcagaagacattgatagttgagttactccagggctggggttgggttaaacagttcaaaggaaagagagagtttagtgagtttaagatattggcaaaagtaatattgagatttatatcatggaaaaatcatctgaacatggtataatataaaaaaggagaaaaatctaatgaattgtaagactgtaggtctttaatgcgcatgaggctccagtgggattggaaaatattaccggtaaagaaactgaataaacaaagtggggagaaaaaagagtctaaaatcatagagcaggaaagttgagtaattcattttgaaagtaaagtaaattcaggtgttgaaaatagtgttatgtgaccatgattggctgaagcactaaaaaaagtgttggtaatgattttgaatgactgacaagtcactctgagtcctgtgtgaagggcactctgtgtgaaggactctgagtgacttgtcagtttcaagctggtgaaagagaaacagaggtaggctggaaatgacttgtactgactttcaggaaataaatttacagaaattttatgatttggctgacataatacctgtagcttgaaatcattaatagtggatataaaatcagcaagtaccacaagtaaaaataaagcaaataaaaattggcaaacactacaaatcagggcaagtctcccttttccagagagacaactgttaaacatttactagttcatcactgaggagaagcaaacatctgtatccaggaaatgaatagaagactgtagtaaaataaatcaggtagtaatattgaatggttcgaaccttaaaagaacagggttttgtaccttcgcttcctttcaagaggagtgtggaatgtgtgatttagaagtaggaaagaaacaaggatacatttcccattcttgatgtatgtggagtgtgaaatacatttttcattaatgtattaaagctgtactcaaaattaaatagaatttaaaattatttatgtagagcaataatgtggctatccttctattttgctttaaagctgggtcaggtatatatacatatatttttcttattgaatgaagccatgaacagaatatgagaaaaataagtacaagtctagttattcttaattaaactgatttgatcattacaaattatatgactgtattaaattatcacatgtgccatgatatatatatatattatttataaataaaaataaaaaacaaaaataaataaatattaatggatatatagaccatctccactgaaaaatatcttggaatttatatagtctaatccgtttattccacaattgaacaaattgacttctagagagataaacttactcactacagatcatttagctttgtaatgttagagctgaaagtaatatgcctgtcttctaaactccagcatgataggaataatttcattgtatgcatctagtcattcatttatccatttttttctaatttattcaataagtatctattgatatctatgatatactagacactgttccagatacaagagctataaggataggggaaaatccttgcattaatggaggttttcttctagtaggaagagagagaaattgaacagataaataagtataaagaggaaatacataatatactacctagtcattaagaggtatgaatacaaataaaatagacggaggataaggtatatatatggtgagtcgagggttttaattttaaatagggtaaatattagaaattctctggaaaaaggaatgtatcagcaaacatcaagaggaagtggagaagcgaggcacatggatatgcagggaaaatgcattccagctagagaaaacagcatagtcaaagaccctctattaaattgtacccctaattaaaatgtgctgtaaattaatgattaatataatcatcaactactttatacatactcatattgtgatatgttttaattctcagtgtacttgtaatgcattataagactttaagctttgccaggacaggggtcatgttttgtttttggtaaatctacgcacacacagtgcgtggcatggttatttataccaagctggtggtcaatatatattagaatgatagatcaaatgattgaatgaataatctagtgaattattaaatagaataagttgagttttaaactaaaacttttgtgcctctaagtctcctcacctgaaaaggcctggcgttaagggccatgttggttaaagctcctacctcagcaaaagctcagggtgctttttctattcttgcttactagggtgattaaataacaatagaggggaaaacaagtttccttatccttaaaaaattaagaattattttaatggtaaaggcatatacatatacacttacatatatatatatatatatatatatatatatatatatatatatatgaagacagtaggtatatgctacagtcatctcatgtacaagtactgtgtttctcttttgattgattatgtaaaacaagcaacgagaataaattctgattatctttacagagctttatggactgtcaaaatggctttagatgagttttctcatttatttatcacaatacttccacgatattgttaaagaagctttttattacattaggtagggaaaagaaattatggcttatccaaggtccttcattgacccagtgtggtaaagtttcttaattgtatttcagtttgtccacatgacagtaaaatatattcttgatggctattatttataagaaaagaaaatatttgatcaggaaagttgaagacatctcatttaaaagataatatgcaatgaaccttcattatgagatacttggaatggtacacaatgaactatcaaatgctgtttcaactacctaaaaaggataactgtctttaactgcaccaaatgatactaaacttgctgcctatcctattatgcttagtcactctgatttcttttattcctctattaactcacactaacactgagaagagcaattctctctgtttcattgtccttcccttcaaatatcctgttttaagagattacagatgccttgagataacactgccagaattatcccaaggctgacaggtttactaacaactgaatgcttttcagatcactgcactggactcagatccacctttgatatgaaccacatatggcttcagtcttgtttccctgaattaactctaatttcctagtgaccaaggtcagatgagtccagatagggctcagctgttcttacctagcacatatgttccagtattgttggtaatttatttctgtaataaaaaattaaaatggaaatctcagccagaatctcttttaccaagggagaccttgctatgagcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattcaagagaaatagaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaatattgataatgttattttcttatcacttttagacagtcaggttcataaaagcaagttcaatgagcataagatggtttctaaattttaatttatttttgacagcaaacaaaatgaacaaaggtgaggaatccatttgtgtacctaagatatctttaaaaagaagatacctttatatttgtcaaatatgttgctcccagtaaaagaaaagaagatctatgcaagtggttcaagagtaaaccttaccttattagcttttcataatattttagaagaaatttaaaacaaaattgcaaagcactattcttacactgatattttaccagttcactaaaacattcagaaaagaaatttaccctaaaatttgttagtcatttgagacttgcaaagagccaaataatttccaggttgcaaactttatttagtgttctagcagaaactaaactaaaatgtctataagttttaaattgttagatgtgtgtttaaaatattttaaatatttacattgtatgctctttttaatacacaaaatcatttggcaattgtgaattttaaaagggggtgtatttcttattcctttaaagtttatttttgacaaaaatacattattttgttgatgtttcacaatccatgaaaactgctattataagcagatagtgtcttctgaactgattttattggtttgtgctgatgtagaaaaaaacaaatcggcttacaagcctcggcatttttataaaataaacattgctaaacattgacatcccaaatccatctaatataacatagaaaaataagtttctttaaggaaaggaggaataaaatagaaatacattctagtatttttagtggcagataggataagtttagtgggaaaataagatgatttacgaaaacttaaaaatgcatttttcttacagtgctttttttaagatatgcatttcatgcaatatctctgagacattatttaattgattctcttggctttatctggctaattactctgtataatataactataaggataataattaagaaatcgttttttttatttttgtcaggtaagttataatctttttatgttttatgtaattaaaattcttttgcaaaatcatgatgccatgaattttatctattttcacttttttttaaggcaaggagctttggttctctcaactgtgtaggaaagaaaaatattttaactatttcttatcttttacttggctaccctcaaggtgagctctttatgatcctctaatttgttgttacctcaattatttgctaatagaaaattattttatgatgtgcttagcttactacctgtcttttattttatatatttctcttaggtactacattcttttggagagtatttcctaataaatttggcagcagctatggacagggcaaggatgtgtctcaattcctgagtctttcctggtgttctgtctcagtcttcactttctctcatcacagtggccagaggaccttcaaagactgtggacattttggctgatcagcttagtccttatgtttgattttaatcaggtcccttggcaatgatcagtatctacttcactgaaagacactagccattgttacaggtgatggagcaaaatgtatttacaggtggctccttcaacatgccggttgttttccacgtataatctttagtttatactgcaactttatatttcctttcttctatgtcaatttgcatacaactttcatattcaacatagaaatatttgattaatttcatttttacctcatcactgatcctaagtgcatttttattccttttctttaacttgtacagctcccatttattgatttttacgtttcaagttcctataatctatttaactttgagaatgttcaacaactttttgctttattaaaaataaatctagctaagtcttcttattttccccttacacaatatattttacagtggaagtatgaccccatgggtgtttaatataaatattttcaaaccagaggtcaagccaatggcagtgttctaaatcctcgtttattctactcaggacccaccttattaggaacattgccttattttttttcagcttcactgaggtacagttgacctcaataaaataataaaaactgtatatatttacagtgttggagagtctttcctaataaatttgacagcagctatgcacagagccaggctgagtctcaattcctgcgtctttcctggtatcttatctgtatctacatacatatatataaagttatcataatcagtttaattaacatatccattatcctgtatttttgtgtatgtggtgagaatatttaagatctattctcttagcaactttcaagtataaatttgcagtataattatgtgtagtcactatgttaaatgacataagctaggcacagaaaaacaaatgctgcatgatctcacttacacatggaatgtaaaacaagttgaactcatagaagcagggagtagaatagtagttaccaggggtttgaggggatgaaatggggagatgttagccaaaggaactttgcattattgattgttctttctttttctgacattttaaacctctcctttcttttgaaacatccgccattggcatttaaacatgctcaaatctcttcaatcttttaaaatcttacttaaaccaaaatattcttctatctgctattctggatctgctcatcttcagggttgtactttttattttattttttttttctttttggcacttactgctaccagtttactttcctcaaatcctttcttaatccactttgatgtgacttctaagagcttcactcccctcaattagcccttgctaaaataaccaagaaactctctgttgccatatccaaaggaaattattcagttttcattgtttgtagttttctagcaaaatcactacaagggaccacttcctcactcaactttctcttgccttaatttatgcagtacttagattttcttccttctctgtttactctttttacgtttcagcctcctatgccagctggtgaaattcaaaattccacaagccttaatcctaggactcatcttatcttcctctcctgtctttttccacatctatccacgacttggtcaattgtatctaatatggcattcaaaatctacatttttagctttgatatcccctctgaactccagacttaatgtctaacttcatattacagatccatttgaatgttcctcatgggtccccaactcactaggtataatctttctcccctaaaatttgatcttctttcagttttttcctctgtcagtaatgctcaagtgtaaaccagaaaccaaggacttgttcaacctaaacctcttctttttatatttcaataattaccaagtattatgcattacacacacacacacacacacacacacacacacacacacacacacacacacaccccctttgagtttctggatgtctttccatctccaacaccatttccagagtccaagtactgtttccttagactgatgctatgtgcttctaaatggtctttttacatccattgtagtcttagtgatctcttcaaaatgcaaatctgatttcatcatccatagacaatctgcttcataattgccttcacttctcactgctcctatgattaaggcatattttgttcttgcatgttaactatttatgaaacctggaccctggtcagtgtctaaaattgtgcctattacatgaaagtaattcaatacacatattttacttatttatttttattttaaaaatttttaataatttcaacttattttagattcaggagatacatgtgcagttttgttacatgggtacattatgtgatgctgaggtttgaggtacagttgatcatgtcacctaggtagtgagcatagtctgcaatatgttttcaaccgttgcccccatcatcttcctcccttggtaatcccccgtgtctattgttgctatctttatgtccgtgaatactcaatgtttagctctcatttatatctgagaacgtgcaatatttggttttctgttcctgtgttaattcacttaggataatggcctccatccagctgcatccatgttgctgtaaaggacatgattttgttcttttttatgactgtgtagtattctatggtgatacacgtattttaaataaaagagtaacttggctctgtgaaagcagaagttgcactgggaaaagttaaaccaacaaggaagacttttctattccaaaaaggaagagagagatcagaagtcaatctctgaactgggctgaaactctggagagttttaaaggatggtttgggagtttttaagggtgaaagagcttttaacaacaattgggtgggtatgggggattatgaccatatgtgtttgctaattgggattatccaagggaaatataaactttctcatatcttcgtcacagaaagtagttttacaacttggaagaagggaccctctgtctgaagttaggtttctacctttccacagagactggaagatagagatgcctccttccttgatgattacctttcaaagggttgggtccaggccctttagaaagacagtctggtgttgaaaaactgccaagagcctttcaaaaagatttacatttaaaagggacaaataaagaatttacaattacaagaattcggcagtaaattatctacgagaggggagggaaaataccttgatgcttaggctatctgaatcatataagggactgagtgagcttaagatggggcctggaggtcagaaggagcctgcctaaagtttaaaaagctgagggaaggcttcaggtcaccttcattactccttatttattttgctatcattttctagcactctgttccttagctcatggtgccccagccaaagaatactttcttcaattatccctcccatcgagttcatatccaaggtagcatctcttgagtgctttctctcatattagagagttcttgatgttgtaaatgcaagagaatgcattttgagtttttgttttgttgcatttgtaaaatatttcttaccactttgaggatcatttatgccattctgtttgctttagtctttatattttcagttggaggctctcctcaagtatctggttatccttggctgtttgatcatatttaatagattttaaaaggctcactgcaaactctaggtgcttactcaaagctgaaaaactgagtttcactgtggggtatatagtgggtaatttagttagaaaatccatgaaatgtatatttagatagagttggtgtagtgcactgattaagattatgaaacttgtaggaaatcttcccatgtttgagtcctggttttgccactaagtagccatataattttaggcaaatcattaacatcattgtgttttggttttcttgtttataaaaggggtacaaaaatacctacatatttttataaaaattaaaaattttagtatttgtaaataatttggaatagcatctagcacatgctaaaatttatatatgtgtaaacttttattattactattaatatttattttgcttgaaaaaaattctattattctttctggaggaagtatatgaatcaagacagacataaggctgactggtctcaacagtggttatggatttcaacttatttcttctggttttaatatggtcttccctggttcaactgtccagcatgctcttgcttcctctccagagaataaaacctctagtacctgcttgagtgggttgggggagtcatcatgctattcggagataggctgtaacaatgtaactgtttttaaaacatcccttcaataaattctactttttttaaacccacgtttattttggctttgaaagggatctagaactgactatctctggacatttgtggagtgagggtgtattctaaagttacctatttcctggtaggtgaccagcagataatcatatttcttaaactgagctttcatatttattatgagaactaaaacagtttgggtgacttttctatctaaatatattttgccattaaaataatagaaatgcttaaagaaatgaaaaatcagtgctggaaagtatttcaagaattttaagtgagtttatgttttgtaaaattcttattacactaattaactgttagtattgtagatcagatatttcaaatgtgaaataatatgatagttcttagtaatttaacatgaaactatatacatttgtaaaggatacagtagcaacatgtcttaaagttggatggttttcagttgtgattaaaaaaaaatgtttgatgtgtttatcacatggattacagtaaaatattcacaatgaatggatttgtgtactattataaaatataattatcttggccaggcatggtggctcatgcttgtaatcctagcactttgggaagatgaggcaggcatgttcagtgtttcactggggagcaaaggtttgcatttctacccggtcttagccctgattctgtccttgtctttatagagcactcattgtacctttttctttttcctagtaaatcataaggtacttatttccattttatcattgaaacagtgccaggatttttctctgtaatattgtgggcctgccttgtagtggaagtagtagtaatatcacatttatttccttgcacatgtagaaataaaagcacacttaaactgtaaaaaatattccatatctatttgcttgaaaagagttttaactttttatgataatacaagcagtatgatgaatatccttcctgtgtttgtaacttcaggattatttttggtatttgtataatataataattaaatgatgataagggtttcacagatgaactttcaaggagcagatgctaacgtttttcctgtttatgttttaccagggccttctgaacaaaacctattttcttcttttagtaataaaattctagtaaagccctcctgagaattttcagttggatataaacactattcaattgtattggtccaggaatctttagttatttagtaggcctgaataatagatttctgaagtccagcttaaagaagtactgaggtgatcaaattgtttctcagtggaaatgtagacatctttatttgtaacatccttatttgtaacacattctgctcgtctcttcaacccatacattttttgtgtatccctgggggttaatgtagcatctgtgttacgttaacccaagttgggggaaaacaaacaaactcttggagtcttacagtgtcaatctgagtgcagtatttctctcttccacgtttgttgtaaagaaatattgacaaatatgaaatactcaggtaagagacaagcacaaagaacttccttataaatcatttgttttctgttgtatgtatagctttcagtgatttactgggatgtgattttaaacatgaagatttttaaaaatatatttgttaaataaatctatactatacctagaaatatgacgagaaattgctatgagacagtcattatacagattcagacttttttggtatatatatatatatatatattccttaaaaattatattaagatggtacaagtaaagtaaatgtagttcattgtgtctaagcattataggagcacatggaaactaaagaataactttctcgtgaccaacttatatttattttcttcagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggtaggttatatgtcagctctttgttctttgttcattaatctgagttgctgtaagacaggggaaaaatagtgtgtccacgtatgccattaggaattttgtttttaccaaatgcatcctgctacctctctgattgtataaaagcaggttatcattttggacatattcttctgaatagataagtcaaaaataggaaaaaataatttctatcaaaatggtcagtagatatttttactgtatcagtgttgaaaaacacacagtataacccagctaaccttctcttttcaatcttaaattcaaaaaatgttttatgagtacactaaagtttttgtaacaatttacttttttaaatttgtggcttacaaatatagtatttgacttagagagttaacgaaaataagtgaggcataaatggctctcatgaatattatcagaattgttttacttaaaagaaggtagaaatagcagactatttaccaatgacatatctagaatatttaacactaaggattatttttaacatcccccttctttcatatggcaaatcatttttagtcaaaataatcaaatgagataatgaattgtaatttccagaaaaccataataaaactcttgattatatatatacaaacatgtatgaatatgtatatgatggtgccgtaagtaaataaacacacacacacacacacacacacacacacacatatatataaaacattacagtacatgtgtacatgtagtggacagaataatggcttcccagagatgtccatgtcttaatccccagaacctttgaatatgttactttatagcaatatactttgaatatagcatatgctttgaatatgtatcatagcaaaagatactttgcagatgcgattaagttaaggatcttgagatggggagattttcctggattaaccaggtgcgtccaatgtaatcacaagagctcttgtaaaagggagagtgtagggttgagtcatagttacgatgtgattatgacagggatgtgaaagaaggagagagagggagagacaaagagaaagaagagagaggagagagatttgtagatattattttttggtattgaagatgtaagaagaagccatgagccaagaaatgccaggtgacctttagaagaaatacagtccttcagagacatcacttttaggacttctgacatatagaactgtgagataataaattttatattggtttaagtcactaagttgatggtaatattttagagtagcaacaggaaactaattgtacagagggaaaaaagtcatagcatattttaattacatcaatgtactttttgaaagaaaggggaaaacatattcatgatttatcacagtaatatctaataatgctgtacatgctttggacctttacttttgcaaatttgtcaatgacttggttaaaaccgatcattgatttctggcaactctgaaaagtctaggaagtccaataattttctaccaaaaaatttaatattaaataaataatattacatttggaaaatcatctgaaatgtattatggtttaaaaaaagctcgaattagttttgacaaaattttgagatactaattcttgcatttatgtagtagagtcataataaagaataattgtgcagtcattattgaaatgaaaaaaaacaaacgagttcttactcccaaaataggcaagtgtagctgagtccacataattgaggggttaatggtgtaattggaattgtccaattttatttccaggtagaatacaatacttactaaagaattaaatataaatatttgctaatttgaaaaagtcaataaaagctcagttgttaaaactcaacaataattgtttagaacttagaccaacaaaagatattttggaggaggaatattttatattttacatgttttagacttcccagtgcataatgatactggatgccactgtttttaaattctccacagaaaatataccccctttattacctgcaccagggaaaggcttcctcaagctttgtccctgttattccaatattatgtacaaattcaaaattgggcaattttaatatactataaatgtattaaaatgattgtgttttcacaattatattgctgagaaacatttttttacttctcaaaatgtgttaaattatacctttatcgccagtaaggctttggtttattgccctagctctgtgtgatgggagtgctcaaatcttggcattctgcatagttaggtcagttatggttctttccctcaataagaaatgcatactgaacccagaaacttcatgagttaatgcaccagttatttggaatttgtgatgcacaacttctttgataatttttgaaatatgttttttcctaggaaaaatcatatactcttaaaagaagaggctgataatgtgctatgaatatcatcatgcagtattctgcacactgatattctgaacttattcttgtcactactgtgctcttggacaagtaacttgaaatttatggcctctaattttttaaactagtaaaagaagaggattgtatatctcaggtccatttaaatgctaaataatttggcaaataatgtgcttgatagattctcagagtttcgtctaagttaggctagactacatggagaaatatggttagctgatgtcttagaatacattcaaaaaatcaggcacactcttaaagtagttatgagaggtggaagcagtggtctgttaggctgccattatcctatagtttcatttgggaagagctgaaataaattaacccatgttttagtatcatttctgaaaggagtgagactcatatattactaccattttctccgggtttgcatcgtctggatgagactcatatattgctatcactctctcctggtttccattgtctggataagggcagagatatttgtctctcttttgctgttcattgtttcagccactatcataatctgcatttctcaactgggaaattagcatttgccttttatgttaccattgctgaagcatactgaaaatgataatagtgtgttaatatatttacttacttacttactttaaaaattgtacttaattataaacaacaaaaaaaaaaggaattcattaaggtgtgaaaaatattccttgaggttcttgctctttctttctcagcaagagttaatgagaatagctatattcaaagcagagcaatatgggctaaggttctgaaaaactcagattacttccagaagttccccaggctttttaatttatatattcaggagctataatccatagtgaaaatttcacctttagtaatatcctatatgtgatcaaagaggggaacttccttttctttgcttttattattgctcagattttgaggtattttcaagaaagcctatgtggtttgatgaggagattaaaacgggaaatattatgagtctttttgagtgggaaatcagaaaaaaaattaaaaattgtgcatatatccacccctgccccattttcccccaaattcatatattatcttcttagcctgccatgcctccttctaattgattcatttaggggcctccccatcaccattcatcactctgagtgtgatcattactgcccaaagtgtgctgtgagatcgctgaatgactcagaataagctatttaattaaggaacctctgtttacacaaaaatagcttagtggagcaatcaacaatgatgtgaaagtaaatgctaaataagcttaagcaggtttaattaagtttggagtgacattaaattccttcatagttttcctgactgcagcaacgttattttaatgtggcatttactgtgtggtagatttttgaagttgcaggagaccttacttggtaagttaactgaacttcttatttcattcaaaacaatatttttaaaggctcggagtgagttaaaagcaaggagcaaaatcatagcagtttcattaaggaatgtctaaattgtgtgagcaggtgccgtcttgtctcttatttcaccataggtgataatctatttatctgaactgggaacatttctcctccttaatagcatttttggctgcattgcttctctcctgactgcctgtacttaaaagccttcttggtttctctttttcaaatgttgagtgcatattgcactttgaggactaggcagactcagcagtccgtgagctggtaggaaagcagcagtctagaaaaaattccattagggccagttggtattattttgctttgctttatgcaatttggtagaaatattatcaaatgactgaagggtctcattaagatgatttctatgtttagcaatgagttagtgtcctctttctttcatgtattagttcctcacaactttaacaacaagcattgtatgtggcagctgaaaaagggatggagggaattgtgctcatatttgtgcatattattaataatgtaattttctataatttcagttgtttctattttacttgtgggattaaatcaatagtgaattccagtcagtgagtgtataattatttaacagtgagtaactatttctgtgaacaaaacccaaaatgaattagtcatataatagagaattactgaaatacacactatacatgaagaatgtaaagataaagtggacatatttacaatgccctttaatatgaagattaaatttaaaaataattttagccatacacaaagctgttatatacattttctctcatatttactgatttaattagaaatattagggtatattttatttagtaattgactttaatgttacctttacaagctaatgctttaaaacaatattatctatgaatatcaaaaagcagtagtaccattaataatcctcaagtaacttttatcaaattataatgtacttacccataattagcctaaagtaaaaaatgtaacattgagtttttatggtagaagtacactactttgacatataaacaaaatgaaatttcctttttttacttctgttttctaatgttaaatgcttaagattcactctttatttttaaatttctcattatttggtgaggtaagagatgtagaattggtaccagtggaggtacgttgtttgtttgaggcagatgccaatgtttgtaaaaatagaaatcagtatgagaagaatgtcgttccctgttttattcaccatccatttctaaaattctcaatttatgatataataagtactgaaatattcatcattatagatgcataaaattgccagccttccgtttttcagctttactgaagtgaatgaatacatttgtcttcattagtttaacataatgcacaaaaattgatgcaaattattcatctttctgcaggtcagcccttccattaaaatgcattctattttccctttgcataagcagcacaattttaatatttgaagtgattttgcagggctaaatctagatctaataattttcagagactgaattaacaaataaactcaaattacacctgttcaagctgtacattcctggcatatttgttaagtctagattatatgtcactgaaaacataagcatctcaataagttatgcctgctccacagacatcattaacaggctgcatgctacaatctaggaggcttcaacagggaatttgatgaattgtgagcaccactgtgaacagccgtgattaatattgtaaatgttgaccaaatggtacccaaacaatgtagaaatggataattctcataaaacagagttctgagagattttatacacaaagattggatcatttaattcatttacttattagtccaagaccatggcttcaaattttactttagatcagttagccacagactgtcagactatgtcagatagttgtccttgggttagcagaggtgggtaagatcaatgaggagtcactcttattagaaaaaagctagtcaaatgtttgttctaaataccaaacccaaatgctttgcatttgctgaccctcatgtgacagacatattcgtagcatgttgcatggagtctttggcctttgtagtcagatgacctgtgtgcaaattttagtttcacctggatgaaacctgaagaagttactgagtccctattacacttagtgtcctcatgtataagcagatataaccatgttcacataattggattgtgataaagattgagcatattatatttttagtacttgaatcagaataggtagcataaagaattttaaagaaatgttttgatcacttctaatacgaggttttagaaaatttaaaaaaaaagtgttttgaagaaatgttctctaataattgaaagaatatgttagtggtctctatttatacatttttagaactgtcttgtctttgtatgtttagggatattaaatatatagccgagaaagcagagtattagtatgacccactgttaaccagctggaaacctgtttctaatgaaacctacctgggattttaccatcagccaatcagtatattgtaattagataactatcattttgtgggaagagagtgattgatatctactatataaagttaagaaaattcctatcataaggcattatctgaacaagcaaaatggttttccatttccaaacatgtcttgaacttttagtaacagagctcaaaatgtattaggagaagtatcatctctaaagacatgtttagtaaacaatctttttagtaaacagagctcaagatatactaggagaaaaatcatctctaaaggcctgtatattttctttacatttgaccaatctacaagaatttcattactctttctttcctgcttagctctgtaaaataatgaacataaaatataaacataaatcatctttcttttttagaagaaagataaggaaaaacaaatttgacataaaatagagaaaaatgcaatattggacataaacaaatacctgttattagtgcagggacttagatagctggagcttagtgagaccaaagcagacagaccaaattgcaaaagggacttcagcaatacttaaaggatgggtagttcactgtcttgaaaaagatatatttttttcttccaattttagggttcttaatgattaatcaggataatgatttaatataaaatggtccaactcttataattctttccttggaattttacattagatttggaaaaaagcataatagtaaggaaatcattgctgacataaccattcctaacactattctaatgattgctgatggcaaaatcataagaaaggtagggtttataggataaaattatttctattttcatacttagtgtcagagtttcatggtttaatactcaagaaatatgacagcaaatctatttcaccagtcacttttaactaatatatatgaaatatgtcagaaccagtaaaaatagttggctgtttcattacaggttgataacattttctttttcacaagttagaggatatacagaatattaataaaaggcaactgtctaatacatatactctataatttgaattcttcattgatacattttatatgccatatataagcatctccctttatgatcttaggtacctgaatattttcctgcatattctataaatattccttcaattagaatgcgtttatattatttaaaaaaattttttaaactaaacatttataatgtgtatatttatgacgtaaaagtgacattgtgatttatgaatacaataaggaatgattaaactaattagcatatcaatcacctcagatacttatctttttatggtgtgaacatttgaaatttattagaatttttgaaatgtacagtacactgttactaattatattcaccatgttgtgcaatagatttaaaaagaccctgttcctcttatctgagattttttaccctttgaccatcatctccccatttctctcaaccctccagcctctgctttctgtttctatcagttcaaatgtgttagatcccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattttatagaagtataagaaattcatgagcaaaaatgataaggatacaaaaagagtaatttcatctttaaaaatatatcaatccataacattttaatcaccaaatggtgtcagataaaagtgaaccaatctttctgatacctaataatcttttcacattgtgtatctgttcaatcagtaccttgctgaaaattttctagtggtgctctcgagctatcagataaaatactaactcctaacaatgtcatgcaatccctttcttttacctatcttaagattcctgtattagtctgttttcatgctgctgataaagacatacccaagacgggataaaaagaggtttaattggacttacatttccacatgattggggaggcctccgatttatggcgggaggtgaaagaattattacatgctggcagcaagagaaaaatgagaaaaatgcaaaagcagaaactcttgatgaaaccatcagatctcgtgagacttattcactaccacgagaacagtatggggaaccacccacatgattcaattgtctcccactggctccctcccacaatacatgggaattatgggagaacaattcaaaatgagatttgggtggggacacagagccaaaccatatcatttcctttctgaatttatcccctcttccctacatctaacctgataacaatacaaacaagttgggtttccttctgcctgagtttaccttttttcactcttcctccaattttctggttgaattctctcatccaaataaatttcttatgctgaccttttcatctctttacacacttttcctaggctgccacagaaatatatatgatctctctcttttggaaccatagcacattttcagatattcctatatagtatttggtatataatattacaatttttaaagtatctttttttccattaagatgataatatgagtgtcctaatggcaaggaccataaatgaatcaatttttacccatactgtctcactattgttgagtacataaatattacttagcgtagctgtgagatcctaagtatataatggtgaacaatataaccatgacccctgccctgctagagttctcagtgtaacaaagactacataacatttagcaagtttttacaaataaacagggtaatgtgttacagaattatgtgacagatgaaactataataaattagtcttcaggaaaggtaagcaaaaaagattacttctatttgataacaggcgtaagaatgataactcttcttttacttttgctacctttttcttacttctctctcttctctttccatctacattccagttttggaaaggtgtacatagaaaaggaaaaagatagtgagagcatctcaaatccattttgttcatttcttctagatttagaggataggatgaggtacaagatatcagggccatggaagaatttagccaactataaatgacactgttcatgtagaaatgagagaagagaggttaaaaatcatctggtatcaagagaagaaaaaaaatgtactaaagacatacctaataaataattatctaataatgcaaagaacttttaaaacacaatcataataaacaaccccactaaaaaatggtccaaagatcttaacagacacctcatcaaaggaaatacacacataccaagagagcatatgacaagatgctccatatcatatgtcataaaagaaatgcaaattaaaataatgctttatttaaaaagcaatgaataaaaattgcaagagtaagttgttacctatcaataataaccttgaatgtaaattaattcttccatcaaaatacatacagtggctgcatgtatttttaaaaagatcaaattacatgttgcatataagagattctttttagctttaagagtattcataactgaaagtgaagtgatggaaaatgtattccatgcacatggtaaccaaaagtcagcagggatggctatacttagagttcaagtgaaaaacatttataggagacaaagaaggtcattatttaatgataaaggaggaaataaatcaagaggacataataattgtaaatatatatgcaccaaatattgattcacctgaatatataaagcaaatattaatggactgaaaaaagaaattaaaataatagtaaaaggcaccaataccccacttttattaataggtaaatcaaccagacagcaaattaacaagaaaatactgggcttgaactgcacttttgatattgttttgctctgtccccacccaaatctcatgtagaattgtaatccccacattttaaggagggacatggtgggaattaattggatcatgggggcagatttcccccatgctcttcttgtgatagtgagtgagtgctcacgagatctgatggttaaaaagtgtgacacttctccccacaacctgcacccactgccaccatgtgaagaaggtccttgcttccccttagtcttcttccatgattgtaagtttcctgaggcctcccagtcatgcttcctgtgaagccttcagaactatgagtcaattaaaactcttttcttcataaatttcccagtctcaagtggttctttatagcagtgtgcaaatggactattaaaactttatatggaatgaacctaacaaacatatatagaactttccattcaagaacagtagaatgtgctttcttctcaactgtccatgtaacattctccaagacagggcatagtttaggccatgaaacaaatcttaacaaattcaaaaaggttgaaattatgtatagtattgtttctgaccacaacagtatgaaactggaaatcaataacaagagaaatcttggaaaattaacaagtatgtagaaattaaacaacatgctcctgaacaactagtaggtcaaataaaaaatcaaaaggagtgttaaaaaatatattgaaacaaatgacagtagaaacataatatatcaaaacctacagaatgcagcaaaagcagttctataagggaactttatagcaacaaatgcctctacttaaaaagaacaaagatcccaaatagcctgacattatgcctcaaggagctagaaaaggaagaacaaactgaaccctaaagttagcagaagtaaataataaagatcagaacagaaatacatcaaacagagaatagaaaaaccataggaaaaaaacccaatagtcacttctttaaaaaaataaacaaaatagacaaaccttttactaggctaagggcaaaaagagaggcgactcaaaatcagaaagaaaaagaaggcattaaactgaaaactctaaagcattactgaaagagattgaagacacaataagtagaaagatatctatgttcatagattggaagaattaatattgttaaaaattttcttcctggccaggttcggtggcttatgcctgtaatctcagtactttgggaggccgagctgggtggatcacaaggtcaggagttcgagaccagcctggccaacatggtgaaaccccatctctactaaaaatacaaaaaattagctgggcatggtggtgtgagcctgtaatcccagctactcaggaggctgaggcaggagaattgctttaacccaggaggcagaggttgcagtgagccaagatcacaccaatgcaccccagcctgggtggcagagcaagactccatctcaaagaaaaaagaaaaaaaaaatatttcttcctacccaaagctatctacagttttaatgtaaactctcttaaactttcattgtaatttctcataaaaaatagaaaagcaatcctatagattatgtgaaattacaaaaaggcctaatactcaaggcaataatgagcaaaataaaataaagctagaggcatcacaatatctgatttcaaattacactgcaaatcaatagtaatcaaaatagcatggtactgcccccctcccaagaaaaaaatagacatattgaccaatggaactgtatggagggtgcagaaatgaacccacactgtatggtcaattgtcaaaactatcaagaacacccaatggaaaaaaacagttcttcaatcaacggcgttgagaaaactggatatccacaagcagaagacgtaatttggtctttttctcacaacacatacaaaaatcaactcaaaatgcattaaagaattaaaagtaaggtcagaaattgtagaagtactagaagaaaacatagggcaaaaactatacaacattgagttgggcaatatttttttagatttgaacccaaaagtgcaggcaacaaaagcaaaaatagacaaatgggattacatcaaactaaaagtttctgcaaaggaaggaaaaaaaataatagtgcgaagggacaacctagagattgtgagaaaatatttgcaagccacacactcaataaggtgttaaatcaaaactatattaagaactcagacaactgaatagcaagaaaaaattatttaaatgagtaagggacctgaatagacatttctcaaaagaaaacatacaaatgactaacagatatatgaaaaataattcaccattgttaatcattggggaaatgcaaattaaaaccacagtgacatatcacctcacactagttagaatagctgtaacaaaaaagacataatgtattggagtaatgacaagctagaagaaatgtaatattattagtagtctacttcataaaaatattttcccagaaccaaagcgagcaactagtaccaaaccactacctaatactaggtcatatacagcatgtaatataatataattacaatatctgaataactaatgaatataaaataaaagaaacaaatgtcctttcggaggtggccagagaggatatgtcatatgaaaaaaaagcaatacccagtaagccctttagacttttaacaaaatgtatgaaggatttgggttctattaaggaagaacaaaaagcatatttttattatttttttcaaaaattggtttcatcaattttagtatacagctatatttaaagtgttcttataactcttgtcccacaaaattatcttgcaaatagacttcaaagccagttgtggaactgtgttttaatacaagcagtgtgctgtgaattcttatgaagcatatggagcaatagatgaaaaagggaacctacaaaaaatacaaattggtaagctgtgagttcacaatatgtaagttcaaaggcagaaaggagagtacatagggtcagacagaaaaatctaatgaaggggcaacatattttccacagagagaacacatgtaataacaatagtaattgttatctaaggttatcttactttacaataagtattaatagtaattattgtttctaaagccatacaaattgaatttaaaagaaaagaatttatggggacattaataagcgagagggaaaaattcttccccgacaacaaatttaaacattataaacaagttttatttaattttttctgttctttcctttaatagatagatggaagcctttactttgctaatgtataatgtgaatttgcatgagatatatttgatatgtagtattaatcaagattatttgtacaagtaatcctttacaaatcaaacagatgtacatttaccaaaaacagaagtgcatgtgggaatagccagtttgggaaatactgttgtaaagagttttagaaggagatatattataaaaagcaagaatgattttgtttctgacccttgtaattgattaaagcatacagaagcttgatttgaaagtaaagaaacatttgaaaggctgaatgagaggtttccagaatgtaagataatgcaatttcagcatgttaaatataagatacattgatttcagtatatatttttaaatataggataatgtgatttcagtatattcattattggacaatttgctgtgcaacctttaaagaaaagttatttatcaatgaataagcctccctcagaattaaaagaaatgctgactgcatttactttattagtcctatattatctagacgtaatgaaataagataaagagaaaaatgttggcatgtaaaattgagagtttgtacagggtagtaaaagggctatagaagaaataaatcaatatattgtatataatagacttaaactttaaaattaagtatttagaactacgtgcacatttcattctacaagtaaggttcctagaatgatagagaggaaagaaaggaagaaggaaaaaagggggaagggaaagaatgatagagggggaagggagagaagagcacaggagggaagtggaagttagggaaggaaggggaagggaacaaaagaatacagggccccagcacggtggctcaggcctgtaatcccagcactttgggaggccaaggcgggtggatcacgaggtcaagagattgagaccatcctggccaacgtgatgaaaccccgtctccactaaaaatacaaaaattagctgggcgtagggtgcctgtaatcccagctgctcgggaggctgaggtaggagaatcacttgaaactgggaggcggaggttgcagtgagccaagatggcaccactgcactccagcgcctgggcgacaagagcaaaactcggtctaaaaaaaaaaaaaaaaaaacggaataagaaataaaaagagagtacaggaaaggcaaaaaaagaaaaagaaaaaggaaagggaacacagaggaatgaaaaagtagggagggaaaaaaggagaaaaggagggtagagggagaaagggagggagggaggacagaaggaaggaaggaagcaaggaaagaaataaagaagaaagataagaataactcaatttaataaacccagcaagttagctctgaaatatttggtgagatttgtgtttactgtttataataatcacagtttaatctcttaaggagttttaatctatgtcttgggagagattctcatgaaatcacaatattacataaaaatatttgattaaagtttaacataaaagggacatttagagacaataactctattgttgaggaagttctggatagatacatttgtagtttttatgtgcccatccatacgctgtcattgtatgtcacttgaaactgcctctatacctcctttgagggctcatttggagcatcaggtcttatacatctgacatatgaagaggtttcactatgtaataactgtatgtactatgactgcctgcttccctccctcccttccttctttccttccttccttccttccttccttccttccttccttccttccttccttccttccttccttccttccactctctgcaagctaggacttttttttacttggtaaaagggatcttttggcaacttgtaaaaagataatttacaaacatgagttccttactgtgaatatggagaatttgtttaaattatcaaagaaagtcccactgagagcagcgatatagaaagtaccaaagattagagattgaaatgaagattcaaggcctaatttggctttaaaagtgtttggtttatcctgaattttttaaaataatttatttgtcaatgttttaaatgtgtgaattttagacaaaatatttcatatgatctgacaaaaaagtgaaaatatatggtcaccctgtgaccatatagtctcacaaggttttagtaaaactgcaactgaaggccgtctattttgagtgttgcagttttccagatatttttgtctaccttcctccactcatttatggttgtctgtcctcctaacagtttgaaaattgactctaagttacaatgatgcatgttctaatagacacatttataatttccttagtgttttctaattaaagttagaggccccttgaaaacatatacatatttcttgaaggtgaccttacagtgtgactcctgagcttctctcagttgacattcagcaacatcagttctttgtttgccaacatacagattcatgtgggagtttgaacttgggaggaactgtctctatctacataattaatgagtgttcacttcattagagttaagtgcatggctgttcatgtcacagggagaatggaagattctttcgttctttggtctcaatgtgtccttgagatttttcatctagctgaaatttcagtccacatttgacttcagctggcatatttgtagaaatacttccaaaggagcatcaaattatgtatcaaataagtaataattcatttttaattacttgtccttttaaaaaatacttaaactagatcaatgatggaaggacaagtaaaacatgtcattgatttattggcattgattatattccttatattatttcatcttgtttaaaaccttaataagcccattaactttgtacatttgattcaaatcaaatatcatttaaacattcctatgttcataaaagcaagtgtgctgaggtttgctagcaatgggaaatttgtatattcacattcaatgctggaaataggaagttcagctggcgaaaagtcaagcggtgtctcacttgctgaaaagtaggttgcttttgtttatttgtgtcttattttgttcttgagaatgtaatggagaatatagtgtttgaagatactggaatagacatcccagtgcagttggtgcatatagtgagttggcaataatattatattctttcaatagttctcaaaatgagaaatgagctctcacaaaataaatacttaagtggattaagaattttctatatttgaaagtctactttccaagtaatcacccttcacaaatcttgcttataattatatttatataaaagaaattacagtctgggcaccttggctcatgcctgtaatcccagcactttacagggcaggtggattgcttgagctcaggaggtcaaggccagctgggcaacatggtgaaaccccctctgtactaaaaatacagatgaggtggcgggcacctgtcatcccagctactcaggatgctgaggcaggagaatcacttgagcctgggaggcagaggttgcagtgagccaagatcccaccactgcactccagcctgggtgaaagagcgagactctgtctacaaagacaaacaacaacaacaacaacacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatagtcaagcaaaatgaccttagtttatggtgttttattacatatcacagagactcaagcaccatgttattgctcttacgttatgttaaaatgcttttagtcagttattatgctcctcagaataggcaaacatttgctgagagcctatgatttgaaaaatgattgagaattcagatggatggatgtttcattagtgttctttagtgtttatgctaatggatgtagatattcatctgcattagatattacataagtgatatttttgttaatttgttgaccagaaacatataaaaataatgaagcacatgcatctttctatatctgttagatggatggatggatggataaatggatggatggactgattggacagacagacagataatagatagcctccatacaaaaaagcttgtaatgtatttaggaaaatagaacatatctcaacaggtaaataataataccagggaacctaggctgaatgcccagtgagtgatcaagacagaaagtagtataagttgggctaacatattgaaatctgaagtggttaaggggcagaatttacactgcaccttcatgttagattagtattttaagaagagcacaggggagaaactgagaagcagaaattcccctaatatacttaagaattcttgcataatgaaaataaaatatttgagttctaattataggaatgggcaatgcccctatttaggaaggctgtaaaaaatgtagagaagccataaacttctacagcttttaagtagagaaaagatgatgttaaacaacttttcagttgagtttggtagatcttcatttgtccaactttttaaacaggttacttacattctatggttctcgtctttctacttttacattgcctactctcactaaaagagatgtatagatgtggacacatttaaatcaaaacaaaattacaggcaatgttgaatacaagctgaaatgtttaatatttttctggaagcaggaaaacactatgggtgaatttgtacacaaaaaatggaatgtgcagtatagtgtcttaggaaaaagatcacactttagaagcaggctatttctgggtgggggaaaggaataaaaccaatcccttggaacagatatagaaaaatgcatgtgcttcaatatttttatatgtttctggtcaatgaattagcagatattacttatcatgtaatatctaatgcagatgagtatgtacctccattagcataaacaatacgttttatttatattgttgcctccactggaaaaaaacaaaataaaaccttgtctcctataaaataaattgataaaggaacaacgccccaaatgtttacaatacgtggctgtatgccccttgatttataaagtaaatcaccataatgatttttaaattatctaagtccatacaacctgtgacttctgttatgcacatcacataacagatactagtgactgcccattatctgctaagtaaaagataccattgaatacagcttattagtaattattcccttaaattactgcatttaatctttggaaacaccaatttttcacaacttttctggtctaaaaatagagatagctgttttatcagtgctctggtttcagtgtagaataaattgtagatatgaatgaaacatctttgcactctatccgttttcctttgtggattctttcttactgttttacaatgctgtaagctgagtccaccttttaggagacatattctttcttaaaacaaaattcatttaattcctcaatatctagcaaggctatccattttaatgatcttgttaaacgtctatgtgttttttccagttgtttttctcttctgaaaaaacattggcacactttgaagcattttgaaaaatctctgccctcctctcatcttgctaacctttaattatgaaatttcaggttccttgaaatacttaacataacctctcttttcttaggttctccatatcgagacaaaattaccatagcaattcttcagctgcaagaggaaggcaaactgcatatgatgaaggagaaatggtggaggggcaatggttgcccagaagaggaaagcaaagaggccagtgccctgggggttcagaatattggtggcatcttcattgttctggcagccggcttggtgctttcagtttttgtggcagtgggagaatttttatacaaatccaaaaaaaacgctcaattggaaaaggtaaatgttacttgtttcagtttaaatttaaaacaatttttgttgttacaataaaacacaaaccaaaagagtttttatgttaccaactaatgataatgcatagaactattgctctaaattgtcttatgtcattcattacataacaaaatattatattttgtgaaatttcacagaaagactcatggtcacctttatgattttttatttaattttaatatgtttaattgtagccagcttcaggaaaaatagctatttctactcttattacagacttaaaaaataaacttttgttgtttgaatttcatcgtggtatatgatgagatacagttaattaagtgagtaaaaattagaaactaatatgaaagaaaaaatactctgcagattaaaaatgaggttttatatacaatatgggttaacagtttcaagttagagagtaagtttttatctgaatagctttagtccaataaatttctagtttaagaaagatattagctttcactggagaaattacagttaattttctacattaatgagtgtgtgaaaatagtatagtttctttttgccatttaatagtattcttaatcagttctttgtttttttgtaccagagtccttctaaaaatatgtataaacttcaaaaatattgaggctattgctatattttgcatttgaatgcagtcatttgtataaatgctttttgtattatccttgaaaagtttgtcacctcattcagattctatatttctagtgctataatttcctcatttttataaatatgatgaagactaggaaaataactctttcagatgctacatgatactttttgtatgcaaattcattgctctggatatgacaaaaccaacagtttaaagtcttctagtacattatttaatcttttgtatgtaaacatctcttttgtttttgaagaaactcacaatattttagacttaactttaaccactgtggcagagtgagatgatataatctttaatatttaagaggtttatgaactttagttggtaaatacaaagagcgaaaaagaggtattttgaaaataatgccatacaggaataccaggtaaatattttttctaatattctttgaagtgtttgtacctttagaaatatttttgaaaataaaaatcctcctttatctctaataacttatgtcataattatttatccttcctggaatcagaattttggatacagtatttgtacatttttgcttgattacagtacttgacactgaggaatgttatcataaatgtatatttttataaccccattttgtctatgactgaaataacaaattaaagtttttgaagaattcagaaaataacatgatttgttttcacaacacattcaggttgttatttatgcttgcttggctaactcaaatattggttgcatttgtgtgtctaagtacactttttatgttataatcatttttaaagtgtcaaaatgaactttgaaactaaatctaaagagctaaccaaagaagaaatattaactcattaattatcatttcaggtttaatttgtcagtaagtgtggtatttaaggcattaatgtgtaatataagaatgaaaatcatagaataaatatgggttttctacttggaacctcaaataatccatatgtaataattttctttaagttatagctcagtattaaagtaaaacgaattagtctcttgatgatatgtggtattctattgtgcttacctctatgtgtcccattcatttgatttagctaggccgtatctttagtgcagttttgttttacaagtatctggttaaaacaaaaacaaatgatgcgaggatttaattttgtaacgtatcgtgcttcattgttattacgaacacgtttagttgaatttttcagatattacccagatctcttgacattctatggatctatatgatcctctaaaaattagaaaaataaaattaatgtaccttttcaaacggaaacaatgaagcattaacattgcactagaaagaaataactgagtggatattacatgagcattatagtcacttcacaatgctttgcacactgtttctacatagctgccacaaagaaatccaaattccttaggttagcagatgagaccctttcacacctgtccctgtccactgctgtagctttatcttttgctcctctccgatttgcacctttactacagccacactacattttaactctcaatttcccaagtttatactctcccttttgactggagtaaatcttgtctattattttaccttgcaaactctcacaaacattttatattaggcacttaaaatgagacattaacttgcccagaaagctttccctaatcaaaaggtataatgggtttgggcacagagcatagcttgtttctaagaagtggaagtagattttcatttcctattgcaatgaaaaaaaatgtgactcatatatctcatctttatacttagtttatttcaggtactgtcataatctaaaaacatgtatctccttttgagaaagctgggaaggtattttgctcatttcaaaccattttcagcattaagtctagatatcttcacgctgcgaacccctaagcacatctccattatcccattaacagtattgtattcttgtttgttggcttctgtgtatgggtgccttttcacatattaaattcttcttgctgttaggacaaatacctagtattttttgtttgtatctccaaggcctcaattagtgcctggtggcataatatctatctacctatctatctatttgtctatctatttacctacctacctatctacctatcatttaaattaagaatgaagttgattgcagtaactttttaagaaaagtatcataaagaaacaaattatttttctatacaattcaaaatagtaaattaaataattatggatttaatggaaatgattcattttatttattctgataaattaggttcttgggctcagttcttcatttttcttaagaaaatttaggttggtctatatgatctatatggctgtttaacacattacttaatttattaaaattagccatacgatagtcctagattttatcatacatttgagaacatacagaaattcagtttacttttacttatcataattgtgtctttaacctagatgtcttatatttcaaaaataaggtaaacacttgtgagatccattatttactcaataaatatttattgataaataagtctacaatgaattgtgttttgcccattgaaggaaagcacgaatgtattggtgactaaatagtttgtcagatatgtcagatataatatatatgaagtttagctgaatgtgaactttgtgaataaaatttataaataatgaatatctttccatattaagtcttacttttaatgatgataaaattataatatattaatttatgggtgaaaataaaatgccttttataatacatattgtaaatactagtgaaaacaaatagctcttgataatgataggctttctcataagttgttggataaagattaatatgcaaagtttcacatttttaaatgagggcaggttaaaaataaaaacagaaaataaagctgaaatatgtggaccttcaagcatttaaaaatggaaattgcattcctttcagataaccacaagatggtgtatcataatttttataaaaaatggctttaattgtgatgtaaatattaatgcctcaaggacacattgctttttatttattcaaacttttaaaatactcagaaccttttctcatctgaatgtgtctgaaaaggtaactaatcaacacatgcattttataattatttttctttttgccttatctcttctgtgattttaaagatatttctactgaagtttcactgagaaagcaatccaagaaactgttgtgtatctgagacaattatcacactttgggtgtatggatttggttgaaagatcttgtgtccctcttctaagacttacttttggctataacaagctgcttaatatactgaattttgttgttttctctgataatatttataatatgttggctttgtaagcaagaattataagatataataattttaatttttataaactttttataacatggattgtttaaaattctgcatttcttaaatatttgcatatgtctacttttaacagacatacataatttttctttttttaggttttcagcaagaacagcaacataacttctatagtttgatctctttttgtgtgttttgtatatagaaagaatatttttcccatgtatttgaaaatgtatttgcttatacaaattgtttttattgaactgtctggatataaattattgagtttcctgacataaaaaaaatcttaagatgaagccaaaagcactccatttcttattaagtgtaaattaagtaaatatgtctaagaaataaaatatatatatatataaattattgctcagatactgaatttgtgcaataggtgtcccatcttgaacacacatttttgttgtctttaaaatggttaaaatgtatttttaaatctatgtggtattgttgtttttttaggacatagtctactttggtcaatgtagctgtttctattatagaacactggcaaattttacctaagacaatctctaaataattatatttttttctggtgcactgatagttcaaaaacattttgtgagggaacatagaatgttcttcagtgtttagaggaataaccaatttggaatacagctataaatcagagtagtagaagcacaaatgaacaaaacatttcaatttgggggatgataagaagaaaatcagagggtttagtttaaacacgcaagactagggatcctattttaaaggtcatttataaggaaaacacgtagcaaagccaactaattctgtatttcatggaaacagaagaatgaaaacagtttgtttacagatagctacgtataagctgctgttaaaattttaaataattagttctaacaggagcaatgctttttagaagaatatacttttggggtaaggtataggaatgcaaacagtgttataaattatcagtaaaaatgttatgtcaatatttatgttttgcccagtaatgcctttttagaaactataagatatctatactttttattaattacatttgatgtaagaaattttagctgaacttaattttacagaagttaaaatttctaagtaaattttcagtgtaaaaattatagctgtaaagcataattatataataatatcatattactttttcttaaaatgcgtttcacagctatattgactaaagttgtgttgattcttgtcagaccttatgtattaattttttaacttgttcttcacaagttaaaaagtataaataaactttggacaaatgtcaattttttaattgtttttatatcactgcctttctttgagagctgagtgtctttcaatttccatgaatgatctatataatgactaattggatgaatttttaaaatgtcttgatatacaaatataaaatactgtactttgaaatgaggtgtcaatcttcattttgcttactgatctacttccaaatcagctaaaggatttttaggtcatttgtttatgataacccatactctttgtatccccacaaataattatttttaattaaaataatagcttaatagataattttaccaccttatttttataaatgactttagtttttaaagtgtaataccacatttgaatacaaaactaccctaagagccatgtaaatattatcatctatatagtacagatgaggataataagtatctcaagggtgaagttgttttccaagttcaaagatgcctagtctaacagtgtttcaaccatatcaagctgtacagaatggaggcagaatatttaactattcttcctccttgaatttttcactaaggaaatatatggattaggagtttgaattagataaacagattatgggctttggtcataagcagcctaataatttcaccttcctagatagtaagcatgagttatggaattaaaaagacttggaaacataactttgtttaaccttagataaaattacttagcctctctattcttctttttaaataaataaataaatgaaacaatgaataaacaagttatgaatccataaaaacggtgttttaagaattaattaagatagttaatatacatagagggcttctttgcacataactggcttataacaagcagctcttttaaaaataatatcattattattatttgtaaagctgatacattttaactgccacaccttatgaaaagaaagttttctagcttaagcattagttatttggatgtaactcttaaaaaaaatcgtatcattatgactactagcaaaaatgtgatgattagtattattttttctaaaaatgcatttcgcagctatattgattaaagttgtgttgtcagaccttattttttttttttaactagcttaagtaggggaaatttaaaagtgtataatgatcctcaatttttctccatcccattgtgtttgcaaaatacaatatgaggatattgggtaactgtttctgttagagtaaaggtttctgagaatattttaatatttgataatgtttatcattgtgaaataatccaggctaaagcataacatgatttataatttaattcactaagaaagatatgtatttcttttgccctcataatttttttctgtctgctgtataatttagtattcaaaaaatttacatttagcaagaatagagtccaggtaaaaagctcagctgagaatgaaatcatcattaatgaggcaggctaatatgataaagctttcatagatggaagttaagataatagagttcctgtcttagctctgagactagttagatatataacttgacttcttaagttttaattttttctagctataaaactacagtgattgatcagtaggatcacgaaagatgctacatgtaaagtttcttttgactgctgaatagcttatgtaaataataaaacttttttttaaagatagctgctctaaaaccaaatatcaagaacaaggttgtatatatttttttaacatgagtgatttagccagtcattttccatctttcattgcttcactgttatattcatatagccttaggtcaattcatacttctgatgtatagcattaactgtttgatgtttttaaaaggctgccaatcaaaacagttatattcacaagaaaaaatttaacgggtcacattaaatgacatttatttttgttatttaacacaccaatattatgtaaaatattatatcttatatcctatgaatattttttccattttagttattattattatctaatgtggtagaataattttctgcaactaatcacagtgactgttttgatttgtttccactacatgtgacttactattcttgggcaaatggcctatagagtcagaaattaattggagagtgtctaagaatatatagtatatccataattagttaacaaataatttaaatgacaaacacaaaataaaagtttggttgatatgtactagaatatattagaccactgaggtacaatagtatcttatagataccattgataggagtagctcaaattttggtaggctccaagtaggataagtagaaattgtatgtagaaatggttaggaattattctgaatgaatactaaaatatcatttagttattttatactatcaaaattaggccagcgagatacacaaaataggatttcctccttaaaaataaatactaaatgcaggcttgaaagtaacatattttatgatatttcttgaccaatgaatacatatattcaaaaagagagtgatgagcataaaagttaaatcatgctggttatttttcttcagatactgtttttcaaaaataagtatattgctaaacataatggttttaactttaaaatgaagctacatatgtcaattatcaatgtggagcatgatttcaactacacttctaatataaaaagaaatctgtgcttctccaaatgctgtcacatcatgttattataaaaatatatcttttaattaggaagttaagcttttaagaataaatattctgtaacatcaacaatgatattcttgaaaacatttacctgtggactatttatgtattttcttattacatccaaaatacaaaatagagctctttaaaaaaaaaaaaaagctctataaaaaagcaatgtaaatatggccaagttcatactatcaagatttccagatctacattgtttcaagaattagagatgtgtaaatataaattgactaattaaatataatgaattttattaagagttttactaatttaaatgcaattatacatgctaacagctcaaagatttaaattttcattttcaggaatcttctatttggttagtgccaccataccatccagacactgtttagtaatcttttgaaacttactaaaagaggtttttaataatggttagtatccttgtgcctttcttttttctttttgtagtctgttatattaatgtggagaaacatttttattgttgttttcatcctaaggaactgaccttatttaatgacacagtgcgtgggtttccacccctaaatagtgattttaaaagcaagatagttgtctttctctttcttcttccctccagctttccctttcttcttctcctccttctcctccctctccttctccttctcttctccttctcctccttctcctctccttctcctcctccttcctttcctttcctttctttcctttcctctttccttccttccttctttctttctttctttctttcctttctctctctctctctccctccctcctttctttctttctctctttctctgtccatctttctttctctctttccctctctctctttctttctccatttcttttcttctttcttctttttttagtataaccaggaaaattactgcctagtgcacttgggttttgagacttatttcatagtccaataaaaagatttaaaataaatttcaatcattatataaagtataaaagacaatttgtctctatttaatgataatacgttagaattttacttaaaagttagacacagtaaattttgggcaatgtacagcacagggaaacaattatatttcacaaaactctgtatagtttcagctttagagacttatataaatcaagatatggaatttgccttgtaaacctttaaacaaaaagaaaagaatgtatatttgctctagtaccataaatgaacagttctttgtgatatccttgaatttgtttaatttgccatgttaattgtaaaatcttgctcaaatctaaagattatcaagttttaaaatgggttagaattattctacaaatgagaaaagaacctatcgtctcacagtaactttatcaataacctaaataaacctatttttcatgtaaacttacattgataaataacaaaagagctggcaaaattcatcttattcaaagagaaaattaataaaatttgtattttgtcattatgtaatcgagaccattgattgacttatgaaagattgcttgattaaatttttactttctaatggctttgtaagctaaataaagtctatgacgacaatggtgatttacatgtttacaattttgagatagttgtaaaatttgtaaatataatttatttaagacaatttcaaattataaaagataatactattctggtaattgattagaatgggcttttttcaatttacattatctattactcaacaatataaacttaatattatatgaaattgcttaaaatggttttaaatgttcttatttgtagtctgaagtaagtatggggtactaaacacagagtttacctcttaaattgctagaaataatattgagtcatttcatagttgagcttgtatgcacatgtgtaagattttttcctaagaaagttagttacttagcctactcccttactataggcaaattattaattaacatttatactctattctgttttgaaagtaatgtaaccaaaatatctgaaaattgagattgccaagaagaaggtgtcataaatttttgaagatttgggaaatttattggttttaaatgaaggtttatttcaaacgattcaatgttacacgtcctataacaattttaaatgtcaacgggatcaagttttgaccatgttatgtcatctaattaattcttctgttaaatgtttcaacagagagccaagactaagttacctcaagactatgtattcctccctattttggagtcagtttccatttctacagtgttgtcatcatcaccatcttcatcatcattatcatcatgttcttaataagtacatctaatagtaggtattaagcaacaagaaacactgtttccatatactggctgtcaggtgccacataaatcctttaatagaaatataattcatgaattgcagaactgcataatttaacacataatacataatgcatggcaatgactctgtagttaatggggaattcacaagtcacatttaatcatcacccattacaagtgctaatatattaatatttttattaatttaatgttattaaacaaatgctaaagttttgcctaattttattaggcaaaattaattgtatgcaatatattttcactaggtttctaaacctgaaaattttttaagcaattgaattagaaacattgttaaataagaattaaaatattagagtcctgtgtatctattgttaattcaatcaacatttaaagagcttatgtgtgtacaagcagtgccgtgagaacttgacctctgctctacacaattcagggagagagatacatagagcactggcaggccagacagaaaaacaggataatgagtggaaaatactgacagaataaaacaaaatcaagttgtgaaaacaaaagaatgtgcctggtcaagtggaaagggcttcctaattaagttaaaacttgagccatgtcctgaggtaggggataaagttgggatgatgtgaaagatgaaagaactcagcagggtaccagaacaaggagaaacaaaggaaaaatattaatggaagtcccaccaataaagggagtgtgaggagaaagagagagagatggaagcagtggggaagggagaagagggctagatcagagaagtcatgatggaaaaaaataatagatttgagtttgacttgtttcctaaaggagaaaatgctattaataattgatattttaaaaatagattatccgggtaattgtgaacctttacagaagagtggcgtagacgtagaattaggaagaccattaaggaaactctttaaggagtccatcaaaggaaaattaggatatagccagagattgacaggaaggtaatagagcagtgtcaaaatcataaaactagatatatcaggatatgttgctggaatcttaggtgtgaactgtagaaagttatccaacctctctctgaatcagttttctctgacacacagttacctaattaattcaaagtatgtttagactggcacaaactattatgaaaacaattttttaaatgtatttttaagttaacatataaaattgtatgtatatatcatatataacgtgttttgatgtatatatacattgtggaatggttagatatgtctaattagcaaatgcattacctcacatatttattatttttgcaatgagaacacttattcactcttttagcacttttcaataatatattattattaactatagtggccatgctgtggaacagagctcttgaaatttttcttcctgcctaactgtaaatatgtatcggaaaatgacacacatatggtcttaaatattttcatcatgttgtcttagaaatagtctaagttcataatcaataaagcagctaacgcacaaataagtcttcacatgtatctcaatcagttggggagagacactaacaaaattttgtttcatatatatgactctacaatataaattttgaggagctgtaacaataagccccagataaacagaggttctagcaaatctatttccaatgagatgggaactaagacaaaagcaacatagggtcatattttttctcatttgataaattatcagctctcagttatcaagctaatgatgacaaaaaagttaatatttgtttgtagatgtctaacatgctataatttgtcatttcatgattaagtcatatttgtttgtaatcactgtcaatgtttctataggcataatcacaaaaaagacataatgaaatgccagaaattgttttccatattttatgtctgtgtgagtgctatctttgttttgagatgtacaatgaagaatcaatgttcaaacaacatttgcatatctcatcttgtgatctgaaaagtagtatgatttgtctatttttttgtatcaagaatgggtttctggtatagaattgtcattgtatttaaattttaaagtagatgtctatgtcatgctaatcatttttatataatgtcataggaaaattttatttaatatatgtgtaatatatacattactagctggttgttcatttcagtatcgggtggagattttctttaaactagcccacttttatagaatattttaattatcatgggttgagtgtttaaagtgtgacatttgttataacttttacaatgaaaattttcaaaccttcaaggatgttatgtgacaagtctgttgaggatgattttaatattgatcttggacagttacagtttatgtatcttgtaatatttaatttttctgtgttcttctgtagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttcagctttgtctttcatttttctcttgtatgtgtaatgaatgcaccatatacttctttacattaagagaagcacatatcctaaatatttctagatcatcaaggatggccacttcccaactacctgaagaaaagaagaaaaatgcttgggggaggacctactcagatctggaaaagctggactgggatataaaaagtaatcttaagttcagagcagttaaaataagacaaacagtagttctagaggtgacagacatgatattaccttttcaatgagaggatattgactttgtaagttaggttgtataagactgtacagtgatcactaacatttaaagttcaactcatatgctatttaataattccttgcacattgataatttaatgtaattcagcataaaacagagaaagagataggtctaatattccactt

SEQ ID NO: 12897 - DNA, 7195 bp, Human
ctttatcaccacgaactcacagtgcttccctgtgcctcagtttcccctcttcagactctatggctaatgacagagcttttcagatttggtggaaatgctctccggggcggggagcagacggggaaggctgccccagctaatctccgcagccagtaccctcgaaggctgagatctcggggagcacagcctccgattcgcgttttctaggcaccaaagtccctcgctggaggaagaggaggggaagaaggcagaggagaggggaggggcggacggatctggtcctgggctcccgcgcggagccccctcctcccacagccgccgctcgcgtccccgcagcgcatgaccgcggcactgcggctgcagggctctctcccccgcccgcgccggattcctggagcaagggggtggggggctcggaggtgcaggacccatcattccgacacgcgccgcgacgccaggagtcggggatgacgcccctgctccctcccctcgttcctgtttctcggagtttttcgacccctgagcgcgtcgctgagtcaccttcccggaacgcgctcgggacgctctggacccagcggggactgcccgggggccgcgcaaggcgaaggcgcacccgccgatacgcgcgcggagctgcggccccagggaccccgcgtcccagccagtgccccccgacccgcccggggactctcgggtcccgcccgtctgaccccccaagtgttgggaaacggggccgagctgcctgggtcctccggaagagaagacaccgcggaggcgtgccggagttcagggcgccgcccggctaattggctgcgtgctcctcctggacctgcctcttctcgactttaagaagcgatgagagaggtgtgtgggggcgggtggggccggcgggggcgcgcgagccccgcagcctcccgcaggggcttggtttctcctaactctggccctacctgggcaggtcaccaatgggccttggcaacttcttcctccgtctccgccgtaaccccccagggatctaactcgaggtgctcgcggacacgttctgtggcttgccgcgataagtgtatcacaaacacactgacaaacgcgtccctactggcctccaaagaagtgacaacttctgagcgcgtttccggcgccccttcttcacgctgagccagagggggcggggggcacgtaccacatgcttggctttccaatcccgacgggggcccccaggcccatctacactgtcaagcctcctctccggctcggagcccccggcctgtcgcctgctctacccgggacagcgcgctaggcggcctcaggctcggtagcccagctgcagcgtcgggaagttaaaaataacctccgtgggagcgcgggggaggaagaaagagggaagctggtgggcggcgggcgagacgccccggcctggagaggcgccccgggtggcgtgcgggcctcgaatttcgggtgggctagggcagagcgcgcaaaaggggcgctgcatcccggcgccgacagcacccgcgggggcgaggtcgtggcgtcgaggtgaaaccaagggtcccccgggagagcggagccgcgcgcgcccggcgctcgctccgacacgagttcgcgcggagcccgcgcctccgtctgcgctgcgcggtcgctttcgcgcgccccagacactgcgctcgcggccgggcccgggactccgcgcctcgcggcctgccgcctcagctcacccggccaggtcgcggcgccgccttctagccagacgcctaggacgagcggcgggggcgcgcttgccgcttcctaggacccgggcgggaaccagctcgtggcccggccgtgggcgcgggccgtgccggaggcggcgcgctgaggccggaggcgggcagaggccgaggccgcgccgggctcaggttccacccccgggagcgcggggcggagccaggccggcgccgaggctcagtgccctcccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtgaggagctagtccgtcggagggagccacggggctctgactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccaggtttgtggggttcctgctgggaagggctgtagggggattcctgttcctcgccaggaatgatggaacgcccagctggacgaaaggggctgtggacgatcgggagaaacattatccctcacgaggccagaagccggccgaatctgagccaaggaagggggtggcaggggcgccgcgtccccaccccaggtctcccagcaaaggccgctcctctggccagggtcaattaccggggtgtttcgggcaccaagttcccacactagtgccccattgttacccgtggccccctagtggtcggttgcggacgtggcctctttggttttgttttctcagcagggcggcccccgggcgtagctcccgcggcccttgcctatgagtgactgctgaacccgcgaaggcaagggcaaggcttcagctcttccggagtcacgtgcagccccttttggctgaggctgaaatctccttcacgctgatgctcactggtgagtacctctcggagggggatttcgggagcatcccctggcaggggatcccccccagtcctgatagctgccggtctccctgcagagcggcggaaccacgcgcgagactggatgcgatcggagaagctgggccgctaggacgctctggtggtcatgtctggagacgggctgatgcacgaggtgaagaccgcactgcgcggctcaggcctggggcttggcgcggtgcgtcccaggctgaggccacgtgtgcttcaacaggtggtgaacgggctcatggagcggcctgactgggagaccgccatccagaagcccctgtgtagcctcccagcaggctctggcaacgcgctggcagcttccttgaaccattatgctgggtgagagcccagggccagagtaggcctgtttcccgtcagtgctcctctaccgcgggggttttcttgtctaagctcccataggctgagatcatttccatttccccttctcccttagtcctggggccctctcctggtgaccccagctgactgcttccatttgctccatctgtcacctaccagtcctgccaactccccagggaccacatggcgctttgccagctcccactccccgggaggaggaagcgggggatacatgggggctcctgtcctgccttatctgactttttccccctgcagctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgctcgtcctgtcctggtgactggggagagaatgggttctcgttctggccgggactatagaatttaatggtaatgatggccaatggtgccccctgggatgggcaatggattttactggccccaggcatagtcattctggtgggggactcaggaccagagctggttcagcctaatggtgggggggcctctaccaccctgataattatagcacctccaacctgaagcagcctcagagctcagccagctgcctgaccacacacaggatgcagctcggagctggcatgtctcagccagggccacacaagcagctagtcccagcaaatctcatcagagccccatgtggatttagcaggaaaggggaaatatctgagttaagggcattagaaaactgatgggccaggcgtggtggctcacacctgtaatcccagcactttgggaggctgaggtgggtggatcacttgagcccagaagtttgagaccagcctgggcaacatggtaaaatctcatctctacaaaatgtgcaaacattagcagggtgtggtggcggacacctgtagtcccagctacttgggaggctgaggcaggagaatcgcttgagcccgggaggttgaggctgcagtgagccgagatcgcgccattgcaccccagcctggctgggtgagacagagtgagaatgtctcaaaaacaaaaacaataaaaccactggccaccgcccccgcccccccccaaaaaaattggcaaggagcaggagacctcagaagtaaaaaatggcaatatcttgctttttttttttttttttttttttggctcactgcaacctctacctcccgggttcaagtgattcttgtgctcagcctcctgagtagctgggattacaggtgcatgccaccatgcccagctaatttttgtagttttagtagagatggggtttcaccatgttggccaggctgatcccaaacccctgacctcaagtcatctgcccgcctctgcctcccaaagtgctgggattacagtcatgagccaccacacctggtatcttacctttttaaaaggagtctgtcatccaccacaatggtctagggttctagggttctcccagcctccctcagctgtctcctttccctacctgtccctgtggaggagtgccaggcaggagtggaaagaatgtggcagggaaggatccatccaagtctaaactgggcaaccattttggcttagcgtccaggagttgtggcacctgtccaccgccaggtgctatgacgtcggctctcccagaacctggaaggagctgaactggtcagttgtaggtctctggagactacagctgctgggaggctgctctaagctggctcctgaggggcacaccaccggccaggaggaggccagaggactgctccaggacaagaagtacaaaaggcatgcaagcaggtctggcaggcagagggcagtgtgggcgggtgggggtgctgttcacagtggcccccacctggccaggaaagccaggacccactgccacatgccttccctggcaacaaacaaggtctttccttccccaggaagggtgtgtgtgagggacacaaaggcaacggagcccagatgaatggcagagggaggtttaatggtgtcaccttgtcttgctaatgagccaacaaaaaaaaaaaaaaaaaaaaaatgcaagtaaaaaaaagtttaatcacacagcactttatacagatatcgtaagcagtaggcattcacatctccacatgtacaatgcactgggaagcacagccccaccagtcactccgggtgtttctcaaacaagataccgactcggttccaaatgccacggtgtgtggtccggctccatcctcccgcagctctgctggctgggcggtcacagcacagcacaggtgtggagcccacttaaggctgacaagacgcatcatgctttggctttttttttgtctttttttctaataagagttaatatctttgcttttgagttttttttccaacctta

SEQ ID NO: 12898 - DNA, 108169 bp, Human
ataaatataaatatatgataaatgaataaaaacatatctatgacaatatatggtgatgataagtgctttggagacaaagcaggaaaggggggaatgtgctagtgtatgcagaggttggggtgggttgttgactggtcccagttccctgaaaattcactgacaagaggcagatggctagaagaaaaggtgtacttatttatttaaggtgtacatgggggccttcagaaggaaggcccaaagatacaggggaaattgcctagttttatgcttaggttcaacaaaacatggagagccctgtcgaaataggattggaccaaaagggtgtgatctgatgctgatactgagtgaggaaacccagcgaggccggtggctctagattcttcttggcctctctgagcagcctttttttccttctgggtaagggacaggttcttctgtggaatgggaggtcttaggactgcaatcaacaaggtagaacaggtgatttctttatggccagtttttacacagacaagtgagggaaaatcacagtgatatttttgttttatgactggctttggggaaaagcgttctggtttcgatggctagcctgggggagaatgggaccgagagacaggagggcagaagatgacacagagactgcttctgaggccttcattttggcgtattgttttctgagctccaacattggcaaaaggggttccaagccgagatgacctaagagtacaggcctgaggagtgagtggtgtccccgccatactgaggttctgagtctgggcccaggacatggttgcaccgaaaggcagggcaggaaaggggagctgggttggagggggacagactgagtctggggtccagcgggcagttgaaactgctggtgaggacatgaggccagtttgaatccaagcagcctggcttcaaactccttgttccggaggaggaaccgcaagtcctcccaaggccttggagaaaagtgagctaaaggcagaacgtgggccgataacgtgggggcgtggggggaccgcgacccagcccggggaaggcgtcccagcatggacccagcagcctgggcagcctgggcgggaagttctgatcgcgctctgccgaattggcaggcgcaataagtaagcggaaaaaccaggattcaaaccaaccaccaacacccttccctggcgttcagaccgaaggtgggtgggaaggccctggcgaaggaggtctgcatcaggcctggccttgaggcgatcccttctcaccccaaacctcctggacgctgagcaagccccttcgcctgtgtgggttgcccggctgccctctggggaaagttgggtgatcaaatcccaagttgtagctctcgatgggtcgagggcgatggccagcgctgtgctgggaacgggcagccctgccctgccctgccctgccctgccctgccctgccctgccctgccccacatgggcgcaggaggcctccgcacgcgcaagggccaagggctggagggggctctcccgggcacaggcaccggacccggggcgcgcgcgcgcgtccttagtccccgggctgcactccgggccgctgagagatcgggtcccagaagttccgggagtggtcgggtgaccctggaactttcttcttctggagcccgacctggggctgactgcagagcaggctgctggcagggaccaaaaggagctccgcgccaggccggaggctgcgcccgtcactcgcggtcccggccgggtccctggcgcgtagtcaggccgcaccgcccgagccccaccgcgcgcccaccccggccgggtgcgtccggctcgcggccgtccctcccgcgacctgtggcccggggctgctgcgggcgcccggggaagagaggcgggggccgcggggggcaggaggagcggctgcggccggcacagcgccagggcgagtgaggcgggtggcgcgggggaggcggcggagtaaagagaggccgccggctgggtccgcgggtcactccgaggcgcgagctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgttcggctccccttgtgccgtgccgcggcggctggcgctacgcccaggcccactccaccatcgtcagcgaggtaagggcgccccggccctttggaagccggcgggagaggacgatgctggctcccaggcggacaagccgcgtgtgagacgctggccgccaggggaggtcggtggagacggggaccggtcggctacctctggggacagacaggattcagcgcacccttggaagtgccgcgtcgtaaatgctgggaaaagcctttcgttatctgcctgagcccgtgagttaatgcacagatactttggtttcgggtgtgaacaaaaactttcttcgaagccgagttgtaaacgcctggcgcacgcctgctcaggagtcaaagacccagcaccgcgttccttatctttgaggtgtgcgggcgccgtcattggaaattatggttaggtgcgcgatagggaacttcagtctctggggtgagcgacgttggcagttccggattcgcttgtggtctccagggtcaaaggaaagggcgaaccaacgtttgaaggcagcggcagcttttttccagttgcccaaatggttactcaaaatgcaaggggacaaaggtcgaggctttcccggggaatggttttggtaaaattgctttggggcaaagagcaacatctgggataagttgggaaaactgaagtattggataaattttagtttttttttctggtaataaattttaggaacatagcgggagggccacagccttccaacgcaaatccccaacccatttacaggcggaggctgctgccggcgggtgggcgggggcgatccccacattttgggcagtcagtgcatttggaagttaggggagcttccttcacccttgccctcagtaatctgtttctgcatccttgctgaaatggaagattgcctctctgtgaggtccagatatagagcagagtcactttgtaataatcggaactcagaaacggcctcaattgagcatgggttgcagagatgagcagttttactgagctttgtctacaatcacagcttaagttaattttaaaaaaagattgaatgtgatcaggtacattaggaaaaaaggtttgtcttttttttgtgataaactttaaaaaatcacctacttgaagagtggggaaaacactggatgaggaggtaggagcgccctttctgccgctgttgctgttggtctggtgagcttatctcgctgcagttgggagtgtcggtggttgcaattgtacatgttttatacgccatgtgctggtgtgttcgcacagtggatggctctatgctatgtgctccagggataaaacccatggcaggacagccaggcgatgtgtgtatgtgtttgggatctttctgtaacgccgtgtgctgctgtgttcgcacagtggatggctctatgctaagtgctccagggataaaaccccctggcaggacagccaggcaatgtgtatgtgtgttcagggtgtttctataatgccacatgcaagtgtgttcgcacactgagtggctctatgctgagtgatctcaggataaaaccccctggcaagacagccaggcaatacatatgtgtgttgggatctttaatttctacttaatccatggtaaggctggggactgctttataattggtgatggtatggttagagatttcacagttgaaaggacagggcatggacttggatgagagagggcattatctctgtgagtcgcatctgttaggtggcttcttccactccactcagcagcgctgcctaatgcttacttcccaagtgaaccagaggacccacatggagggcagacagctgatttttggagacatttaaagatgaagaataaaacgagcctcaacaagtgctcaagcgaggtttgcatgagtgagtatgatccatggacatcaaagaagacagacataaaaatctgtaatttaatgctctgacagatactttggaagcattctggagttgcagggttactagcatcctggggttacaataaggtgattttatgaagatcagtggctactaaaatgcagtgtggaatgatggagggtcaggggctggctcggtctccagctggctgtgtggcttgggtgagttactcgccttctctgggcttgtatttttcctctgtaaaattagccattggattcagcccgttacaatgctccaaatgccatcagggtcaccacctggttactgtttggtgtgcccagaacaatgattaaaaagtctttaagaaagtagaatgatattaggaatgtaccccgtaaagccccaaaaaagtttttgaaatatattggagagattcttttttgttttgttttgttttgttttctttgagacggagtctctctctgtcgcccaggctggtgtgcagtggcgtgatctcggcttactgcaagctccgcctcccaggttcctgccattctcctgcctcagcctcccgaatagctgggactacaggcgactgccaccatgcccggctaattttttgtatttttagtagaggcggggtttcactgtgttagccaggatggtctcgatctcctgacctcgtgatccgcccgccttggcttcccaaagtgctgggattacaggtgtgagccaccgcgcccagcctctttttaaattccaaatagttttgtgcttcttttggtttgtttttcatgtttggtttcttaagaggaaaacccccatctattcataaagttcaactatccaaaacaagtcagcaactctctgaattctgcatagctaatattttgctgtctttggttcaactaatttttttctttcaaattctgtctgatgaaaggaactgtagttccatcttcagctaacattatgtatccagtgtatttttataaacttgaagcctaagatacaaatcatgcaaaggggtgaattgggagagtttacaaagtgggcgggatgaccagactccagaatgcctccatatagctataatacttcatccttgcaccatggtgggaggggtatcattgtcctggcttcatagaagagagacctgaggaccttccagggtcccacgccatttatgtagccaaactgaattcaaatccgggggccttgattgtaagtcagtccactttcctccataaagtgctcaaaatccttcaagcaagtccatgaaacatagtactcagatctctcacactttataacctgcagaaacctcgttgaaactttgtatttattttcttactatcatggtcctccaatgggctactttgtttcattttacggtgtcaggatccacagtcagccagactggcagatggggaggctgtgctttcatttggtgggaatggttctctagcctcctgatgtgaaagttgcaaaatggtcatttaaatctcatacaccaccttcgcatcttacaacttgagatagttctaagacactaagtcagaaatcaatgccaagggcacatccctttatggccagctcctaatttgtgtctcctgctcaaggcaaggcagtggatttatcacccacattgaacttcctcagtggagacttttctaatgtccgaatctcggccttatcttgttgtcagatattgggcagaataaaatacaatgtaacgcagagaagcgagtctgaccccctgtcccaaatatttcaattcactgcccagggagtgtcttcaagattgatgctaggatttttcaatgcttgctaatatggtatggatgaaaaaaaaagagcttttccctaggctatcactcagagcagggcttcagaacacctttaaaaatagactgaatcacatttgtttttcctttccagatcattttgacttggaatcactttttcccttccagattacctggctgaatctataaaaactgaatccattgtttgtttttattagaagagtgtgtctttcccatactttctgaaacatcaacaattcaacaaaaattttatgttggcccttgtccctcagagtaactagtcctttctgctgatgacaaaagtgttttaatagtgtaataggtttttgttttgttttgttttttgacaaagtctcgctatgtcacccaggctggagagcagtggtgcaatctcagctcactgcaaccttgccccccgggttcaagcaattctcctccctcagcctcctgagtagctgggattacaggcacccgccaccgcgcctggctaatttttgtatttttagtagagacagggtttcagcatattggccaggctgacctcaggcgatctgcttgcctaggcctccgaaagtgctgggattacaggcatgagccactgcacccagcctaatagtttatttttaatggagtgaaagcaggactctaatgagtgaacagccaccccactaggtgtctgattcttggtctaggcagcagaatggccaaacagattcatgcagcaatgctttctggacctcagaacaaggaaaatatttacaataaggaccttcattatgagaatgtgcaagagtatctcctgctcctctctggcagctgatattttggattatcaacatcagttcagctgaagtttatttagcatttattttattctaggcactgggctaggctggggatacaaagatacacgagtctttctcaaaacagcgtgaagcttggcagggaaaattgcagcgataatgtgatgacagtggctgtgggtgtgataaagggtaccaccctctgatgggacagaggagtgaaccagggcagaaagtacattgaccttaacctcaacctctgagtacaaggaggagtccaagaggaaaatatgagggaaaagatgttctattctcacaccctctcatcttcattattttctctgcacccatttattttgtgccctcaggagcagtggttggtgtgcattctcgggtcgcacacacagggtttggaatcaaaagacgagggttggagttcaggaattttcctttttcacaaacatctagggcccttttcagatggtccatggaccacacagagagacaagctgggtgtttcttaatgaggagcatgatgagaatataatgactgggagagaattgccagttccaccaagcacaccctggagactctcggaggggaacattatccctttatcctcagacaggtatcccaaatcttatcagatgaaatgctgctgtttattttcagagagctttgagctctccagggatgggcaactgataataaaatcctggaattaactggggagcgggggaagcccacagctgaaccacactttctgggagtcttggtaaaccttagaaaggagctttgggcaaaggtaggggactccaacagatgttgcagagacatctgtacttttggacccacgggttatttttggcattggcatcttagtagagtggaaagaatacacatgtcctttggtgtcagataaatcttgtcctaaatcccagctcctctattaacttgaagggcaagtcaactgagcatctgcctgagcctcagtttcctcagcactagaatgggtacaagaatgcctgccttagcaattggcttgacatatgcttgcaaagtgcctggtcataggtggtgctcagaacagttggttcctgtgaacacataaagacccttaagccgggtgggagtcaggagggagggaaggaacaggctatgggccagatttgaccctagagctgtaagtttgctgatccctggtctagcataataaatcactgataaatttgccttaaatataaatagtcaaagccttggccagttgtggtggttcatgcctgtaatcccaggagtctgaggccagcctaggcagcattgtgagactccaactatacaaaaatattttaaaatttttaaaaaattggccgagtgtggtgatgcatgcctgtagtcctatctactcagaaggttgaacccaggaggtcgaactgtgctgctgtattccagcctgggtgacagaggaagaccctgtctctaaaaaataaaataaaatatctcggacactaatttgctctaaaggctgagaataccgatactttcccactggaccccacaggtaggtcatatttcccagcttcccttgaagctagagaggccacgtgtctgagtcctggtcagtgatgttggggaagtgaatgtggaactgctaagcctggagccggagcaaccttcctcctgcagtacccggaggatggtggaactcttacacggaaggatatgcgttcctggaggcatgcgaggcaggcaggagccccacagctcccctccacaccaattcatctgcacaggaatatgggattgcgaataagaaataagctttattgtgttacacaactgaggcttgggagactgcttgttgcagctcttcctgttaggctgctctgactcatacagcatcttagtgtgcttcctggcagggcacaggtcacgaggctgtgggcacctgacaaaatggtatggaggctggtgcctctaagagcatcctcccctgggtctggtacacaaggtctctgtgcctccaccccatgtctccgcctatagaggcttttccctctcttagcccccggggctcccactctccaggcagtcaccctgggacatgtgccacagctgtcctccccttgggctcttgtgtgcgctgtttcctttcctttcctcaaaatacctgtctttcctcggccgggcacggtggctcacacctgtaatcccagcactttgggaggccaaggtgggcagatcacgaggtcaggagatcgagaccatcctggctaacacggtgaaaccccgtctctactaaaaaaaaaaaaaatacaaaaacgattagccaggcatggtggcggctgcctgtagtcccagctaccggggaggttgaggcaggagaatggcgtgaacccgggaggcggagcttgcagtaagctgagatcgcaccactgcactccagcctgggcgacagttagagactctgtctcaaaacaacaacaacaacaacaacaacaaaaaacttgtcttttctcatgaggctgttccgttttgtacctttacacacaccaattccagacacaccttccccactgctgcctctacccagggctgggcttggcttcctttatctgtctagctgccttccctctactcatcttgtgctcactgcctcatcagactctgaggtgctggagggccggcgctctgccctcctagcctaacgcagtgtttggcaaatatttgtgattaaattaatgaatgaaagagaaagggattccttggcacgtgtaatgctttttatgaccatggctaggccaaccctggaattggctttcagagattaacccaggccctctaccgatggtgttgcttcctgttgactcctaacgccgattccttgcctcatcctccgccttcatcatcttctgccttgcatccatgaggtgtgatcagtcacagggtgaacaatcatcggcggccatggccgcccgcagacctctggagcaggaggaaaacaggcctccactttacttgactcctatctgctcatggggtctgtgtccgcagaatcctaatgtagggggtgtgacctggaacatgaaagggacaggaaggaatagaactgctggctctttggggccataattttaatgtgctgacgtccattgtgcagaagagacttttcccagctgtcctggcaccacacagtagtctgtgtcatcaatcgagcctgctccagggcagctgggcacaggtgcaaggcccggtgcagggaggagcactgaagggcctgggctgagcagctcccagggtgcagcgctgtccccttcatggctatggagtggggagcaaacaccacctaccttccaaaacaaactaaaacctttccaacattctgcctcggttttttccccaccccctcttaaatcataaccaagaaaggacatgtatttatattctgtgaggaaaaagcaaagttttaatggtctttggtgtggctttttaaaatgataaatgactgttgagcttgtcaaatcatggctaatactgttttatctgggtgagatcagtaacagctttttaagggttaccatgctgttatttctcttcgtgttggtaataaagcaaaataactctgtggctggtacttgtgtgataatagagaaaattagtgaggggtgaagtttaggggcttagaagaaggtgaataaataaatgtaatttaaacaattctggggcaggcatccatcccaccttccttaacatctgctctagattctagtgccctgtagagtccaaggaggggagctgtccttgactgtgagcatagtggaaaccactggatggaggaagggtaggcacaagcctggacctgagaaacaaaggcacctattctgctttcaaattcagtcctgggagagcaggtgacctctgtcataggactgctatagggcaccagcagtggagataaccaagtgataagcaagtctttggctttccattaacagagaccactggtcccaacatggaaaagcgtcccagaagcctttcccagttgctgcgtccacctagcatacacacaggatggctctgatttcatgacacttctgccaacgggaagctttgggcaatcgacagcacaaaatgaaagacaacatgtgtgcttccaggctagtggggagggacgccgtaagctgatgcttctgagacagaaaccgaagggacaaggtgccaggagctcctatactaaaaactgtttgtagcacatttatggggattaagtggttgtggtgaaaacagcctgcacgtttaatattgatgatgttttaaaaagcaatgcactgcaaatatctgttgagaaatgaatgccctttaattgttcacaaatgagtatcttaaagaaaatacccatagagaagtcacctggatagttaaaaacattaactacccagggtagaggagaaaattagattgaaactaattcagattaatttggcatcaactttaaagaaatcaaataaataaatgtccaagttattagagtgtaagaaagtgttccaggaaccttttccacagaggttcttgatcttcctgtgtggcagttagtgggaaattatgtgacaaatttatcacatctcttgtcagctcctagcatccttgtaagattgctacaattccctatccagtctgtatctaatagagcatacataatgatttttattttaattccaaccaagttgaatacattataaaaccaaataaaattgtctatttatcaactccagagatcattagataataacaatttattgttgcagagttttgtgaaaaaattatcaaattttagatccaaactggtttagtgtagtgtattgctaaggcaaataggtggctaagaacgtagacttcctagttttgtggatgcaagcaaatggctgaatttgagggtttttgagctctggactagcccagtcctgagatttcctggttttagtggggagacttaggtaaataaggcattcaaagtgcttgtcctgttgtctgagatatgtaagtagctggtgatgatcatagatgctgacaacagatactgagaaagttgactcagagaggcagcttgggcctggaaattcaggcaaatggcaagcccctagggctgagggaagcgtgctttaggcagggcaccaagattccaatactaaggacgtggccagggtccactctctggagctggtataaactggagcttagtaatgaaaactagggaaaggcccagggtagaggtcggagctaccagatttggcaagatttctcaagcccccgtggattcagttgtgatatagagtgaacaatccccccatccgggtggctctggggacaaatgagaaacatgcaggaaccgctgagcatgtggaaggtcctgggcacatgccagttccctccttcttgctctttgtcactaactgtggtgcccaagtcctccccttgcctggtctagtctggggttgctggatgtggactcactcagaaccccacacttctttccaattgcagtctgagcagagggacgctgggacagagccctggactttcctaaaaccgggaaatcccaggacaggactagaccagagctcagtgagggctgaagactcagctgtggggctgcagggcttgaactccatcgcatgttttctcatgagcctggaaatccttcaataaatatgaacaacaaaagtgccccaaaggtgctgtgttagaaaggcacccatctggctcatgcctgtattctagttgagtcaataaggcaaatttaccttatgttgtttgtgggcagttgcaatggtcctataggcaatgaaaacatcagatcacagtttgcttgtgttgctgtgagaatctgacctcaaagaaaatactcccccaacccaaatccaaatctatgaaatgaagacacagcagttgtggtggggcactaattatgaatgttgagcttcaggttagggttgaagtaaatttgggctaaagtgctttatatattgagcattccaattctcataacattgaatagacactaaaacttaatttacgaaagtagtttaatagccaatggggacaaaaatttattcttacagttatcaatactcacttcctgcttagaaacttgttttcttccttaattaccagaaaacagagtacatttaataatcaatcatactaaatttaaaattagggaaagagagcttatggtgttcagcaaaaagggaaatatcaaaaaagacatcttagcatctggattttttggccaaaaggagagcctgcagtttaattaatggtctacatcaaacaggatattttatgaagcaatagaaagctgtaattaaatctagccttctggatttgatacatcacaaaaccaggagataaaaacaacagaaaattggtgatagggttgaaactcaaccttgttcaagaagcattcacaatggaagctgttgacctatattctatatactttacatttcaacagatagtctatgtttgaacagtgatttttttatatgtgaagattttctgtaaagaactgtattaacatttgtaaacagagtccaagaaaaattaattatgactccttttttggatttcacattggtacagcatgacctttaactcattatcttattacaactattagaagaatagtaaaaacatatttcatatacttttcaaatatttataatcatagtattctttttataatagttttcaattcttatttgatagcatgctatacaattatttttccttactaaactttcatagacatttcacttaaatgatttttctttttttaaaccatataacctgtcaaagtataaaagacacatacaagcggccgggcacagtggctcatgcctgtaatcacagcacttcgggaggccaaggtgggtggatcacctgaggtcaggagttcgagaccagcctggataacatggtgaaaccccgtctctactaaatatacaaaaattagccagccgtgatggcaggctcctgtaatcccagctacctgggaggctgaggcaggaaaatcacttgaacccaggaggtggaggttgcagtgagccaaaatcacgccattgcacttcagcctgggcaacaagagcaagactctgtcttaaaaaaaggatatatacaaggtacaaattatttgaattagtctatattgatctcccttttcattctctcagtttctctttattaaacctctttctcttaagaacataaacaaacaacaactactagaaaagctttaaagtccagcattagtcaaattgaagtactgtcctgacccggaaagcattatccaagaaagtgcatttcaaggccacctttcctaaaccagtctcaggaaggtccacgctctatttccctttgcaaaagcatttaagttaatgctgatatatgatttgtatttattaactcccccccgccccaaccaatgtagtcttttttaccttaacctattattgacttggtgacaagatatagagtgatcatggagctgggatccatgttcctatgtgtcatcagttagaagaatgaagaggccaagggagtcattctaatatttatatggaagaataaaggcccagaagcaggtaaatcattctaaaagaaggggtagggagtaagaggagggcttcctctaccagaaattaaagtgaaattccaagccaaagtaatcagaacagcatggtattggaacaagaacagacaagtggaccagtgaaaagatcagagcacttggagactgactccacccaggggaacatcatatacaataaggatggcctcataactccatggggagaggatggattgttggctaactgatgttgagaaaagtaatgactcatcagatatggagaatgatcaatctgcctatcaccatgtacaaaggtggactcagggtgaattgaagacttaaatgtcaaagtaaaaggtaatattaacaaaggaacatacagagaaacatgacaaggtcagggaaagactttttaaagaaaagtataagccaaaaatggattatctagattatatcagatttctgcctcatgacagataccatcagcagagttaattaagtgatgacaatgatactgagtagagccatgctactctaatcaagggtcgttatgggagttatacaatgcatattgtacaatgcatattgaagccaaaggcttcaataatgttcactgtgtgctcaacactgttgtagacacttgacatgtgttcaactcacttaatccctacccacttcatgaggcatgtgccatttttgtaggttttttttagaggaggaaaggaaggtacagagagattagataatttgtccagaatctggagctgcaggataggagacttggaaaagaaattgcaatgtctgaaccaacaagtaattaactgacatctctagaacaggaaaagaagttctgtaaatcaacaagtaaaagatagcaagtcttgcagaggaatcagcaaaggatacagatagttttcatgagaagaaacttctccaaaaggcgactaagcacatgaagaaatgtgtgtgtctggggagctttccccttctaatactaggtcagtttctgtgtggtaacttgagaatacaatgaaacatcgtttaaagtaacctgtggcatgttactggtaccttgcaggctaaatacatcctaagtgtgctaatactgcagataccttgatccccttaggacagttgacccaagccttcccaggagctgtttacctgtgggtgtcacctggctgcaaaacagggatgaacaatgcacagatttcaggggtcacccagggatgctgcgacctcagaacacgtcacatggaagatgcctctcagtttccatctgaaaagcctggtattaatccaataattcaatcaccaaatttagtagttgcattccccagattttcttttgggcaatccacagtttgtagaatgcttttctgtgttcccaggttcagaatttcagggattgcttctgtcttcaaggagcacttcagcttcctggttaggaagagaaggtagcagacgtgtagaaaaccctctgcgagactctgctctggcagttttatgggtaggcgcaggcctgcctgaaaccaaacgctttcctttttccttcaccctttcccgttgttgtctttttggttcctttggtatggtagtgtctccatgtgagtttccagggaagcagaggctgaagcgagggcgtgggagctgtttcatgcattagactctctggggagcagccacagggaggggactgagggacaccgcgggatgtccagagaggccggtccccagcgggtgggggcgggccagacggtgcggagggggagaggaggaagactgtgtccagggcatgagccttctggcattgtgggttcccccacgctccagcgccggaggggacccaggcggcaccagcgcgttaggctgcccccgggagcagtgctgcaggagccccgagctcgaggtggtgccggcagccgcgcgctcagagctccaacagggctgggccgcggccaaggagccaggagggtgcacgagaacgtcccatccagggacccacggatacttcgttcctgccagggtctcctttgggccgacagagttgtctctaattgagtgcaggcagccccggagcccgccgagagctgaggctgggctgggctcccggggactcgggcagctatttcaggcagacgcggggcatcgcgccccaatgcgcacactgttgccgaggggcagaaagagagggtctcagcctaagccaggtggaaggtccgagaagaggctggaagggggcgatggtccagcaggagctgggatgaacaagggctggaagagcaggtgggagttccaggtgagggaagtgacctggaagcggagcagaggtcgcagctggcccctgctgggcctagtctcgcttctgtcgtgaccccttgtctaggaagatcccatcgcgaaggcctcatgagtcccacgtgaccggcacgcctgtgaggcaggaagctcagagtccaggccccgtgcccctctttgggggctagagcttctcccaggtgcaggcagcctgttcacaagagcggggccctcctgggtgaagcctcaggctccggttgtcacccctggcaggcgtgtgcccagcttagatccacctgcagctggctctgaacgctggatggggctgggttggggttttcctgtggcctggggtgagtcccagcaagccaccaccatccttgcccactccccacaggacagagcatagaccctgttcctaatcctcccaggccacactccgcagaatgctgcttctctgtttccaagcgcctgcatgtcttgcatcccctgccaccatcttttgtccgcctgaaggggcagccccataaaccttacttagacatgtccctgcccccagcacaggggctgccttcaagcccgcctttgtctgtggggtttttccttgatgactgttcagcatgccggccccactttcttctgcttgcatctggggttctcccaggctgaccagctgtccccacttgctgggagtgaaggggtttcctgggatacgaactttcagtattaaaaccaggagagtcccagacaaactgggacaattggtcaccctaactgacccacaagtagaaaaatgattcattaaatgtataataatgaaaagctgtgaattatttgcatgtataatagagggagaacatggttaaataaatgtggtgtagccatttgaaatagctactacagggatgaggaaacaatacctataaaataacacagaaatgttgatgacatattaaggaagaagaagtctgggttatacatttgtgcaaactgtatgatttcaaccatatttgtacactccatgtggtagatgggttgttggaaggtaaagactggctgcataggggccctaaaggtgagagcttttcattactgctgcttacgctttcttcttaactaattcagatattattttgccaaatgcagagccaggaggtgtgaagcagccttcatggtggcaccacatgtgacacagatgagtagatgggtgcagcgttgacaataactgcagtcatattgttcatcttgacgggatttctgagtaacaagtcaaagatgcagaaattaaagtatacaaattggattgggttttcagtaaaggaaaaggcaccaaatcgtttctcagtaaggcacagtaaagggaggctatcaaaacctattgttagtaaaagtacctattgatgatctcttaagcaaaattgttacctagttgtccacgtgaaggaaaggactctctgaaaagagggggctgtttagagaagaatcaagcctctggcaccagaggggactccccagttaggaaactgttgtaacaaaaggactccatcgctcagagcaggatcagatgataaatcaggctgaaatggtataagaaacctacaattaccttcctccatatgaataattgaaaaggcaatggcttcatttaggttgtaatctgacttacagcttttaatagctatgctctgttaaagtgtacacattatcttttaccttatcgagtttatattgctttatatcaatataatgatttttttactatgtaaaaaaatacacttacatagtaagtatatttacatagtaaaatcaataattttttttactgtgtagcaaaatacacttacttgattcatgaaccattaagtttttaaaatctgtgtgagataatgtattctctgggtttattttgactactgaaaatttctagtcacaagacattatagctagatacattccaggtgtttttaaatgttaaactgtcttcagcatcagaaatggcctcatgaggtaagtcattattttcccctattttcaaggatggaattgaggctgggagcagttttgtgactcacccaagttaagatatcatgaaaaattgtttccttgcaaggtctgccacaccctaaaccaatgtcctgtcccaatccacctgacttgagggctgttagattttagatgtcagaatcacatggagggcttgtggaaccagactgctgggcctcactggagtttctgatccaatgggtctggggtagggcctgaaaatttgcatttctaacacttgcagttcccagatgttgccgttgtcacaggtcttgggaccacactttgaggatcactggtctagaaggaggcttgtattagctagtgatttttttcattgtgatgatgatggctaaccttacacttgaacaaaaaatgtggctttctttaaagaaaatcatcagaagttcagttctttaaaattcagctactactcactgacatggtgtattaccctgttctcatgctgctaataaagacatacctgagactgggtaatttataaaggaaagaggtttaattgactcacagtacagaatgtttggggaggcctcaggaagcttacgatcacggtggaaggggaggtaaacacttccttcttcacatggaggcagcaaggagaagtgctgaacaaaagggggaaaagtctcttagacaaccacgagattccatgagagctccctcactatcatgagaacagcagcatggggtaaccacccctgtgacacaattacctcccaccaggttcccccatgacacatggggattatgagaactacaattcaagataggatttgggtgggaacacagccaaaccatatcattccactcctgtcccctcccaaatctcatgtcctcccatctcaaaacacaatcatgccttcccaacagtcccccaaattcttaacttattccagcattaactaaaaagtccaagtccaaagtctcatctcagacaaggcaagtcccttcaacctatgggcctgtaaaaccaaaagtaatttagttacttcctagatacaatggggatacaggcattgggtaaatacagccattccaaatgggaaaaattggccaaaataaaggtgctacaagccacatccaggttacactgatgcaagagatgggctcccacagccttggacagctctgcccttgtggctgtgcaggatacagccccgtcccagctgccttcatggctggcattgagtgtgtggcttttctaggcacacggtgcaagctgtcagtgaatctaccattctgggttctggaggacagtggccctcttatcacagctccaccaggaagtaccctagtagggactctgtctgagggctctgaccccacatttcccttccacactgccctagcagaggttcttcatgagggctgtgccccacaatacacatctgcttggacatccatgtgtttccatacatcctttgaaatctagatggaggttctcgaacctcaattcttgtcctctgccaacccccgggaccaacaccacatgaaagctgccaatgcttagggctgagacctcctcagcctggattccattgtccactatcagcattttggtcaaagtaattcaacaagtctctaggaacttccaaactttcccacatcttcctgtcttttgagccctccaagtctctaggaagttccaaacttttccacattttcctgtcttcttctgagccctccaagctgtttcaatctctgcttgttacctagttccaaagttgcttccacatttttgggtatccttgtagcagcaccccattctctggagtaccaatttactatattagtccattcttatgctgctaataaagatataaccaatactgggtaatatataaaggaaacaggtttaattgactcatggttctgcagggctagggaggcctcaggaaacttacaatcatggtagaaggggaagtaaacatgtccttcatcacatggtggcagcaagaagtgctgagcagaagggggaaaagctccttagaaaaccatcagatctcgtgataactcattcactattatgagaagagcagcatggaggtaactgcccccatgattcaattaccttccgccaagttcatggggattatgggaactagaattcaagatgagatttgggtggacacagcaaaaccatatcacgtggtttcttttactgaagcattttcccctccactgcaacttgcatacctgtattgcaactttcaagtgctataaaaatagcacatacccccatcaggcattgatagcacctccatgtgcagattttgaaggtaactgaaacttcctctgccctgacaggccatgctgctgctcagtgtcttccgctgctgtctccaagtggtgttcttgtcatcctggaagccctgccttgggccatgcctgaaatgcactaatatgctcatttgtgaggtagtacagagtggtcagggcatccaggcacatcatggatgatggggcactgttacgggtgctgggacactgccatgaacaagaggaccaggtccctcccctgtacctctgtagtcggtgccagcctcatgccattcagctaccttcacccataatgtccctgcaccctctctgttgagtctacctcctcttcctcctccatccagcctaggtctctggcccagttcttcagcccatatcttccagtggccccactgcccttcccactggcctgcctgggctgagagcactgctggagacaccactcccagtacatgctgctctgtcctctctagttcccggtgtcctgatattgcctgatagtcatgttgagtgtcctgacgtccactctggctctccagactctgttctctgccaacttccaacctgcccctccccactcataccctctccccctactcttagcaaaccactcactctccacttccctgagaaaatagaaaacttggaataatacgcttcttcgatgtcctgcaccaggacaatcaacttctctatctctgctcccatagcttccttctaaccccacagcagaagagttataatactgccccctgttgaaagcttattttccacctgtgctctggtccccacccctcctggcttctcaggtgatttccacctgcctaccacacccttgatgcctgtcttcagtctctccttcactggtgttctttgcttgtccacccttaaacctgcttaagttcacctgtccacgcttaaacctgcttaagttcacctcctatttaaagcagtgtcccttatccctgtgttcctctgcagctgagcacctgtaattccctgtcataggcacattcatcatctctacattctcaccttccactcactcctcaacctagtgtggtctccatcatccccgccacaccacagaatctgtgcttcccagggtctctgatgaccttgaggttgctgttcactcacctcctcacccctggtcttatgtatcacaccaaagtgtcagctgtgcaaaagccaggaataggattcctactctgtagggacccctgtggctggcgcaggtagctgccatagtcaccggttcatatttcaccgttctgctcatttcgtgctccctggtacatctcttatttcactgcttgcatattctgtccaagctctgataaagccaaacacatttaacagatggacacaactggccatgcttcaggcttctgattcacccatacttccaggagccatgaatctgaaatctggagctggtctgtagaaagcattctatttagtgaaatgttgaaggaattttaggtcaactatcatgtatttcattgtctccaatgccataatttccaagtgcctacttgaacagtagatactttcaggggattttcatatcaatgattgcattttgccattgttctttattttttcagtaatgctccatctgtaaacaacccaaatttcaaagcctgacatagtgtattgacaaattattcctggatgcctgtttttatcaggccaaaatccatagttattctaaaatggatatcatacaaataatgctgctgtagcatgctaacattttccagactattatgaaaatgtttagctcatttacaagtcatgggaaacaatatcggaatttgctactgtgtagaaccattactatagcacttccagtgatgcctgcttgtgatctttattgcccactttatagttctgtattttcatctccattttttaatccttaaatatacaaagtaaaatgtaaatatcttttttgtgggtcttttagaattattttttagcattagcacttgtaaatttactggaagtttcaacaatttgtatttcatgttagataaaagtaaggaagctttcaaagaaaagtctaacaaatataacacatgtacccacctccccaaatgaaaaaatgttagcattttgttgtattttatttagatttttttgcagagaaataagccattatacatcaagttgaaattctacttactattgttgtgcgacaaattatctcaaaacgtagtgatttaaaacaaccatttttttttactcacagattatgagagtcatgaatgccgaacaggcacaagaaggagtgtttctttctgctccacaaagtgcagcttcagataggaaggcttagaggttgggatgacccaatggccagggcaggagccgtcagggtgtcttaatttactgatttggcagagagtagtgctgtcagttgggccctcagttagctgcaacaactgcacatgatacctctgtgtagcttgggcttcctcctagcatggtggctgcagacgtcttacaaagtggttcagagccccacaggtgtgttctataatagctcacaaggcagaagctgcattgcctttcaggacctagcctcagaagtcacactgcctcatttctgctgtattctgtcagttccaggagagtcacaagcccttcctggattcaagggaaagggaattagatgccatttcctgatgaaggtggggcaaagttttgaaagagcatgtgtgggggactcatgccatctttggatagtcccagtctccctcctcaaggacatcaactcttgtagtttgtctccagtccaaacatgtgtgggcactttccctgcatatgtgggtatccacgtgaatgtctcttcattgcttctccatctttctaaaaagtaatcacagagagtcatgaaatccagtgttagaaccaggcattgttaatgctcttatgttattattattcaagctgggctaggggaatgtggcattaataaaacaatatgtacattggatttagttatactatactctctattctaatactttgtaatcattagtaataaatagtagcatattacttcatgtaggattttgcaaagcttaaactattttcacatttgttccttcagtccaggcttcctaaaaataaaatataataagagtcttgagacttaagttcatattttgcatgaatcagataaaataatagatagtaaaatgctttgtaaactgtgcagagctattaagttgccccttatcattaagtttttaagtctgattttctgatattgtaatcctgtcctaggcttcctctcatttctttgctgtaatctttgcttctacctcatttcttgtgtccaaatacaatcagttattcaaggcctggctcaaatgctgcctagaagcctttcctgacacagacctcccagcttacctcctctccctcctctgtgcttttatcgcattctgtgtttctctggtagattatcttttgtattctatttcacgtatcacatcactggggctcacctggaagcttctagcaaaccaaaccccagtctctgtagcccttagtgcacaacaacatgcctcccacccaggagcaggctgtgaaagtctttttattttttaattattatactttaagttctgggatatgtgtgcagaacatgcaggtctgttacataggtatacatgtgccatggtggtttgctgcacccatcaacctgtcacttacattaggtatttctcctaatgctatccctcccctagtaccctaccccctgacaggccctggtgtgtgatgttcccctccctatgtccatgtgttctcattgttcagctcccacttatgagtgagaacatgaggtgtttggttttctgttcccatgttagtttgctgagaatgatggcttccagcttcatccatgtccctgcaaaggacatgaactcatccttttttatggctgcatagtattccatggtgtatatgtgccacattttctttatccagtctatcattgatggacatttgggttggttcccaagtctttgccattgtgaatagtgccacaataaacatacatgtgcagcgtgtttctagtagagtgatttataatcctttgggtatgtacccagtagtgagattgctgggtcaagtggtatttctggttttagatccttgaggaatggctacactgtcttccacaatggtggaagacaatcccaccaacagtgtaaatgcgttcctatttctccacatcctctccagcatctgttgtttcctgcctttttaatgattgccattctaactggcttgatatggtatctcattgtggttttgatttgcatttctctaatgaccagtgatgacaagcttttttttcatgtgtttgttggccggataaatgtcttcttttgagaagtgtctgttcatatcctttgcccactttttgatggggttgtgtttttcttgtaaatttgtttaagtttgtttacaagtgggatgacagtgtaaagtctcccactattattgtgtgggagtctgaatctctttgtaggtctcgaagaacttgctttatgaatctgggtactcttgtattgtgtacatatatatttaggatagttagctctttttgttgcattgatcttttactattatgtaatgcccttctttgtcttttttgatctttgttggtttaaagtctgttatatgaaactctgggatgaaaattattgtcattcagaatgtcgaatactggcccccactctcttctggattgtagggtttctacagagagatccactgttggtctgatggacttccctttgtgggtaacctgacctttctctctggctgccctttacattttttccttcatttcaaccttggtgaatctgacgattatgtatcttggggttgctcttctcaaggagtttctttgtggtgttctgaatttcctgaatttgaatgttggcctgttgtcctgggttggggaagttctcctggataatatcctgaagagtgttttccaacttggatccattctacccatcactttcaggtacaccaatcaaacgtaggtttggccttttcatatagtctcatatttcttggaggctttgtttgttccttttcatgcttttttttgctgatcttgtcttcatgatttatttcattaagttgatattcaatctctgatatcttttcttctggttgattgattcggctattgatacttgtgtatgcttcacaaagttctcatgctgtgttttttagctccatcaggtcatttatgttcttctctaaactggttattctagttagcaattcatataaccttttttcaaggttcttagcttccttgcattgggttagaacatgctcctttagctcagaggagtttgttattactcaccttctgaagcctacttctgtcaattcatcaaagtaattctaattctccatctagttttgttcccttgctggcaaggacttgtgatcccttggcgagaagcagtgtcctggcttttggaatttttagcatttttgccctggtttttcctcatcttcgtggatttatctacctttgatctttgatactggtgaccttcagatggcgtttctgtgtagatgtcctttttgttgatgttgatgctattcctttatgtttgttagttttccttctaacagtcaggcccctctgctgcaagtctgctggagtttgttggaggtccactttagaccttgtttgcctgggtatcaccagtggaggctgcagaacagcaaagatttctacctgtttcttcctctggaagctttgtctcagaggggcactcaccagatgtgagccagagctcttttgtatgaggtgtttgtcaacccttgctgggaggtgtctcccagtcaggaggcatggtggttagggaatcacttgaggaggcagtctgtcccttagcagaacttgagtgctgtgctgggagatctgctgctatgttcagagctggcaggcaggaacgtttaagtctactgaagctgtgcccacagctgccccttcctccaggtgctctgtcccagggagatgggagttttatctataagcccctgactggggcttctgcctttctttcagagaggccctgcccagagaggaggaatctagagaggcagtctggctacagtggctttaccaagctttggtgagctctgtccagttcaaacttcccagaggctttgtttacacggtgagggggaaaaccacctactcaagcctcagtaatgatggacacccctcccccaccaagctcgagtgtcccaggtcgatttcagactgctgtgccggcagcaagattttcaagccagtggatcttagcttgctgggctccataggggtgggattcactgagttaaaccacttggctccctggcttcagccccctttccaggggagagaacagttctgttttgctggaatttgaagcaccactggggtatgaaaaaaactcctgcagctagctcagtgtctgcccaaatggctgcccagttttgtgcttgaaacccagggtcctggtggtataggcacccgagggaatctcctgatctgcacgttgtgaagaccatgggaaaagtgtagtatctgggccagaatgcatggttcctcacaggatggtttctcaaggcttctcttggctaggggagggagttcctcaaccccttgcacttcctgggtgaggcaatgtcccaccctgcttcagctcaccctctgtgggctgcacccactgtctaactagtcccagtgagatgagctggtgcctcagttggaaatgcagaaatcacccaccttctgcatccacctcgccgggagctgcagaccagagctgttcctattcagccatcttgccacctgtgaaagtcttttgaatggatgaatgaataaatgaatgaatgaactgttttttcactggcttcatatgctcatgcctcactaaggttgtagaaaatacaggatcttgaatactttaaagtggcaatgtcttgtgagacagacatcatccctgctgtcccaaaattacccagcgtgtgtggagaggcccctggctttggagatggggggcatttcccttgactcccacctcctcagcaccacagggctcatctctggggacctggctttccagttagagcagacctggatcaagaagggccacaggaaagagaaaagaaagacttggcagtgggagggcagggcgttcaggcctctccagggaagggtgccaacctctggacttagcatgatgtttttaaaagaaatgaatgtgtgtcttgtctctaccttcaacttgtaaggcaagtgcagtgccagaggctggggtatctctgctgcccaggtgcactccacagagacagagcaagagcacgtgcagactgtgctgtccaactcgcatagaaggctgacaaccacttccgtcctaatggggaaagtgaagttggcaaggcagaaatgaccacatgctcacccaaaaccttggtagcagcatgtctttccagaaattttgcaagccagatctggaaatttgatggctttgctcctctttttcctgaaagaaatggaaggaatcaggctcatgaaaagccagatttcacctccatgcacacaaccaggacccttgccttcctgaaatgccccacaggctttcacagaatagatgcagtcttagcagtgggcagcttgcttgttgtctggcctaagtctgagccaagataaagacatataaactgccaaggagacactctattccagaaccttctcttctttgcaaagcaaacataattttaagatcaagatgcataactcttgtaatcaaaagcttacacatttcctagcccccccaccaccctccacccccaagcaatgggttctaagcaatataaactgccaaagtggtgtgtagagggaaataaaaaccagactggtaagataccaacttttttataccagtttcagaaagtgcttatgcagagcaagtgtgggacaatattcaattggcaaaaatatgatgaaagtagctcacttaagaaaggaataaagtcttgtttattgaaagaacagtgacaagtttttttaaattctgaaagtcttgcatatttcctgcactgtatatttacctaagtacaagtgttttaagaatgatctcttgagcctgcttaaatcaagaacgcatatttcagcaatttgaaaaaaattgcatttctttgttcatggctgttctcggggttgagaggtatggacccaggagtcagaggtctgagtttaggcttccacctgctaactagcttggaacctctgactaggtttttaaaccctctaagtcttgggtttctcacctgtagaatgaggataataatcatgtctacctcacagtattgttgggaggacttaatgagatgtagagaaactaatctaaagcctggctcacagaaaggtaatgtgaagtctcaaaaaaagtgaattttacaatagcaaagacatggaaccaacccaaatgcccatcagtgataaagaaaatgtggtacatatataccatagaatactatgcagccataaaaaggaacgagatcatgtcctttgcagggatatggatgaagctagaggccatcatcctcagcaaactaacacaggaacagaaaaccaaacaccacatgttctcactcataagtgggagttgaacaatgagaacacatggactcaggcaggggaacaacacacaccggggcctggttggcgtgggggcaggggggtggtgcggagaggggtgaggggagggcgaacaccaggacaaagagctaatgctcgtgggtcttaaaatatagatcatgggttgataggtgcagctaaccaccatggcacacgtatacctatgtaacaaacctgcacatgtatcccagaacttaaactaaactaaaatttttttttaagtgaattttagccactagattttagagttgaagcatgccatggtacttgtgattaggcatctacctgtgtatttattcacctgaacacctggatgtgtagaataaaaattgctcaattgttgaaggctgctgcatcgctctatgctacttgttctgttaaagtatgttcagggagccagcccagagaggcacctccttttagctctgtgaggccttaaagctgggtcaccatgaagtccctgtatatatattttttgttttaataactccaagtaaccaaatgaaaacaattatttataaaatgtattaagaagtaaatgttatcaatttgggactttgcacaactattattaatgtgacctcaggtcccatgacaaattagaatggcaatcctgggtgagaagttaattttgtcctgaagctggcagaatcaacatgcaccccagttgtgggataggcctgttctctcactccatcacatccaacacctggcaaggacagcttttggtatgctaaagaatttgggaaagatgctgttggtgtaggggcggggagactagaaacaagatctttccatgggcagagctcttcagagcttgataacaaagtttggtctgcagcctttgtcaaataattataaactctccagttgaaacagggaaatgtgggctggcgtggtggctcacacctgtaattccagcactctgggaggctgaggcaggtggatcacttgaggtcaggagttcgagaccagcctggccaatatagtgaaaccccatctctactaaaaatacgaaaattagctgggtgtggtgatatgcacctatagtcccagctactcaggaggctgaggcaggagaattgcttgaacccagaaggtggaggttgcagtgggctgagatcatgccaacacactccagctgatagagtgagactctatttcaaaaaaaaaaaaagaaagaaaaacagggaaacgtttgcaaagcttccatctccaggttgacttcagtcaataatcctattgtcttaaggctggagtggacttccttgaagctctttgcccagaaaaccttgccaaaactctcctaagattattaagagttttctcgagtctcttttcctgattccaatcaactggaaatgttatgaaaataattctgtggtcaagtctcacttactcttgctctcaaacacaatccaccaaaagaacaaaacacaaagtaaaagtggatgcaagacacaagaggaagaggggccctctgcagaggctgctaagcaaacgtaggtttggctcaaagatttttgtttctttgaatcagttcactatttttaacctgtggaaatttgttcactcattctaacagtagcttttgctttgtgaaattggtttatttagtgttatgttcctcctgtaaaccttttcattgtatgtttttctcctaatctaatggtaatcctctcagtgatatgagtaacctggtgtttgtatttaacactccttcaacattcacagaatcagaaaatatcagaacaagaaagccccagccttcaagattgtttgatttgtgttccctaattttatgtgtgaacaaaactgaggctgtgaagattctagaataatatgttgagctcaaaaatatggtagtagaattagaatatagctttctaatatttgtataaaagtcaatgatatttagaagtttaaaaaagatacacattaaactgggaaaatactaaatatttaaattctgtaggctagttttcatattctggaaaggtggattttcatatggcactggtgctggtgtttcatcaggtcagctgtctatgtcataagagggtgttcttattagaaaatgtaggctttggcaagctttaaaaggtacacgtgttactgcatgttctgacgagattttgaaaatctttggcaactgtgctttccaagtggagaaaaagggctaccataatgttgaaagacggaaattaaaatctaatcagatatggtggcccttatcctccaccttagaatttcttttcgtggaatgtctggtggacagtaatatatagaggctcctcgacttaggatgggatcacatccagatacacccattgttaaattgaaaatatcataagttgaaaaatgcatttaatatacctaatctaccagacatcatagcttagcccagcctactttaaattgctcagaatgcttacactagcctgcagtcgggcaaaattatctaacacaaagcctattttgtaataaagggttaaatagctcatgtaatttattggatatagtatcagttgtttccccttgtgatcgcatcactgactgggagttgtggctcactgccacttcccagcatatatgactagcctggaaaaagatcaaaattaaaaaacaaagtacatttctactaagtgcatatcactttcacaccattattaagtcgaaaatcgccaagttgaaccatcctaagttggggaccgtctgtagatcaggcaatccttgacattttatggcggcagattgccaaaagagattggagtctagaagtcctggaagcagccccaacaattacacagaactcagcatcatgccctcacatcaaggcaaggagggagagttgtccctatttttcctttccttgaaagggatagtgaaactcattctgaggtttttaaaaaatgtactttttaatgcttttcctctatctgttttgctctcccttgataccctctctacatcatgatggctgtggcactgctcctgctccttacatggggtcttagaatgcacaaagctgcccaatatcactttctctgtatttgaggaaaatttctagtagcaaaagaatatcctctgacactcttttcaaaatgccaactaaatgtgatagaactactttttgcaacagtgaagtcccaaagtctctttcttcctgatgggttaatttagtaccttcctttttccaaatcaaagaaccataaaagtcagtgaaaatctgcattattattatcctgtgtgtttagttttgctttttagtacttaccattattaaacacttggcccatttttggctaattgttgtgtaattccaaatacaaaccagtcaccatggattattgcagttagagtcatcagaaagcaaggagctatgactcatgctctgttcttgccatgtttttctgatttgtatttcatttcttacctgtgctcacaagtcacatgaagatcaatacatctgaaatatatatgctgactatgtcaccagattttatttctcccatcattgaatctggacaggcttctttcaaaagtgttgagtcatttttatgtctttatcacactcttctaaagtccttaaaactcctaattatttcagaggattattgtcatataaggtatacaaaatcaattatatgaagaagttgtaatcactataattaaactgaggcttatctagacagatcctgtgtcatatttttcacataatgaggctaaaaactttgtggagaaaataatggatatttatagaatatactcaagtgtatttattttagaaggtctgttagacatttcacaaaagaatctgtaatctacagaaattaccaaattatgttacataatattttaaaaacttgttttagaataagttggaatgtgaggtttataaaacaactggaataataaactgaaattataatttaatttttatacccagtgcatttatttttcttcctatgacttgactatagtttaaaattcttataggtttagtatcccttttttgaaaacaggttttcaatgtgtttctgtaacaataatgaaaagtaaaggcatgtaatctcttttccaaaataaaagattggtttgagaattatgatcatatatacaatgtactaaatgcaaccttttatgatgatgatataaaagattcacagactcacaaatcatatgccactcaactaaaatactaagagaacataactttatctttataaaacatatacataggcataaatacatagtacaaaggtctagaaaaatatgcatatcagtgtggaaatgcaagtgatgataatgatttctgttgttttcttctaatttctatagagtcactatgctatttaaattttcaaaaaattaagttatgtgcaataatctttttaaaattatttgttttttaatcagctttttaatctgatgacatagaatgataacgtagtaaatcatagtttctgaaccaaaaaacagggacacatagactgagaagtgccaagttcattttagagattaaaaatacaacggcattgggacttttctagaaaattcaagatatgtggtcacaattgaggtgttcagcttctagagcgaactgaaccagatatctgctaaggctctgatagagaacagctggaagctcagaaaggtaaacataattcaaatattggtgaatatgccagtgcagccgagaaggtgacaggatttgaaaaatgtgccaggacacaatgagaaaggccttggaataaatacaaaaagcccaaactttattctgtaaaagtggggagctactgaaggttttaatcaaagcagggataatctcatttccaaggcaaaaaaacaaaaagaggcattccttcctaataccacatgtaggagctgttcttattctatggtggattattactttagtagtatcttataaagacagtgcctgaaggtcttttatctgtacattgatgtaacacttttcaaaagcatatcagcagacacatttttggaagcatgcattctgaaacttgaacttcaaataggagttatggctgatatcatggagtaaggtaaaacagaagctgactcctctccagtattcaaggctgactgttgtctctggaactgagaatactgggaaaagtgtgagttggacactgtgcacaactctaattaacactgttctaaagggaaagtatatgaatatattgtttaaacactaatagttaaaagttatactacaatatcttcaaggtttaacacataaattgagacacacacttaattaggcctaagaaagaagtggaatgtaaactcgttgattttattttcataaatgatttattttacaactatgaagaggaataatagaggccttttattagcaaagagattattatgatgtctattttcagccatgatttttctaccaatggaaagtggaactgaaaacctacttagggtgatgtgttggggttgggatcaaagagactactataactgtcctacctctgagattccagcatcacatgtggtgacaataacacttcatttagttatatttctagtgagtccagtggaatggagaaaattttttaagttaaaaattctaaaggacatatgtataatggtaggaattatttagtcttcttaataaaataaatcatttattttagaattattttgtagtctgaaagcacatttcctataatttttaaatgtgaaagcaggcaatattatcttgtaggtattgtattatattacaagagccaaagcatgctgattcccaatttcatccagtatgacttgtcttagaaaaagaaataaaaatgcagatccatttattcacttattaactgagtacatttcctgaatccatgtgcacgttgggtgataggaagctgaggccctgctggctaaagatgtaagagaacagagcctaaaactggcacaccagctggaaattaggagggcaagtttccctagaaatgggagaaccacagataggatgaaccccaaaatctgaatataaactctttccaaatacttggctgaccaccaacttatgcaaacataagggagacttcagtaggccagcctgaaacaaagcaactgcagaagctgaaaaatttagggatttgtcagttgctgcatatcacaggagagcagagcttgtagtttgagtccaggtcagctaacttcttaccagaacaataagccaatgatcaccaggagagcacaatagaactcagaaaggctgcagtgactattatctactagctttaggccctgtcctctgatatatcaagctagtaagacatgcaaggaaaccaggaatgtgataatgcctggggctgggagattatggaaattgtcagtcacccaaaactgactctaaataggcctccatgttgaatttagtagtcaaagacttcaaagcacctattgtagatatgctcaaccaaagggcattaaaagaattaaaggaaaaattgtcttaatgaatgagtagatagggaatctcaacagagaaattacattattaaaaaaatggaaattccagagctgaacaagtacaataattgaaataacaaacttgctaaacagtctcaatagcatattggagatggcagaagcaagaataagtgaaattgacaatagatttttaaaaatggcccaatcttaagaatagaaagaaaaaaatacccacaaaaaacactatcaaggagtccagcacacaaaatccaagctctgcctgtgcattaggcttcaggacatgagggaatggcagtgaattagggctgcactatgccaggaacactcatttaccacaactggatttgtcagcagttcgagtgaactttccttaggcattatagaattaactgtacttagagagaggttcttggttaacctcagtgttttcacattttaaattatttcctaagtttcaagtgaaactaaatatcatttgaaagacttttaaaggcagtctgcccaccccactccaactcaccccaatttccactaacaactacttcaaatgtaattgtcagaaagagcaccccactccactgcaccccaaatcagcctccgatagatattgcatctgaccctggggggcccttcccgctttcctcttgctatgctcactacactttatttccctcaatgaaaactccttccccaccctcctaatgtgtgacttcacattctatacatagaatttcttttttttccaaagtgaatatagttttatatattttttaactacataaaaataaaacacactcaatacaaaaagaaatggataaaacgcaaatgtgaaaacaaactcaccaatcaccaaccactcagaactttaggtcagtttaataggtgtcctcttctgacatttcagtgtccagtctgccctccttatccatggggtctgcatccacagatttatccaaccatggatagaatatatgttttaaaaagcaaaaaaaaatatataaataaaaaccaatacagtataacaactatttacatagctatgttgtattaggtattgtaaataatctagaaataatttaaagtgtatggaaggatattcataggttatatgcaaatactacatcagttttggtgggggggatggagtctcactctgtcacccaggctggagtgcagtggtgccatctcagcttactacaacatctgcctcctgtgttcaagcaattctcctgcctcagcctcctgaatagctgggattacaggcgcacaccaccaggaccagctaattcttgtatttttagtagagacggggttttcccatgttggctaggctgatctcaaactcctgaccctgtgtgatctgcccacctcggcctcccaaagtgagccaccacgcctggctcaaatactatatcattttatatcagggacttaaacatctgtggattttggtatccaaggagggtcctagaatgaatcaccagattatggtcatctcctgaggatgattgtatatacataaattcggggtgttttacaccaatggaatcatatgcccagttttataatctgattttaatttttactcagaatgtggatatcagtccaaatcaataaatatagacaataattgacttagttcagcagagaaactggaatctcacactaagggtgaggaaggcgggagacaggagcattcagggaggggcaactcacaccttagagaccaggaaagactcaggtgtttctaagccaggggagccagtggggctgaacacaagagaatcgtgcaagctttaagaggagcatccagatccccagatctctggttcctccaggcagccccaggggtctgggaggctgggtgggaaggagatctaagtgctccctccatgacctgctgctcgactcccaccttccttccaccctcagaatttctctgtgggcctcattgtgactccgctcccctccttcccacccaggggaagccatctccacatgatggactttatctgtgtgcctcatcatgtctccactcacctctttcccatgcagggaaagcaggctccgcacagtgggctttctctgggctcctcttcttgtctcacagtctcctcctctgtggcttatgctctcaggttcctggtgcatttatcaaaccagcgctccgggtcctgctcactctcctctggctgccagtgtgcagctccctgcctcccagtgttcttaagttcagcagttataattttcatctccaatgattcctttttgcaggatgctcctttttcatgattaattgctctcattttgtcaatgcagcagactcttgtgtctcactgaaagcatgaattcaggtttttagttacttcttgtttcttgtgtactgttgtgcatggaatcattttctccagttctgctcttctgaagaattgtgctgagccctgctgccctgcctggccagcatcttctcttcatatctgtagatggacagagttgttcggtgtagcaggtgccctgcgttctgtcatgggagacacagtgccttgttcaattctttcacttcccagttactgtattttttctggttggtggggctcagggggagatatccaagggttcaggagctctggccacttttccttgtgagagtttgatggggctgaacaagacagttagggaaggaggtaagccctcccttcaggtgctcagcccctctgacctctgtactgtctgccccgtggcctccagtccctcaacacacacctgcacccaggaccaagcttcctcggccctactgtgcgcagctggacccatgggctcctgcacaactggaccccagaatcctccctgcagccttcctctgccttccagccgacgcaggagctgttagtgaaggggaacagaaaaatggatccataaatccttgcttacctccctcgcaggctctcttgcctgggacagatgacatggctcctgcctgctctgctctctgtcaaaacttccccaagtattgagtctgtgggcatgaccattctctagtttctatctgtggcttggaatttgtgttaatgtattggttgggtcctttcaattggaatggggagagagaggaatccataaatctgtgactcagtgacctttaggaattggaagccaaggtctatttcttatgtcttattttgtattgtgcatagcagtgtctctcaactgtttgaatccaggcccctggagatgaatgtggactgtcagtggtgtggctttttccacctgcaccttctgcagagcagggtgcaccttgagcaccttgagcacgggcatcttctgcctgtgcacctgtgcacatgaaggagcctcttggggtcttgctgcctttggggcttttgctttcgcctccagctccttatacttctgcccatatatctcactctctgttttccagcctgtcttttctgttttctgaagtctgccctttccccttcatggttaggtgaaggaaggggaaatagaaggaaatatttgaagaggaaaggttgtggcactgcagggtatttgtgactttatccccaattgcattcttcaagtgcagttcttggtttttagggtatctctttgagtgagattatctttaagtcttttgtccttattctgagaaaatcttataaagtttccctatatcttttcatagcctggatttctcagaaaacacatggagaagcaaagcttctgctaggttgctgtgggaaggggaagtataggcccaggcgggcagagtgagggaaggggagtggggcagagtgggcaggaaagtggacacatgtgggtccccacagagccctccagatcccatgcatagagcagctgctgccaccagcagcacagacatcttccaagggctggcagagccagggcacctgctctccaagaagggcagaggtcggcaggcatgcacagcacttaccccaaggcatggtgtcattattgctgttgctttggagcctcttatgggactggaatctgtggagaggatggagagagtaatgcatctggaatggacctcctggctccttcctatttctcatcttgatggtcacactgcacacttcccaggccgcttggccacctcactgtcatgcagccaccaggacagccagatccctgctccaagcactgcaggaggagtcctcctccagcagggtacaacctggcactgcagctgctgtgactcatgcgcatggcatcaaggcagccatgcccaggcccagctcttacctctggggaagatagacagctgacaggtcaggacacagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggaggccaaagacaaactcttctcactgcctgtaagtgagcaggagtctgacccccggcttttctcccagagcctgcttctggctttacagttatcactgccacactcatgagcagtatttccaatactgcacagcaagaggggctcccaaggaaatacatgtagacccaatctcagcttaggcaaaaagatttctttgctacaggatttgtcagaaccttaaaatgtcaatgtattggaatgtctgcattcagaagggctatccgagacattatactaatgtatgatggtctccactcatgtttttggaggcctcatgggagtagtgtttataggcgtcaccttaggaaatgctgccctagacttttctgactgtttgccagccccatcaggctttggatctcgtatcttcagaaatgctgtcagtattttccaaggtaaaaactagtaaagaaaaccaaacaaaaatccagaaatgtgctcagttaatagttctcctagtatcttcccagaatagcatgtgcatttcacccttgtcctggagataatgtctattacctgtattataatctggaaatgaattctaactccttttattatgggcatgaccttgtttctgtactcccagcctccaaccagcaagaaaatgggggtctcagtcccacagccacaaggactgggattctgtaaatgccccagatgagctgggaggcagattcctccccagagcctgcagatggagttcagcctgcccctgacaccttgcgtgggagacactaacagggagaagagctgagcctcccccagccttctgacctacagcaccatgtgatcatgaatatgtgttattctaagccactaagttggtggtaatttgttatatagcaatagaaaacagatgcattaagtttgtctacaatgcccatgcctgcagtcatattctttggcttcctagaaggtgaccagcaatacatgtcagagtgtacaattagaaaaaaaaatacaaacaatacattatgttgtggttctcaaacgtgagtgtgcatcagaatcccctggagaagtgtattcaaacacagatttctgggacccacccctagaaattttgactcagtgtgcccgaggtggatcccaagaatttgcatttctggtaagttcccagatgatgctgttgctgctagaccaggaaccacactttgagaacactgtgttaagtcatgagctctccttttgaaaataatgatttactaagttgctgtatgtttctcaatctctactttaattgcttattttatgataaaaaatatttctataaaatgctcatagaaatgcctcttattgtgagtccagtccccattaagttgcctgtctacattgtgcttctgaatttagtcatttttccctttgggactgttctatacaccaccttattcactatttttattttcttacaaataaactttacaggaatcagcttaagaagctaacagcaattatctgcaacaagaataagtatgatgaaaatagagatgttacctgattgtggttctttattagagagtaaaggaacagagaaaggattaccccaaagctgcattgtgcatcagctgctaagtcatggcctgcttgggcaggtacgagaccagtgttaggaaatgcaataatccagacaactggagctgcagggcactggctgtcagttacccccaaaccaaggagagaagccaaggggaagactcccctcttgggctcccaaagaggtgaatgtattagatagtcactggctagagcatccaatttagtcatctttccagaacactcacggtcagatgacatgatgatgaaatatctcgtatagaaggctgatcatctcacttgattaaaaagttgtgtgacctgatttttccatagaattggcccttaatcatgagccatttttttgtcttgtatttaatatcagtcttgtgccagttccttggaatatccaactgactgatccaatcaatgaacgagtgtttatggagagtctaccaagtgccaagcaggagaacatcaattctgtcagccagtccttggaataatccaacgtggccatgtgggaggccacggcaaaggatggccaagcaccttaactgacagggttctgttcttgttcacagtggggagggtaattctccaaaattcagtcctgccactgccactggagcaagtaaggggtgtcaggcaactgtcactgtgccctgatgtgcagcgtggcatgtccacttgactctgtgacacgtctctcctcctagcccactggtagagcaggtcagagattggtcccttcttgaccatttgtactcccagtgttgatgatactacacccagatggtcagagcgaggctgcaatttcagctcttaactcatgccccggcttagcactcttctctcttagtggaagggaaaccctggtagtgccaggtttatggctgcagggctgagagcaacaaaacccatccaggcagcaggacctgctggttgggctgacagccttggagactgtgttgaacctggtcagcactggctccagcagggatggggcagagtctgtatagtgaagtctaacgtggttggccttgggtgggattctgtgtgggtctcatccttttggatggaattgcattaaatcaatgcagtgactcaagatgtttagttcatgaaaaacagtagctatgcttgccaagtatttgtgcctttgattaacttacttagaactaattaatcaccacttataatgtatacttttttaaacagactcctccaaaatggggaagcatgaatttaaaatagagtagccctattcagatggctatgatccacttgttaagcactccttagcctgagtggcctaaaaatcggagcctggggcaaaagcttatatattaattcttgatcaagggctgccatcctagggaaggaagaggggggaaagcaagagcggcaggaaggagggagagcaattcagagcgaggaaccccaagccagccacaactccacagccaaggcactggcctcattccccagggagctctgcaaagtctagtggaatatctgtgtctcagaacagccatggagggggttgggctccctcttctcctgtgctccatcttttactggtcagagtctgtcctgagagacagtcccatcatggctaggttgtcgggtcctctctgcttgggaagccagtatcttgcgggtccaggctgacacctgagaggtgggaaaaagatgtacactctctccagggggctgcaactggggaatgagatgagtgagccaccagggagatgcagctgtgtggaccaggactcagcacaaagctcatccctgaattccaaggagtgagaatgcagaagagagagctatcttccttgttgttttattaatctttgttttatgtgaaactgataggagtattcatttcctagggctgatgaaacaatataccagaaactgggtggtttcagaaaatagaaattgattcgctcctggttctggaggccagaagtccaaagtcaagatgtgcacagaaccatgctgtctcttgggctctaggagagggtctgttccatgcccctctcctggctccagcactgctgccagtccttggcactctttggctggtagatgcatcaccccaatctctgtctctggcttcatatggccttttttctggtatgtggctgtgtctctgttttctcttcttcaaaggatacctgtcattggactagggcccgctctgatacagcatgatttcatcttaactcattacatctacaaagaccctatttccaaaggtcaacttctgaggtttcaggtagacataaaatgtagggtgttgagggaggggggaagccagtcctataaaatacgctgaaattaactatcttccagcaggtaaatagttgataacctctatatcaactgcatattagactaaatcctatttaattggactggagttgggctcaggcattttttcatttacctcaagtaattctatatatatatattttattatcatcagcattatatcactgattataatgcaattggtaacatttattggacagttactgtgtctcaggcactgggctgagtactttatgtatattataccaatgactcatcattccagttcttcatcttacagataggaacacaagagtcaacaatgttggaaaatcgccagaggacacagacctgggagcggccaagtcaagacatccaggctgtctggctccagaactaggactcgtctttgccaagagaacccagaacatatttagaacctttcatcttcttctcgtctttagacagtctcagttatttagagaaattgtaaacattttaagatgcgtaactgcaagccttcactacaaagaaataaaacagcctggagagagaggggctgacgtatcatatgtatcttgtacaacctgaggatgagtcaccaagggcagaagttaataaatgacaggaattattattcaaacagatttaatactttcatgtctcccaatttcacaagtttagaaaaaaagtgatgcatttagaagacatctctccctcctatttcgaagcttagctgcctaacctacagtaaagcctgatagttatgaaccttggagaacagcttctatgacaagtgaggatctaagagcctatatctcataatgatgcctctctgcattaaactaaatcaccccattctgggcaatcattgcagatcccctggtttcctgtcttggccctggacccacactcccttccccatcaaaggtgggatggggagaagcagctgcccagcttaaaacagtgtacttcccagtcatgtgccaggcagaaccttgttggcacccacgtttctgtctctgtggctggacctgctcctcatcttgtcttcagtgcccttctttttcctttgatttctacctaaatccagctcattgtgggaccttctctggtccaaccttcttcaagtctccagctgctcttacctccatgggccatttctttgtttgaagttatcttacatttagtcgattccattctgtttagatctcagctgctctacatttgcttcacagaaattgaccttggctcccaaactatataacaagtacctcccagggacagaaacaaggtgtgtatatgcctggtattcctcccagccttctcggcataatgccaagcaaacaaaattggagtgatctccaacatacctgataattactctttatacctgtagtataagaagtgttaactttttgacattaaatgaaggtgcccaaatagtgccatcagatcatgttaaaattttttcatggtgacccaaattaataatgacatcctttttcctcatggaaacccaaaccaaattattatttatgattactataatttttagccattattaggctctgttatggtactgtgtggttgattaaaaatggaagttgcccatggaggtctacatgtcattgttttggccagtgcaaaatgtagccaggagcacaccacacctgacagtatcagtgattattattattattattattatttttaatactgatgaagagtttagtgactcctgatttcaagctaagagctgattaggaaaggttccattgacaactcatccctagaaaattaaaacagaagcacatagatattgcaatttgacttcagagacttccctttctcctagaacaatgcacaccgcaaatgagggctatttccgatggcttataactaaagtaaaatactgtgatatcgtctaatcttagaatctcttaagtgagaatttgttcaagagggctaacctagaacccagtggaaaaatccagctgatggtcacctgggtccattccctatggtctgaggagcaaatgaggcccctctcctgagtttatttatttatttatttattttatttatttatttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccctaccacacaacagtccccagtgtgtgatgttccccttcctgtgtccatgtgttctcattgttcaattcccacctatgagtgagaacatgcggtgtttggtattttgtccttgtgatagtttgctgagaatgatggtttccagcttcatccatgtccctacaaagaacatgaactcatcattttttatggctgcatagtattccatggtgtatatatgccacattttctatgccttttgaatacttgcattattttctgccttgcttcttacctttgacctttgtaaatgggagattatttgttgctcttgttttaaggataatttagaaatgacaactttagcatatatctaataattacttgccccagcatttcatcattacaactcaaattaacataatgtctgtttggattttaacaaagaagaaaagctaagaaaaaccttcacttggaaacccttcaaaagtttctcatttggctacagttactcaggctttctgcaaaacgaagcaatgttatccttacattacaccaacagttgtttgagtcttttatcagactgactttctgctcatgccaaaaggcgtcattttctttgtgtaaaagtgactttgaagattaataagtaacagaatgggtacacatggatttatgaacatttaaaattgcttaatgtttttgcatgtgtatactttgaaaaaaaataggagatgccccagttgttctacatagattgccttaggagaaggacataaatgtgcgtcattgattcagacttaagtgaattgttggtgatccacaatgatctcccattgacaagaggtgggtttttggtctcccaaggaactacaacaagcttttagtactttatatcagaaaaaagtacttagcctgtgaagctcatggctttggtgcccgctaatctctctttaaacacgaaagatacatcgcaggcccagagctgttgcatcagcaggcaggcagcaagctgagagctgattaggaagcgtcagcccctagaggcagaggtctgccccctgactctatgagcaagagtcaacatcaagcccttcaatccttgggcctgcagttttccctgtacaggaaacacaagcgtgtgtggatgtgtgtgcatttctttagaaacacataatttgtttgttgctttattttctacctttgaaagatggcaagatcccagtcacaaaaacagaaaccaggctaggtattttaaccagagagggatttaataaaagcgttaggatttgagctgttttggaagagctgaagaagaaggagaggacaggggtcaggaaggacagttcctgcagtgtcctgccctgctgggtggccattacaaagctggcagctgtggggcagtatccctttgcccccatgtggccaggcacacggggcactggctgactcccacagccaccactgtcaggattggagctggagctgctgccacagccagaagcagaatgtccactacctccctcctaccttctgattttgcactagctccctactggtacaacctacacagaaccctgccagtaaaggaatctgagaaatgtagtcccctgaggtacagaaaacacagaagggcaggcagtatctggcccagatgcctatcataaagctttagaaaatgttgtgttatcgctgcactttaaccattgaagtatttattttaaattgattcttatttaaatatcaaatataagagaaatcctatttgactatgccttttatgggacagtcaagaagataatcagtattatattaaagaatattttatgggtttaaagaatattttgggggcattttaattcacatagttcaaaagcagctgaatacatgtattaaaaggcaagctcttgataggccttgctatgtcatctacgaaaagcactcctgtttgcctctgctagctaactcagctatttgaagtacagatggatgaagcaaattctactgtttgggtttttatatttgacactggttgatacttttccaaagcaaatgttgcatttccgctggtagtttgatttcgctgtttgctttctgaaattctatgtacttttattttagtacatagaataactatgcctgcttaattccaatgagaaattatttcagataaataatcatcaacttgtttacttaaaataaaatttttgtacctcgaaaaaccaaaattgataataaaaatcctttaaaatgaccatgattacaactattatgcatatctgtaaatctctttacttcttacatcttgactgatcatctcagcaactctgtgagaagccaactactactgcctccaaattttttccaactatgttaggtgacaggtcattagctgtaaaaccaaggcaagaagttggactttataagtaaatacgatagtttacttatgaatatgtatttatgagactcctcaaaattcatattccaaccacattaattttctcttcatgctagagtctaatgcagtggttagactgcagcatgaaactggggtaagcataccacttggagatttgcaaagatgatcacaggaattgtcggcctggataattttaagggagccagttttcagatcctcaacctacattcgtactctttcccaaaacaaattcgtctaagaatatgtcccttttaaggatgcaggttcctacccaaaattgtacttttcccactttgcaaaattaatcatgcctctctctcatctttctctgaggcattgacttgaagttttaaaatcttcagggcaacaaacaatgggacaatttgacatattgttccagtattaagaaagtaactttcttaatgtaagactaattataagtaaatgtaaatgactgatgacttaattaaacaactttttgtaagtctgatggtttccatttttttccttagagcagaactgtaggagaacttacatgacatgctggctaataaaaaagtaaaaataatttggtgatagatcactgtgaatcttggcatacagctgagaaggaggttaaagaattgagtaacatttctgtagcaaaactcccttcattcccactgatttatttatatggaaaaatcttcttggcccataaatttataaaaatgaaaaacagaaatagaattaattttgagccctaactcattctagtaataaataatatatccactgatttcatgacctaactagaaaaacttagactcgcttttggccatggagacatacatttccaacaaaattttacttctgcataataattatttcttaaaatttattacatcttatttttttatcaattatggtctaaagataattgtaattataacccaagcagaaaaaatccaatatttagagacttattgccacaggaaaattttaaaaattaaatgtcaatttatatatgtaacttattgtacatagaagtatggtgacaaaacctataaaatattttctacacgaaatacattacattagaataaaagtctgtggaaatgaaaataagagctcaaagagaaaaaaattgatgtcaaatttcagactattaaagaacagtctgtttatagcaattggacacctgatagcatataatattcatactctattgcagccatcccttcctttttggcactagggaccagttttgtggaagacaattattccatggatggagggagtgggggctgttcggggagatggtttcaggtgaaactattctacctgagatcatcaggcattagttagattctcataagaagtgcgcaactgagatttcatgcgccgcccacaatagggttcacgctcctatgagaatctaatgccgctgctgagctgacaggaggcagagctcaggcagtaatgctcgtggcccactactgctcacctccttctgtgcggtctggttcctaacaggccacaaactggtactggtccatgactcggtggttggggactcttgctctattcaatacgcttaaaagaatgatgttggccaggcgcggtggctcactcctataatcccagcactttgggagtttgaggtgggcagattacgaggtcaagagatcgagaccattctggccaacatggtgaaaccccatctctactaaaaatacaaaaattagatgggcgtggtggcgcacacctgtagtcccagctactcaggaggctgaggcaggagaatcgcttgaacccgagaggcagaggttgcagtaagcagagattgctccactacacttcagtctggtgacagagcgagactccatctcaaaaaaaaaaaaaaaaagaacgatgttataacaacatagtatactgaaaattacatcctttgcagttatttaaacaaaggatatttatgtgttaatgtaaacatacgtatgtgatacattttcaaaatttatttaaagagtatatgagcaaaaatctttacagatcattgatctatacaaaagataaggtgttttgaagatctgcattctggcatgtctccatgtgtgttttctttgttttctcagtttgaccttgtctgtgtcaatgcgtggatgctggacctcacccaagccatcctgaacctcggcttcctgactggagcattcaccttaggctatgcagcagacaggtaggtaccaatgtgacagccattttatgtcactataataccatgcattaatacggggagaaaaatgttttatgttaactattaaaacaatatttttgctaaattcgcaaacaattcttgattccatcattcatgacatccacacttggttggtttgactaattcttttcttttcaaacttcatctccttattccttgaacttcacaaaggtctgaggctgttcccggtaggactgagagcatcagaatgaaaacacagacctccaaagcaggaacatcatgactgggttgatgcactgttatgctgaatactacagaatcaatcaattcgatgtgcttcagtaacaacttactgattgtggttttattaatttagtcataagattagcctattccaaatttgtttcacctaatttttttttaaacgaaatccttgtattttattctacaaatgtaaaactctgtgaaaaaaatatttttccaaaaaccactaaaggagtttttttctattattttgtattcataaatgcaactgcccagtggcaggcatggtgagtgtgtatattcaagacatcatgctttctatttaaatattcttcttccttaagattattgatgctagctattgtattcatgtttaactctatttttaattccaattctaactatgaaaatacttgcagtaatttaatattcctctctatcccccttagcaggagtaataggaatatagactggaaattgctgactcatggctgtatctggcctaatattgttctggttaatccatctctgactcatggccatatctggcctaatattgttctggttaatcgagcccagcccatggtgggttcttgtgactgtaccattcagtgggtgatactaagtttacctttagagaactgcaaacagcaattaattagctaatagaacaacaaaaggccccatatcctgtagccaattgaagatctgagtttaatcagaccagtgcttcaaaatgggtagagccttgggtttcattttctgtcactttttctttctctttcatgtttctctctcgccctctccacagctgtcctttgcatgtgagtttctgctggatcctttcatgtgtgatgccctttcccctttttcttctttttatcgatgtccttttctcctgttctacttctagccctttcaagcttcatctttcctttcctaatttcccccacatgccactctttttttgctggctacaatttggaactgtgcagtttaaatatttatttattttgttttgtttttactctttctaatttggatattaggttttgcttcatctgtgttttttttctcttactcagtcaataaccatatctccaaactaaattaacgttactaaagtggggaatttccccttcctatattctcataagtgattgagcatctgtcctcatataggacttgctgccttggaggggaggggccagacctgggaaaaagaggagccatgaataactctgcttcctacatttggcttcttctcttcctccatatccatgatttatatatgtgaaggaagaacaagaaataacttaataggccatttgtcaatgagagtacagtgtaggaagggtggaaagtgaatataaaatctagattggggcttctggtttcctgttcagcctataaggagcttagaatttgccactcagtcttgacaacaagtaaaatgctgaacaaactgaaaaatcaataattcttctcagatccataagagaagtgagattacagggcaaactactaccttcagcatcaccccgcacccccaaccccactaaatagaaagacaggagaatacagagaatcataacacaggcgcagaaacctccttgagagagccagggtagataaacatgaactgtaattgatgaattcctggaggatcactgtggatgacctgaaggattaaaaactctagagggactcactcaaaggagggcccaagcttttgtgatttttttttttttttttttttttttgccacctgaagctctacaaggttccaaaggtgaatattaaggaaaatccctcatgctctggcagccagaggggaaaaggaacaattttgaaatatgccagaatatcgttcttaacaatgtctgccctcaggagaagatgtttaaccagagcctaatcttctggggttttctgagagcctcattgatctgggggaagggaaataccaactccagccccttctagccttccaagtggagaaagagaaacaccaaattctagcctcctctagctttcaacttggaagaagggaaatacccagctccagccccctctagcctttctcccctagttcagaggagagggatagagaagcatttgtgaagttcaccgtttagagacataggttcactaaaagactgagagctactcatagaaccacagaatgccttccctcccccaacacctcaccaccacattactaaaggtctatttatagcagttccgtttacccagtacaccatgtccacctatcaagaaaaaattacaagacatactaaaagccaaaacacacacacacacacacacagttgaagagacagagtaagcatcagaactaaattcagatatggcagggatgttggaatgatcaggctaagaatgtaaaacaactatgccaagaagtctgatgcataaagtagcatgcaagaacagttgggctatgtaagtagagagatggaaattctaaaaaaagaaaccaaatgaaatgctagagatcaaaaacactgtaacagaaatgaaaaacgttgttactgggcttattaggagattgggcatagctgaggaaagaatctctggccttgaggatatcccagtagaaacctccaaaactgaaaaaaaaaaaaaaaaaaacccacacacacaataacaaccacctgaaaaagcagaacagaatgttcaataactgtgggacaattacaaaagatataatatatgtgtaataggaataccaaaaggagaataaagagagcgagaaatagaaaaaatattttaaacaataatgactgagaatttttcaaaattaatggcagacaccacagatccaggaaactcaaaggaaatcaagcaagataaacataaaaaagtatacctagttatatcgtagtcaaactacagaaagccaaagataaaggaaaaattctgaaagaagagtggggggataatgtcttactatagtaaaagagcaatgataaaaattacaccctacttcttttcagaaaccaggtaagcaagaagaaagtggaatacttaaagtgtcaagaaaaaaaatccaatctagaattctatactgtgcaaagttatcatttaaaagtgaaggagaaataaagactttgttagacaaaaattgagggaatttgatgccttgtaataaatgttaaaagaaattatttagagagaatgaaaatgatctaggttagaaatccagatctacataaaggaaaggcattggagaggaataagcaattgagaatatgtttcttattctcaattgatctaacagataatagtttattcaaaataatagcaacaatgtgtttggttgtgtatgtttatatatataagcatacataagcatatatagagtattttttgttataaggtactcatactactcatgaagtgatacagtgttatttgaaagtggatttgaattagttataaatgtatattgtaaactctaaagcaactactaaaaaaagattttttttaaaaaagcatgactgatatgctaaaatgaagaaaatgtggaatcctataaactgctgttcaatgaaaccacaaaagccaggaaaaagtgtggaatacaaacataagaataaaaaataagggaaacaaatagaagatgataacaaatacggtagacattaatccaaccatgccaatactcactttaaatgtaagatggtctaaatgagccaactaaaagacagagattttcacagtggatcaacaaacaagacccaaccatatatgttgtctacaagaaatccactttcaatatacagacacatatacactaatagtaaatggatggagaaaactataccatgatagcagtaatcaaagtaaagcagaagtagctatactattatcagcagagcagacttcagaggaaggaaagttatcagggataaaaacgggcattatataatgacaaaggggtcaattctccaagaagccaataatccttaatatctatgtgtttagtagcagagcacaaaattataagaggcaaaaactgtgataaaactggaatgagaaatagattaatccacgatttcactggagacttcaacatccctttgttggaaatggtcagattcaacaggtaaaaaacctataaagatataattgaactcaacagcatcatcaatcaactgtatctaattttcctctttagacaaccttatctaacaacagcagacttaacatttttttcaagttctaatgaaatattcacatgcaatattcaagataaatcacattctgggccataaaacatatattagcaaatttgaagaaataaaaattatacaatgtctgctcccagaacatagtggaattaaactagaaattcataacagaaggatagatggaaaatccccaaatacttggggatgaaacaacacatctatagtaacacataggtcaaagaagaaatctcaagagtaattaaaaagtatagtaaacaaaatgaaaatgaaaacactcaagacttttggaatgcaacagaaacaatgtttaaagggaaatttatagcattgaatacatatattagaaaagaggaaatatataaaatcaataatctaagctttcaccttaggaaactggagaagagcaaattaaacccaaggcaagtagaagaaaaaaaaatacaaattggagcagaaatcgataaaattagaaacaggaaatcaagggagaaaataaaaccaaaagctggttatttgaaacgattaaaaaaaatcaataagcctccagtcagactaagaaaaaagaaagaggagagagagagaggttgaagacataaattactaatattagaaataaaagaggggacattttgacggatcccatggacattaacaggataataaagaaatactatgaacactctgtgttcacaaatttgataacctacatgaaatggaccaattccttgaaagattacaatctgccaaaactcacccaagattatatagacaatctgaatagggctatatctattaaataaattgaatcaatagttaattacttttcaaaacaggaagcaccaggcccagatgggttcacaggtgaatttgccaaacgtttagagaagaaactctaccaattccctaaaagctctttccaaagatagaagtagagggattgctttctaacttattctgagaccagcattactttaatacctaaattggacagacattacaacaaaagaaaactacagactaatatatttcatgaacataagtgcaaaaatcctcaacaaaaatttgcaagtagaatccaatagtgtataaaaaaaattatacaccacaaccaaatactgtagcataccaagtgtgtagtatcccaagtatgtaaaactggttcagcattctaaagtcaattaatgtcatccatcacatcgacaaactaaggaagaaaaaatgacatgatcatatcaatagatacagacaaagtatttgtcaaaatccaacatctatatatgacaaaagctctcagtaaactagaaatataggggaacttcctcaacttgataaggaatgtctattaaaaaaactacagttaacatcatacttaatgacgataaactgtacagaagctttctcactaagatcagaaacaagccaaatatgtcatctctaataacttcttttcaatgccatgctagaagccctcgctaatacaataaataagacaagtaaagaaaataacaggtatactgattggaaaggaagaaataaaaactgtctttgttcacagatgtcatgattgtctatgtagaaaatcaaaagaattaacaacaacaacaaccaaaaaaaaaactcctgaaactaataagtgagtatagtgaagttgcagggtacaaggctaatacacaaaagtcaactgctttcctatgtaccaacaatgaacaagtaggatttgaatttaaacacataatgccatttacattagcaccacaagaatacacaacacttagatataaatctaacaacatatgtacaagatttatgtgaggaaaagtgcaaaactctaatgaaagaaattagagatgatctaaataaatggagagatattcaacattcatggataggaagactcaatattgtcaagatgtcagttcttcccaacttgatgtatatattcaatacaatactaatcaaaatcctacagagttattttgtggatattgacaaactagttctaaagtttatatgtagagacaaaagacccagaatagccaacgcagtactgaaggagaagaacaaagccagaggactggcactacttaacgtcaagacttaccgtaaagcgacagtaatcacgacagtgtggtatttgtgaaagaatagacctctaccaatagttcagtggaataaaatagagggcctagaaatagacccacataaatatagtcaactgacctttgacaaagcagaaaacaaaaggtactggaacaactggacaaccacatgcaaaaaaaaaaaaaaaatgaatctagacacagaccttacaccctttaaaaaaaatggatcacagacctaaatgtaaaatacaaaactgtaaaactcctagaggatgggataggaaaaaaatctagatgaccttttagatacaacaccaaaagcataatccatgaaaaaaagaactgataagctggacttcattaaaattgaaattttcttgttgtgagagagacattatcaagagaacaaatgaaatgacaagacacagactgggagaaaatattaacaaaaggcaaatatttgataaagaactgttatccaaaatatataaagaactcttaaaacacaacaataagaaaataaacaacccaactaaaaagcgggccaaagatcttaacagatagctcaccaaagagagtatacagatgataataagcatatgaaatgatgctctacgtcatatatcatcagggaaatgcccattaaaacagcagtgagataccactacatatctattagaatggccaaaatccagaacaatgccaacaccaaatgctgactaggatgtggaacaacaggaattctcattcattgctggtgagaatgcaaaatgaaaggtgactttagatgacaaaattcttacacatttttgtaattcttacaaaattaaacatacttttactaaatgatccagcaattgtactccttggtattccaattccaacccaaaaaagttgaaaactcatgttcacccaaaaacctacacatacatgtttatagcagctttcttcataattgccaaaacttggaagcaaccaagatgcccttccataggtgaatggacaaactgtgatacatccagactatggaatattattccatgctgaaaagaaatgagctatcaagctatgaaaatacatagaggaaacgtaagtacttattactaaatgaagaaactgatctggaaaggctacatactataagattttaactatatgacattttggaaaaagcaaaactatggagacagtaaaaaaaaggatcagtggttgctagagggtggggagagggagggatgaacaggcagagcacagaggatttttagagcagagaaactattctgttagatactttaatggtggatacgtgtcattatacacatgtcaaaacacatagaatttgcaacatcaagagtgaacccaaatgtaaactgtggacattgggtgattatgatgtgtccctgtaggttcgtcaattgcagcaagtgtaccactcccatggggaatgttaacaaggagtatgctgtgcatgtgtaggggcaggggacagagtccactaaaaaaaattttagataaactaaggctacttccatctctactctgctgactcaagcaagatgctatatgtacatattttatggaaatttttatgaaaagatgtaatagaatcaaatctcttaatggacattgatagcaaacatttaccagacaataatttgacaccactatgctgaaccaattcacaccagtctctcagaatgttgtgcatgttaccttgttccttttcctaaactatttaataacacatatgccaatggtgaaaataaaatacaaaatttaagaacaactgacattggctgtgaactttgtagtttataaaacactttcacattaacatctcatttgatcctctctacaacctccctctagaaaaaggtgggaataaacaaaaacaagcaagcaaaaccttcgttttgaagaccttaggaattagcccaaggtcttatgactggtagatggttgaggtgagattcaaggcaaggccttctggccataacacaccattccttcttctttctgcctctctgtccttatgacttgacacataaaaaatgctagaaagtgtcacatctgtaccaccggggagactctgtgtgaaacaatagtttcaaggagggtcatcttttcagaaactgcaatcacaaaggatgcattctgtactttaaattttgtaattccagcctaggcaacatagggacaccctgtctctacaaaacatctttaaaataaaatgatataatgtaatacagtataatatggtatgatataatattttatgttatattttcccattgtgttgaagaaaatgtttaaggtgagctcttttcctgtctttctcaaaaaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattggtaagacattcttacaccatcttctctatttggaaactagggccagatagccaacaaatgctagttaatcaaccttcctcttcctcatgtgtcctttaacaaaggaggtttcactgcagctacagtaattatttctgcagatgggagagctcagaggtaggattctgagtgctttagaaactaaaataccaccttactttgggagccaaatatagaatattataaagcactggggcaaactacttttatgtacttctacactgttataatatggtttctagctttgctttataagaaattaatttttataaaatctcagtagcttcttgaggcatttttgaggcatttttaaagcattttctctgcactgtgttatgtgatacagtttgagattactttcctgtgttgccaactctcctctttctgtacaagtgggaaactttttactatgggagaaataggttctaaaaatgagaagttcatttgtgacccttggataccttctatagccagaaagtttgaccttctggtgatggaagaaagaaaaagttcactttacttttttctcatgtcccttgggaaagccctggctactccttttggttccatttctagcttgggaccagccacttactttaagagtagtggtggatttctgaccaggaaaatgtgaattctcatcttagattattgctgcagatctttgcacttccactctcctctgtcactgctatacaatctccaagcagtgcgcattttggagacccctgaagacctttctgtgagtgggagaaggagagaagatgattagagggattggttgtcactgtctggaacagaaggagtaacattggaaggcaaggcatttttaaggagactcagcctaggtgaatcttcaaagttgtgatctgagggcaacaataaagtagcctatcccaggataatcagaatatgagaaaccaattagtgggaaggggcaggaaaggaaaagatttcagcaataaaatttcccatgtgatttttagagcatatcctgtcaatgaaaagtataacactgtggagagaattatcatttaatagaagttgtcttgtgataacgaaaagtctttgtagagtcttatatttataatgaatcttctaaggagactagaatgtgcatatctctagagatacagtgataaaatgtagccatcttaacatatttatgttttgataattacaattaccttttaaaataatcatcactgaagctttcctaaaaccaacacagatattcttcgtatttccctactgtacccagaagagtgctggtctgggtgcataagaggaacatggcaagtgcctgtgataaatggcagaggtgagagtgggagaaaagcatttagtatcaagaaggacacctccatcctttctgcaagtgtggaagcctccgtatctgagtgctagcgtgttctagcaatgctgatggatgtaacaggtgtaacatctctgtatttgtttgtttattttggagctgaccttgtgcttctgtgacctcttgtgtttgttttcctttagtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactggtaatgtggttttggttatcatcatatttatactgattctgcagaaattagactccaaacagacatgaaaatgaaagcaataaagaaaattttctttttttttttttttttttattatactctaagttttagggtacatgtgcacattgtgcaggttagttacatatgtatacatgtgccacgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgttttcaaacatctctaaaatggctacatgctttgagaatttttagagaattttaggatttaaagagagtatttgttgatgattttattaataattgtgaagaaaaatgaattaataaaataccagaacgcaaaattttaagtagggtactgcattatgttttgttttgtaataaatagcttcatgaaaactataaagtaaccaaccatatctgccagtatttcaacatgcaaattaaatgcaatgaagtctatttgtttctctgtgtgttctataaagcaaatgaatattactcagaaattctctgaggaataaggaaatgttaagagcatcaaaaaattacattatcaaaaagcaacagaaaagcatttgatttttgttgttgctgttttgagatggagtctcactctgttgcccaggctggagtgcagtggtgcgatctcggctcactgcaacctctgcctctcagattcaagtgcttctcctgcctcatcctccccagtagctgggattacaggcatgcaccaccacacccagctaatttttgtatttttaatagagacagagtcttaccatgttggccaagctggttgcaaactcctgacctaaaatgatccacccacctcggcctcccaaaaggctgggattacaggcctgagccaccacacccagccagcatttgatttttattggaatgaacatgttttaatgattcttctaatttaattttaatatatgggcaagtcagtttacataaatcagattcctaagcttttcttaatatttactaaatcccaattcttttcatatatggaatcaatatattgtaagatagcctggttttgcaagagcaatgtcatgttgattattttgatgagcaatgatccaattatcaagctagcatttttccccatccattataaccttgcaggaataatctgtatttcagggacctattatcaactcttattgactcctaaatgtatatctaattgcaagatccattttgatagaaaaactcaaggcaatagattttagcgtttgaaattcctagacataactcacaacagcctccttctttgccagggtggtccctgagtctccccgttggctgattactcggaagaaaggagataaagcattacagatcctgagacgcattgctaagtgcaatgggaaatacctctcatcaaattactcagaggtaatttctttcagtatgagtaacaaatattgctaaagctggtgaattgattttgttgcttcttgtgtacttaatgttgcttcttaaatttatatacaaaatatgcatattatatatatatatgtatgtatgtatatatgtatacacacacacacacactaccaaacatctgggaaatcattttcagtttgacttaactgaaaaaaatctagggaaaaatcataggacatattaaagaagaaatgattatgaagctctattagcattataggcaaggttaattgatcatttcagtacatattttaataattgcaccaagttacttgaattattatactttacttactgtaagccccataatattgaatcattcatcttgattgtacaaactgtaaaactttttttgacttttaatttaaatctttaagtttggccctgaaaaaaaatctgtttattcataccagagcttgagcagtaatgtaatatttcagcctctaaactcctatatgctggtctttctccctttcttcttttcttcctccattccttccttcttccaagaaaggctttttggatgcctctgcatcagtgtaccaagaaataggggagggccgggtgtaatggctcactcctataatcccagtgctttgggaggctgaggtgggaggattgcttgagcctagaattctagaccagcctgggcaacatagcaagaccccatctctacaaatagaaagttttaaaaactatgtgggcatggtggcacgcacctgttgtctcagctactcaggaggctgaagcaggaggatcatttgagcccaggactttgagactgcagtgagccatgatcacaccactgccctccagcctaggagacagatcaagatgctgtctctaaaaaagattttaaaaaaatgaaatgggacaaaaattaaaagcttttgccctttggaatatttgatatgcacttgaggatataacatatatttaaagcaacccataaataattagagaatagcatataaagaaaaatatgatgatgttttagctccaaagactaagtgactacagaataacagaaaggttgttataaaaggaatgttagagaagaatttttggatgatatgaatcttgatttaagactaggttgtcaacattgttttcttcatagcattcagtttgatttcacaggaaccttctgataagaacgttctgataagaactgggttttggggctgggtgcggtggctcacacctgtaatcccagcactttgggaggccaaggcaggtggatcacctgaggtcaggagttcaagaccagcctggccaacatggtgaaaccccatctctactaaaaaatagaaaaattagcgaggagtggagacgagcacctgtaattccagctacttgggaggctgaggcaggagaatcacttgaacccaggaggcagaggttgcaatgagacaagattgccccactgcactccagcctgagcaaaaagagtgaaactctgtctaaaaaagaactgggttttgttggttctattgtcccctccccagcccttgaagcttggtcatgtatatttggatttctgccttcttcctctctcttatattaagtggcaagcagtaggctcttttccaaaggtttcaactgaacagatgtcactggtgcaatggtgcaagtacattaatgatgtaccttgaggtttacagatcataaaatgtgtggtaaagataaagcatgatctttttaaaccactatgattagtccatccttgtcactctttgagtgaacacatttgagctgtgtgttccttttagggaaaaataatatacccctgtttcccagcttgcactcatccattgtctatagtcctcatagccaggtcaaagatctgatcatttgtattcaattttaatcatccagtgaataatctctgctcttttgcacacatagtccagaggtaagtccaaggttttgatcttgatttaaaggtctaaatatagaaatatatttaggaatatagaatatagaagaaacaaatatagaagggaatatagaaaaataggatcatagaaaataaataggaataaagaaaggaatatataaaaataggaatatataaagtgttctagaaaaataggcatctagaaaggaatatagaaaaataagaatatagaaaggaatatagaaaaataagaatatagaaaggaatctagaaaggaatatagaaaaaacagctgtgtgctggtagcttgtgaaatataatgttggattaaccaggcatgtcatgtgtgatgatagtgagtatcactgagagatgagtctgattccccgaagcagctgctgttacacatcccatgagtgtacagtttagcactgctcccacagacccactgacccagctttattcatgagcaccgtagagatcatgacaacaggtaagtagttcaatgttccacatggctgtgcttatgagagatcatgaactatgggatccagtggcttccaagtcattttaattttaatatggaaatttccaaacatactcaaaaatacaaaaatagttgaatgaatctctatgcatatccctcagctccaacagttaccaactcctgatcaatcttagtttttctatactctgcctagtttccctatccactgagtaggaatcaatccagccatcatagcatttcatcttgtaatattttcctctaaagtaggaacacataggtatctctggaactatgtgtgcactatcttcaggacactgctgaaggaggagcaagaactattcctgtggttcttaaaattcaatacaagtaatcacacctttgatccacctgtggggactgatccctcttgtgggagcaaagatggggccatggtatataaaatataaatataaaactaatatcaatgtcattgtcctaagaaaaataaccacgattccttaatatcaagtcagtgttccacttccctgattgtcctacaatgtttcaccctgtctatgtgcattagactcctcctgaagttatggattatgaattgttgatctctttgggtttatttaattcataggttcctgccctttttcatttcattccaactttgggaataaaaaaattcctggggtttttctcctgaagaatttccacagtctaaattttgttgattatatctgtaggatcctttaacacgtttctctgtcttttatattccctgtcaattggtagttagatctagagcttaatcaagttcaagtttaatatttctggcaagactacttcataagtggcttagtacatttccattgagagatacctggtagctgcttgtctcttcttttggaacattacttgccactgataatcactgcctggatttactaactcatcagaggttgccaaatgacaatattctcatcttatcattacttcttcatttattgctgcagtgcttaaataaagaccaatttctcccatcaactcttggtgacactgagatatagctcatatagggaagacaagacatatgcatcattttttcttttccaaataataaattggctccctacatcctcccaaagtgattaatgagttgagtgtgtttatttaaacatagtttatatgtttcaatcctttgcagttgcattagtctgttctcacactgctataaagaactgcccaagactgggtaatttataaaggaaagaggtttaattgactcacagttctgcagggctggggaggcctcaggaaacttacaatcatggcagaaagggaagcaaacacgtgtttcctcacatggcagcaggcaggagaagtgccgagcaaaggggaaagccccttataaaaccatcagatctcatgagaattcactcactatcatgagaacaacatgagggtaaccatccccatgattcaattacctctcactgggttcctcctatgacacatggggattatgggaattacaattcaagatgagatttgggtggggacacagccaaaccatgttaacagttattttggtgagtactctttcggatgctcaaattgctccatctttgggcacacgcagcttatccagagtctgccaccctctagtagcttctgaatacctccttgctctttagcacgatgagattttccagtctcatcttgtaagttccagtctcacacatggaatcacctatttctccaagggagctttggtttttgaaacatatgtcttcaaaccgaacctacccatctttaatctttttaattgtacagcgtaagcagaaaagcaaagtgttatcttcaagagaaggatttaacatttaagtttaaaacaccttgctaaaagcggaattcagccacattatgggccacgtcatagttttccatctcaaaggtccttatgtccccacaagcaccatcctgagcagaaaacctcttcgtgatgacgcagaaggactggccagcagggtaggcactgtacttgaactccaaccccaaaaatcacagcaggattccattacaggttttgtgcaatgacaggtatgaccagtataaattactcatattttgtgattcaaatacatactgtccgtgtctatgttaggatagccttgaaactgtatgtttacacagttactttcacattaacccacatccctctctctggatacagtttccaggatgttcagacccacgactgaagttcccagcaatctctttttacttttcacagaatctctcttcagtaacttctgacttttagaagacgttatcactgtgtaaatgacctcatccttcacgacctctctaattcccacctcattctcagggtgcccattatagggtgcggagaaggttagaatggatttgaaagaatgtggttggattcaaagaagccctaggagacccaacaagtcagcatttttctcttgtgaaaagaaccacctgccaaccccagcctgttccattgctgacatcagaggatcaggtatatttaggagaagctaaggacctagcttaaatctacccaaggatgttccatattacagataagctaaattaactacaaactaagattacaccaatctccagagctttagtgagagaagggaaaatatgagaggaaaatagtatgacagatttgatccaacattgaaacaggtgcattttgagggttgtttatcctgtaaatcatctcagttacagttcacatggatgttactcatttcatgggtaggcaaactctgtctctgcctcacttgttcctaggcttccatttgccaaggtttctggctggcctctggctttgttgaagagatagctagcactagcagggagaaatacaggtgatcagagtccaggctctctgaacatacaaacagtataactgttgttcactaaatggaaaaatcccaaaatcaaaaaccaatgcaaaacagtgaagtggcttgagctcctaggaggttaggtagaaattaaagagaatcagtggatgggtagaattttaagcagtaggtagttacccaatgtagaacgaggattagcttagacacctagtctggtggttctcagcctttcagcatttgcatacgataacttttaaggcttacttaaaaaaaaaaaacaaattatgggtaagtctacaataatgatagcacaggcacagctacagcatgacagcgtctcacaatgtcttcaggagcatccacaatcatccactgaccccagagagcatgtcaaggatgagaactgctttctgccctggccacaccctctgttttgctcataatgcaaagttcttttacagtgcagtaaatgtgaaatttttctttggtattagttagacattattcctgcttgttacttgtagtgccctgtttcttgccttacacctggtcactaaccactcaattcaacttttcactctcatatgatagacaagtaatagtactgtgtgcaagtgtgaataatggatggagtaacaatgcttatctgaggatatggccattgccccaggtactgaatttgtgtgcttgtcaaaataaaaaagaatgggcaagtacttcagagtgtccacacttctggtggtagtagacttggtctattggtgagtaatggagagctgggattgtttctaagtaagcatgaactgctaatatctgtgataaattgtattaatcctctcagctattcacttcctctctgtaagaggattttacatcccattcccacccattgccagatgattgacagcagtatctctctgtaggcaatatacttccccacccagtgtcaggcttggccacctgacttgattgcgcccaaggagcagaagtggcagaatatcaattcagggcagaagctttgagaggcatcatgaattcctgacagccctcttgctccttctgtctgccacaagaacagcagatcccaaatcagtgctgttccttcagggtgggtctcagaaggagagctgcagcctggagcagagctgcagcagctgacctacagctgctgtatgggacatggccaagaaaaagctgtttccccagtaaactactgctcaatgtgtctgcatgtactacagagatttgggggtatctgttcttgcagccaaatctagctaatgcaattggtcatattactagttcaactgccagagtagggttcaacacattctttggtgatgcaggggtatctgattgtggtagattaaattactgtttggagagattcacattttccctcatttccaagggatgaaaatacttcctgggtctataaatgttgggcatggcaatgatattgctttggcctcatgataggtgcagtggacttcctgccctttgatgttggggttgaccatgagacctgctttggccaatggcaggttgctagatgtgatgcaatagaagcttgaaatgtgcttgtgtggttgggctttatctctgcacctcagccatcaccatgaagagaaaattcccaggcttacctatgggccccaaaggaggctgagagacattcagaatggagttgacctagcaaagcttcctcaaacctacactagcaggccccagccagcccacaaacacatgagataaatgaatgcttactattctatgctgctaagatcgatggctcttatgcagcattatttatcaatagctctgatggtaaagtgtcaacttgattggattgaaggatgcctagatagctgggaaagtattgtttctgggcgtgtctaggagggtgttgccagaggagattcacatttgagtcagtggactgggagaggaagcctcccctcaatgtgggtgagcaccatccagttggctgccagtgtggcttgaacaaagcaggcagaaaaaggtgggataggatgtcttgctgagtcttctagctttcatcattctcctgggctggatgcttcctgcccctggacatcagactccaggttcttcttgcacttacatgagtggtttgccaggggctctcgggcctttggccacatactgaaggctgcactgttggtttccctacttttgaggcttttggactcagactgagccactcctggcttcctacctcctcagcttgcagacaacctatcgtgggacttcaccttgtggccgtgtgagccaattctcctaataaactccctttcatagatatgtagatcctatcagttttgtccctctagagaaccttgaccaatataatagctgactgtgtcaacactgagtgagcagccactgtcactgtactgacctggatgatgcagctacacaggtagtaactgtggcagcagttttggtttcctttttactcccaggatcttaaaggcctttatcctaaagatccctctcctctgcccccaactgcccattcctcccgtttttgtatgggatatactcatagagaatagtaggttacagttctagctaacaagaagtctctgatactacagaactgaatatgcccatatttgttagtgatattttatcctatactggcgcaataaacccataagctttgatcgtagtttccttattttttggatacacttatgtattgtttatagtgaatctactgcttttaaaattaaacattagatgttatatcaataatgttcacacataaacatgcttgaggcagttcccatggtggtatgtttatgtgacatcaggaacggaatttgagctttccaattccaaagggattcctttaggcccatcatcaatataaatgataccattgtttgaaatatttgcaaaatagaaaaaattaaaacctcattagaaagtgtcttactgattttttttattaccttagttgtcagggagacttctagaccttaatagctaccgtcttttctataatttaatgagcagtcacacaaacaccaatattgctacagaaagggactttccagctttgggaatatctgtttctgacatttcctttcaaagggggatttttataaacataatttttcttcttccaaaagaggaaccacactatgattccaacttccatggagcccatcggggatggtggtatttcagttcaattagggtgctgtctttgttaactgttgtgtttagttgtgatctcagacttcagatttgaaatctctcttcggggaattcatttcaaaagatccagataacatagtttaggcacatggagtatctgagggcagtccagtgttggaatgagaaagattgagtctcaaaaacaaagaaagtctcaaaaacagttattagaaagaaagtcactgggaacccatccagcactttctcctgacagggctgtcttcctcctctcactttacaggatgaatggtgccaattctaccagcaaagccttcatctttaaaatgactcataaaaatggtaactgtagtatgtgtaccatcacactcactttgacttagaatatgcttgaatgcataaaaatatgtcaggacactggacatactcaacacagaatggaactttgtagccaataattaatttaataatacttcctattttaaaaaatagcctgagttctagaaatggtgtgtatttaaatggatttgtttactttccatgtctttagctttttgaaaacaagactatatcgcataaaatgagaaaactgttcatgctacagtgaaatagccataaagactgtaccagtaaacagttccatccacagcatgtcaagacccccaacttcctttctcaagcatggtgcccagcactcatttccttccccaaatggaaactcagcctggcattgctcaggtcagtgggctgtcattcaacaccgaaagatattgaggggaggatgttctcctacacctttaattgaaatggaaattcaatttaaaggtgctttaaagaatgagattgcagccttggagcaggctaggcagacttgtgggatgcctcatcagacagcagcattttgcacaaggaactatggtgagccagggcctttccccctactcacccaaactcatcttccagatttcctctgggaaaataaatcattgggccatgcctttatcaaaatgttaactatctctgctgtacaagttagggcttgaaaactattcgtcagaactgggaaaggaaagcattccacattatggtcccataaacttcctgcattcagtacttgcaatcaattctggtgtctaaggacatattactaaagagtgagtgtatttacagaacctaggacaacagagggactcaggcagtgtccagcagggtggccaactgtccttgtttgcccagggccggggagttgggagtttcagagctaacaccaaaaaaatgtctcaggcaaactgggtagagctgttccctccatgactgggtcagtcctcatctccccagttatgctcagaggaagattccaaaggtctacacttgcaggcgtcacaagtcctccctgcccatcccatgggccctgatgcctagaagaagacacgggattcccgcctggctggaggatgggtctgggatctgcttgccagccgttcccgggattgggggcaggttgctgagcctgtctagttgcctgccaggcttcccctttctttccgcaccccttcctccgcagagcctcatgtctacctggttcttcatctggtcctgagtccttgcccattctactgtggctctggccctgcttcattcctgcctgattcatcctcagaaggcaggtttctgtcctgtccctacacatccatggccttaaagcaagatgctgacgctgtcttgatggctggacctgcccttcctagagacggctgctgccaacccatttcccagacaagtacccaggccacagacagcagggccagcccacggaaaacacaaagcccttttttccctagctagcctctccatgtggaggaacaagtcctattgcttggtggagagccaaagccctttcctttctcacttactcttctctcactgctactgggatcctggcaaaccacacaggcaggtccatgtggcttatgacacaggagttccgagctttgcgacatgacattggcaactgctcagttatccgtgattagttatgaatctaaatgcgtgggcttcccccttttccttctcaaaggctgagcttccccttgcccttcaggagcaaaagtcttcccctttctactccagcactccttggtaggcagagaagcatttacttcttccctgcctaccctgagccccggcagtattacaaacaaaagtaaaaagtaaaacacaaggcaaaactcatcagccacacgggcttgttttattccattaatattggttgttctcttttctgggagttgtgtaggcatctaatttgattattttagttatgtgtccctctctaatagaaaagaggagtgagtttgcctgtcctttttccgtttcaagcgtctgctggggaagggccttctgataccctctctggaatccttccactctatcagtgtgagggaagaggctcagcttcttcatgtatgttgctcctttgccatttggtccattcttgtgttttcagcaaaaccagtttccacaatccaaattactgtgcttctcgactgtggataaatgagaaaatactcctctctgtgaacgcgctccttcgtggagacagtaatgagtacaacttccagagctctgcgcagccagcaaccctggcaggagtccctgtgttattcataacccagagctgtgttgccatggcagtactgcttgctagaccttggacccaccaggaaaattatctttcttcatgaaataatcctaagaagagagatgtggcttgaggagcagatgaaattcatttaaattccacagcactagattgaacattgatgtacacagatgtgcccctttgacatagatgaagctggaggaaattgtactaaaaagtaagtaagtgagaaaacacattgtcattcaatctcttgaggtcccatccaggaagatgataaaaaaggtatcaggtgctggattttcatggaatcaatcctgctttccctagaaagaattaaaattaagatccatctcataaatgggtggatgaacacctgggttgtgttggcatagcaacacttcttcatgtgggggctgatggtgggacccacccactcatacaaacagcgtgcggcccatgcaacacagagatggctagattacttggtctggaaaaaataagatggtcctgctctgttttcttttttctctgaatttggtgctatttgagagacggaaatagaatttcatatacagaaaggcaaacagattgagacaaagtctttgtaaggtgtctgaataaaggaggtgttaattggtgatgaagtccttttatcctttgcgggagaaggatttagatgatgttagggaaaacagccagaaccaagaatatttttctgctacaggaatcttttgtgtaacagcaaaactatgtcaccttctttttttttttaagttatactttaagttctagggtacatgtgcacaacgtgcaggtttgttacatatgtatacatgtgccatgttggtgtggtgcacccagtaactcgtcatttacattaggtgtatctcctaatgctttccctgcccccttcccccaccccgcaacaggccccggtgtgtgatgttccccttcctgtgtccaagtgttctcattgttcaattcccacctatgagtgagaacatgcggtgtttggttttttgttcttgcaatagtttgctgagaatgatggtttccagcttcatgcatgtccctacaaaggacatgaactcatccttttttatggctgcatagtattccatggtgtacatgtgccacattttcttaatccagtctatcattgttggacatttgggttggttccaagtctttgctattgtgaatagtgccacaataaacatatgtgtgcatgtgcctttatagcagcatgatttataatcctctgggtatatacccagtaatgggatggctgggtcaaatggtatttctagttctagatccttgaggaatcgccacactgtcttccacaatggttgaactagtttacagtcccacaaacagtgtgaaagtgtttctatttctccacatcctctccagcacctgttgtttcctgactttttaatgattgccattctaactggtgtgagatggtatctcattatggttttgattttctctgatggccagtgatgatgagcattttttcatgtgtctgttggctgcataaatgtcttcttttgagaagtgtctgttcatatccttcacccactttttgatggggttgttttttcttgcaaatttgagttctttgtagattctgcatattagcccattgtcagatgagtagattgcaaaaattttctcccattctctaggttgcctgttcactctgattgtagtttcttttgctgtgcagaagctccttagtttaattagatcccatttgtcaattttggcttttgttgccattgcttttggtgttttagacatgaagtccttgcccatgcctgtgtcctgaatggtattgcctaggttttcttccagggtttttatggtttcaggtctaacatttaagtctttaatccatctcgaattaatttttgtataaggtgtaaggaagggatccagtttcagctttctacatatgtcaccttctttagtgatgaacatggagggtaagcagacagggaatcctggatgttcttgttaacacattcttgtctcctagccgctgtaacctcagccctggagttgacaaaagaatctgtcccagtgggccacagatcctagggactatggagttattgcaaagatccacaaaccattagcaaccaagccttgtctgttgaatgaattaatacatcttggattaaaaaaaatgtactttcttcagataaaattaaatacagttagaattaataaccaataataaattgaaaggtgttattaaatcatagtaaatttgtgtcattatgtggtctcaaagaacagaagtgaagagcacaattcctgtcatgtgggcaatctttaaatttttttgacattaatcagacatcctcatactcaaaaaggatgagtcactgtaagcacaaataaggtgtctctacctgttgctgagagtcttgacatacataaacttcatgacaacaacttctaggatcccttcatttctttcattcaataaaatacacttgagttcattatatttttatcttccactgaccttagggacaaattctgcatgttaagtagggtggattgagtgctgtgactcccaactgcctactgtctctcaaaggtgaataggatgggttgagtaccacggttcccagttgcctgtctctgaaagatgaatcttggccttttctggcttacatttcagagccaacacatgacaaatagtttagatcttgaggaagactgaggaaggcttatggaatactcagcacaattatttttatggcacagagtgaaatagagattgaatacttacacacgttttgattagtatgtgtgttccaccaggcttacacacttctctttgagatctgatctagacacatttttctaaagacatttcaggtattccctctgcagttcataacagtttatgcactgcattgatacaggctgctctcaagttagcaggggacaggtttttgatgtcaactaagtgaaatatagtatcaacttcatgtagggttgcttgctgccatcccctttctttccacaattctgtaaacaacttggtacattttgttgtctagaaatagccaacctctaaatttaaacaggttgagtattaaattattgcagtgaacattttttcacattaaaaactgaatcacagaattcttatttgatcaccacatgtttagaaaaactattttaatgtcactgacatgaagttgtcccagaaacgaaagggtatgggtatacacaatgtagcagtcatttatcttcatttgttcctccatttattcagcagatagttactgggtgctgtattcaaggcatctatttttaaaataacctctgtgaaatgttcatttcaaaaatgtctccccagatgcattcaagatgccttctattttctctaatcctctataattgcttttctttttccttttttctttttgagctgttttccttctctccctcccaataataggtctttatttaactatacttattttcatcatataaatatgcacaatataactaaacacgaagttgaagaacatgcatataagacatgtcttatatgcaatgtctggaaatcactacagtgtgttttaattttgattgatgtacacatagcctttcacattgaaatctaggtaaggtaagtacagctattaattatggaaactagtctatatatttgttggaatatgataaatcaagtcaccgttcaaagttgaataaatagtgaacacaatataacattaatgcagattaattaccatggcccagagaccagccatgagacataacatgcttcgctgtcaacaacattcaggattggaattccagagatggcgtgtgctactggcttatggctgatacgtaagagaatctcatctatctctaaatgttctgccttaagccgcacaaaggacgtaccagtgaacaatgagttaccatgtgcagaaaatattctgcaaatcaagaaccagaaaagtaagcaacccgcaaactccaaaactcattacatgattgtgatctttattttgaggtgcatctaaactgatcttcaaactcttcagctatacctgactttctctggaatacttctcagcattttcaaactaaaccaaaggctttctgagttacataaggaaggcaaaatttggatatttgacaaatttggaagcactgaaaatggaggaaattccgagatgacagtggttttggttcttgtggttcttgtggttttggttcttgttttttgaggggtgcagagttgggttacttaagactctgtgcatggctcaggcatcattgggctgtgcaacactcgtctcatgtcctacttgattttcttctccctttcctcctctattcccactcttccctcggcaggttcccactctaatgtgtctgatttatatgtttgctattaatgtgttcttatgaagtggagtgtgctgtgtgtattcaggtgatataaatggtattgtgccactccagatcttgtatttcttactttttcactcaactatgtgttttaagtgtctacccaacttgttcatgtgtgagtgcattgcttccaactgtcgtgtgattttcattaggccatacctgctgtgtctctggtctccatcttcctaatgatgggcacctgggttgccttcagtaattgtgatcggtgttttcatacatgtccttttctgacctgcgtaaggctctccatggagttcaaggcctagaagcggatcccttgggtcctggtgtgcaggcaagctttggaccctgaataacgccagcttgctttctgtgtctaccgcactagtgggacttgtgggtccctattgtctacatctagatttagtatgctccagtttcctaatttttccagccccctcagtgctttaagttgcacatctctagttactggagattctttgtaccttcactggagcacttggaaaacagaagaaatcaaagggcagtcaggactctcccagcaggcagggaccaggtcagagtcaggatgaagacaaagcaccctgagcaagaagcaatggaagagatgcttgtgacccgagctgatggggaaggttgagggcaacgcagagaccccactgccgacttgccaagaaaacgtgcaggaaatgagggaaggctccattttcctgagaaaagggatggaggaacataggcagcatcaagctccagctactggctctttgagaatgtagtcgggacttgccccagtcacccttgccctgagaactcagtgactggggctaatgtcaccctggctgtccttgacctgtgcagaaagcactgccaaccctggacagtgggggaagggccttatgtgcccaggccccagcaggagacacctaccaggaatctagtgggacaaggtttcagggatcctggaatcctgcccacacccaacagctggaacagttccctcagctggcgagtggacaggtggtctgatgagctcatatgttattgatgatgatgttaaagaccatgttcccatagaaataattcccaaagcattcagaagactgagaagaagtgatgataagaattgttctgggcaggagtgtgtagttttgatttttacttgtgataaagcagaggatttgcttgaattcactcaaacttgctttttctctctcttcaaaacaactttggctgaccagtgtctcatagacactcaatttgccttttcatggaactcaaaattttgtgtatccatacatgctaccatagtttcaggcactgggcatttcaaaaatgtgatatttagaacctttctatttccgtgatgactgttggcatagatgctgctggagatttcgatgacatgttggattcagtccacgcaagttttgatgcatattcccttaatttctgagcctttagagttagagttttagaactgagagtacattctcttcttttttcctttctcctcttatgtcaacaggctcccttccccacccccccacccacacacacaaacaaaaaataaaaataaaacgctctcagctttgcttttaagaaatgaagaaatgttccaacatgtgacccacagctgcaatccgttcacctttgccaatactgaggctgccctctgggtccctcctgggactgcatagatagaggcccatttgctgttctgggcagcatgcccagtcatctaggaggtgggggactggggcactctttcaggccaactcaaactaatggaataaaatatcttctccatgcagtgtctcaaagaaagagccacctgggctgcaggtgaccagactcgctcagtgcagcacggtagctcctagcctcatgtgcagtcaaacacatgagatgtggcaagtctgaactgagatgtgctatcaagtaaactgtacaatggatttcaaagatttaataggaagcaaagagtatggaacgcctcatgaataatttcatattggttacaccttgaaatgatcatgttttggatctattggattaaatgaaaagtattataaattaatttcccctgtttctctttatgttttttaatgtggccactagaaaatgtaaatgtactcgtgtggctcacattatattcttactggacagcattggtccagaggactgggatttatttttaactactttaataaacatcaaacatttgtgataattttaatacaaatatttccccatcgtatatgctcttgcatggtaaatattttatctactcttgttttaaaggataaggaggttttcaaaaattgccgaagtactacaggtaatttggcaaattctcttttatgggtaccagatagtgctatttccacccagaagctggctacagctctgtaatgtgacatgcttactcctggctattctgggctggtcctcgtctgactaatgagctcattatccactgggcagtgggatggaaggacatgagcacctcagctgtcactgccgagcttcctcccagccccaccaggccctctggttcctgatgcttgtctgtaagaccaatgggtactttaacttttgaaggtggtttctggttcccccaatcggtgagcccaaagacctcaaataacattttattcacacagacttcttagagatgaaaagtttctagagagcagagcctttagggaactagtgatgatgcattcactgaataaatcacagtattatactcaagagcaaatacgttttctttcttattggtgtcatctttccttgtgaaatacggcaactgatgaagaagtctcctattgagaataaccagacgaaatcacaaggctagacaagcagctactaacaccatccccttccccctgcccatggtaaaccctgctggcaaatgtatttctccctcctaaacctgggaggactcacgtttctgcacccagagccccaggtggaagtaaacaatgggagtgagccgatgaggtgggattgctgttccttgactcttagtgcttctcatgctagtctcctggggatgcagttaaaatgcagattctctctctagatctggggcggggcttgttcagcaggctcccaggggagaccaacgctgctgacttgtgggtcatactttgagttgcaaggttgcgtacgtggtatttgccagtgtgcacattcatgaaaaagtatcctgccttaagcctggtagatccacagttccaaatcaacattaaatacatctggtatacttaagaaaattcaacataaaaagaaatccatttcttaaaaaaaaaaaaggcagagcaaccattctttttatctgaggacctttaaaagcatctgcctttatgtgtcacagcattagctactaattactaaaggaaaaagtgctgggtgaattatcacctgaaaataaagtaactctcaaatgttataaaacataagattaatgttgacagcctctgttactatgacatattgtgtgccaggtgtgtgtgtgttataggtgcatatatgtatatatatacacacttgtatgtatctgtgtatatgtacacatatctatgtatctatatagacagatgggttatttaaatgaattttcaaaacactaataaggtgtgatttgataaatgaataatatttaataataatattaaaataatatatttgaatattattattctcctgctactgatgagaaaactaaggctcaaacagtttaagtaacatgctagtaaaaaaatgttctgagtagaataccacatgtctggcctaaccctgactgtcttttttctgacccgagaccagtcctccacgtggggagctctgaacaccatatttataacagatggttatttataatgtctttctcttctttggcaatttaaatgaagacgtcaacttgaagaaatgtttcaccaggaagaattgcaaagagagctgaattaatcaaagaaagacgaataaagtgttcttttaatatggagtacataattgttgatggaaaacacagtcttggcagaattaaaagataatcaaagagatgaatagggcaaatagcaattcagctcattaaataaatacaaggaaactaacctctgcagtttaaccttgagcgataccttttcccatgaatagagagtgtcgatactaggcaacaagcctctgaacagatagtgttacccggaacatcacccttttctccctttgcttcaaatcaaaaccagcatcccccatttagacagcataaaaggtatgacaaaacgggacgccaagtgagacactgttgattctgtttctatgaaattctagaaaaagcaaaactgtcatgacagaaagcagatctgggtttccagagcccagagtggggggaggggactgacttcactgagacacaaggaaacttttggggatcatggaaagggtccgtaccacggttgtggtggtggttataagactatatatttgtcaaaagtcttcaaagtgtgcacttagaattgctgaagtttattgtacataaattacatgtaaatatcataaagtgcatgtaaatggtatgtgaggtaataaagcaattttttaaaaacaattttaaacctggtatagcattttgtttttttgtgtgtctgactcagaccaggcaaaatttagtaaccctttggcaacagaaaatcagcacagatatagagctagaagttattgtaaaagaataatagtggcggccgccacggcgcaggagttgccaagattttcctggatgaattccatccaagatacggttttaagtctctcaaggcctttggatgcctagaaagtgggtcatctttcagaatatctgcgtcactgtggagatgttagtaaatcaaagaccagctggatttgtccttaaatgtagcaaaatatgtacttgcttggaagtactcttaatcctttcattcactggacagggaagactggtttcacagtcctgactcccttcattcgttatcaacacctcgtattttttttttggtagatgatatatatgaggcagtaaacttgtggtctggaaaagcagagatcatattaccactctgttttaacttctaaaagtttgaaattaagacttataccaggtatttttatggagtggattggagtatagaagcaattattttaactatttgctaaaaaaaaattgcctaaaatattcagttattaaaggaaaagcattgttctggattggattcttcagataattctgcttttggcaacaagtaacagaaaaccaacttaaataggtttggacaataaggacattcactggctcgtgtgtctggaattctagcaacagcagcattcagggttggccagaccaggatctcaacaatcttattaaaccatggttttcttctcctctctccactctgttgacaggatagcttcatcttaagacttgttgtctcatcagtgtaagatgactgctaagttgtatgtgagcccacaatttcctcattcattccttgaaggaagaaaaaagatttcttcaggaacttctgacttaaaagcaatgaaggactttcccagaagtccatttctcattggcccgaattgggttgtatgcccatttctcattggttcaaattgggtcacgtgcccagtcactgacatggaggatacgatttccctaaactaatcaggcctcccgctacaactagaaggagactcagctcccacaaacatatgaattgatggtgcgggagagtgtagtgggaattctgttaggaaagagaaggaagtcaacaatcgggtacgctgtgtctaatttaagtccatgactttaaaagtgagcttttttttttgttacaaaaataatgtaggcttaatttttttttttttttttgagacggagtctccccgacacccaggctggagtgcaatggcacgatctcggctcactgcaactccgcctcccaggttcaaacgattctcctgcctcagcctcccgagtagctgggattacagatgcccaccaccaagcccagatattttttgtatttttagtagagacggggtttcaccatgttggccaggctggtctcgaactcctgacctcgtgatccgcccgccttggcctcccaatgttaggcttaatttttaattttcagagattatttgtagctgaaaagaagaaagtaattaatgaaatgatacggcatacttttaaacaataaatatcatattctacatactgcagacacattaccgcataatggttaaaaatacagactttgctatcaacctcctggttcatcttcttactgtctgtgtgtcctccttgggtaaggtacatagctttcctccacctcaacttctttctctctgtaataggaatgatagtagtatctgtacaagttgctccagcactaagcctctcattcaggggtcagcaaactacagcttgcaggccagacatgcaggcaacctgtttttgtaaataaattttattggaagccatttatgtatcgtctatgactgttttcacactacgatggtaaagttaagtagttccaacagaggtcttagagctcacaaaaccaaaaacatttaatatatagccctttgcagaaaacgttcgccaacctctaggttaatacataagatctttattttcttgtcaaaatctaacatgtcataattctgtggtcattgagtgactggagatctgccagagaaaggcaattatctacagagctaacatgaaagcaagagatgctcctttattttatcacttaaaaacagtgaagaatcatgaacaactgaaaaatctacaaatgtgtttaaatgtcaaattaggctgggcatgatggctaatgcctgtaatcccaacattttgggaggcgaagtcaggaggattgttcaagcccaggagttcaagaccagcctgggcaacacagcaagaccctgtctctactactactactactactactactactactactactactgctactaataagccaggtgctgtggcatgcacctgtggtaccagctactcaggaggctgaggtgggaggattgcttgagtcgggaggttgaggctgtagtgagtcatgattacaccactacactctagcctaggtgacagagagagaccctatctcaaaaaaaatttttttaaatttttttaaaaagtcaaactatctacctgaactgaccagagatcttgaaatatgtgatgtaggatttcccttcaactctgggatgttggaactggaaacttgagtgagagtgaatttgttcacactcatagctagtggatagaagtcatagctctcagcagaagtctgaagaggaaataaaagagagccagtaataaattgctgtgaatatttcttttgaaaagcaaagaaaaaagtattgccacctgtgtgtgctgaatggacagtggtattgatatgtagacaagggatcctgtcagggaatccctggagagagaagagtctgagactgacactgcccggcagccccaagtctgagttgtggaaaagccctcagtaaaaggaaaaactcatggcaacgagttggtggtgatactttcatggaggaacattgtccttgcaggacgggtggttttaatcctgaatttaaagatcttcaaaatctaaattatctagtcaaatttttttcataaaacaatgttttaattaaagattcagttttaggtcaagtgcacagtgtctttctttaaaaatatttagatgtggccatcaactatcaagaatgtttctagaatgaaatatattcagcagtgctgtgtggggatcaggaacacaggctccaccaatcagttgcctggtttcaattcctggctgatttacctgtgtactattcactcctgaaagtcctaagccttgttttccttatttatagaataagattaacagaagtactaactttatagagctttgatgagacttaaaataatccacgtaaagtgcttagtctagaatctaatatcacacactccataaacactagccattttaatgtattaacacatagaaatgaattgtagaaaacattttggcaacaaactataccataatatatatttgtaatctatggagttcctatctttcacttttgatattcctgtcttgttttttgagcagcaaaggttaaggtagacacagaaaaatccctcactggggtcttcaaatttagaaggttagctcaggggtcatcttaatagacattatattagttaagatccaggtcaacttgctaatgaaacaaggccccaaaaatacagtgatgaaaaagataaaagtgtctttctctctagcacacgcacacagaggtgagcagccaagctctagtgaggcagctctactccatgagttccatttatcttgcatctccaccatcgcctacacaggtggtatggttgaagctcaccagcatcttcttccagcaagttattacctttttaaatgcagagacctagaacttatacacatgacccctacaaccacctcattgctgaggtcttaatcacagtgccactcacagttgaaaaagaggatagaaaaaatgactgtcactaggctgccatatgcccaactaaaattctacgtattctcaaaagagggaagggaagcatggatggtggaatccatcagcagtcttccacggcgattgtcatggaaactattgttttgttgactctagacactattgattttaagacacatagtcattttatgtaccactaagtaaaggaaaccatgttgtttaaactgggacacatttctttcttaccagctcagttgtaggacaccttccaattaagagatgttaaaatgtagaaaaccaatgtgtcttggtatagaagaaatacaggattgtgaagactttggaaaagaaagtgaccaaaggcattcattttgcagtctacttttgtgtgtgtgtgactttccttggagcaaagataggcataagatatcaagctttggttgatctattgaatttactgtttagaatctgtgattgacaaggtactatcagtgtgtgtatgctctaagtcaaattcctgtgattactggtagagagactttagctcaaagctttggggaaaatgtgcctagattttcattcaatctgggccaaatctggagttgtacaaatagatagcatcggtcttgtccttagtagccagcatttttgtttaataggaggagagaaacccaggacgacactgaggaacagatatgaccagggcacttgacttcttgtttcagcactcagtcattacacaaacagttgttgaacaccaggcactttgcttggtgtgacaatgcactcccgccttccaagagctccagacccacaggggagtgctgttgtacaggtgctaggatagaggtccggggagtagaggcagaatttgggagccatcagttctatctgaggctaggaaaggcttcccaggggaggtaaaatcaggactgaggaggtcaaagagccctccatgcagaggtaagagactgacaagcacaggaaactggagctgcggtcactgcagggtatcatgctctgatgcttccgcatgttagactggaggcaggatgtggggattggggggtgtcctctccagcttcgcttttttcagtgttttgtatgtagttggccaatagcagtatttgttgaattgaattgaaaagaccagtttcttggacggccagctagagatgagctgaatttttctggatcaaaaagatgttagattacaataaatgggcaaaagcaaaataatacctttggtgcttactcttaaacttaacattactctattttgtttgtgaaagtcagatttgaggatttagtttataaagaaacccttaattggttggatcccacttgcttcacccaccctgactctcatttcccccaatgtaataaatgtgcatatgtatttagaacatacagagcagtttaacataaagtactgaaattatcctaagaacagattctcagtgcagcaatcctatctttgtgaatttgatgtgttctaaatgcaagagcagaagtgttttaattgtcaggttttaagatattatgaaagcccctagtcacttcagtaagatcatttgattctggttaatgacaagtctatactatgcaggtttttttttttctgtctattgctactgaaatctgcttttcttatatagatcactgttacagatgaggaagttagtaatccatcctttttagatctggtgagaactccccaaatgaggaaatgcacacttattcttatgtttgcttggtaagtttgacttgtgatggatttaaaagcttgcgttaaatttacaatacatcccttccttcaaatcagcttgaagttatctcttacttgttctctggtgtctttcaatgttgctacaggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaaggtaatcttaccccacatctgtttggcagccaaaggacttgaaaacacctaaatccacaatcaagtatagggagccacttgttcttaggaaatgtgcaatggaatcacagtctttcgtgatgtcactccattttctgcttaatcagcataaaaacttcgaagtaagagattggttctgtagatgattctcttttctcaattgctaggatcatttatgaatgaaatagatattgtgcccaatctagctgatagcgatgtggtttctgttactcatctttatgtgacttacttttgtgatatctctgatgtttaacttatttcctgaacctctgccatgctgctggcaccatgctaaacgctgaggttacacatagaagaacgcagtcttgacttcgaatggttcacaatctattaagggatacagatactttaatattgtcacgattcttattgtcatgaattatttgtgagatttagaaactaattaaactatttacaagatttagaaatataaaaaaatagattggggaggagtgatcaatccagaaggggattcaagaaaagcttcccagcagtgggaactaaacatgcgtgaagactcaaatgtgccagatatcagggagagagaggacggacgtttccaaactagagaagagtttccagaagtatgaaacacctttgtgcatgcaggaactgagggttcattgctgtgactggaatccagacaatgagcctgagagatgatctgtcaccagcatgaccagccctgcaggtggtcctgtgagcttgcggaggaggaggagtgagtttggcataactgcagcagtttagagatggctatgagcagggggagatgctgagagcaggagttacaattggggcagtcagacctagatgagagagggtcatttcatttcagagatgttgcagagttaaatttttcagagctccatgcctggtagatggggtgcaggccagaaggaagcagagggtgccgtgactcctgatgtgtggtgagcagcacccagaagatccttaccctagaacacaccaggaactgggaggaggagggcttcacatcccaggggatgtgtgaagtagagcaagttcatcattcccctcttccaggaaaggcaaagtggggattacagagaaagctggattctccaggcatcctttgtgtctgcacaaaaaaggctgtctttctttgagaatcctctgaggaccagccaagaaatggacaatatagtgggagtcagaacagtcagacatttacagatgagtttattaattaaatgaaggtttatgaattcttaaaacacgaggtaggccctatttgaataaaattacaggaatgccaatattcggaacacacacacacacacatacacacacacacacacacacacaatgtacaagtcccctgacatgttggaatgtttgatgatgaacagcaaccacctatttacatttctcttgttttccttgagtgcattcgcttcccagggctgctgtaataagtaccacaaactcaccggcttgaaacaacagacatttatgctctcaggggtgtggaggctgggagtctagaatcaaggcatccaagggtgcttatgtccagaggttctggggaagggtctcttcatgcctctctctggcaatccttgcagctccttggtgtcactcctatctctgcctccatattcacaggacattctcttctctgcttgtgtcagtgtcaccttgactaattacatctgcaaagaccttatttccaaatgtagtagccttgaggttccaggtagacatgaattttgggagacactgttcaacccactacatggaattaacatattataagagttggaggatctgtacaatagctatctcttaatacgtatctatttagtatcgactaattgccagccactgaactaggaggggaatggagaggtgaacaaaatagacataattcctgccctcaaaattgtataatttaagaagagtgaaaaatcgcaaacattggagacgttactgttctattttactttggtactttggatataacatacaactgtagctccctgagatgaagtcttctgttctcatcgtatgtggactaggaatgaatgaaatattcattgtatatgaaattagaaatgcagcgagaaagatgcatgctttggtgtgtcccctcatttcatgatatatatatatactttactctataagattttctctggtcctagattgattgggatgactttaatgtttgttgcattcagaatgaccccagaaagcattcaaggctgtgtgtccaaatcaagacagaagtaactagccggatagtcatataactattttgtagagaattctttcatatattggaaaatataacaccaagaacagactgttctcccttgtctaaccagttttattttatagatataatttcctgattgaagctttagaattgttctcagcaagactgaaaatgaattgctcttattctagacacattttatttttaccttctgcagacttggctgcttttatagtcatatgtcagtcatgactgactggcaagaatacatttcaaatccctaaactgagttccaaatattaacagacgatcctcccttgagtccttccaatttaaagacccattggacttgattccagccactggttaattagcacgagaaaggcttttctgctcagccattcctgacgtcagtagtaggtcgccagcccctggggagaatacagatgagcttttggagaaaccagctctaaaatagtctcacagcaaacactttaatcagctttccctccactcgacccaacttttcatggtctaaagaatggaattctggaagaagaaatagtagttctggttgtattctcatctcagactcactgcttctagtccaaatttcttaacactcattaatgtctggaaaataaagacctttctttatccatacctgtctgccatctttaatttgagtttatttaggatgaccacaaacctagcagtttggataagtcgtcttcttgaactggaaaacttgtcttccacttttatttttctttaattgaaaagtgagttcatgtatcttaatttagacatttctactagaatttctcactaaactttatttcagaactcagagtagatgatccattcagaggacatataaagttttgtttaagtcctgcatcctttcttcaggaattgaggtattattcccaatcatctctagtagcttgaccaaatccacattcagaagaaaacattttctttgttctcatgtaattccatggaagacaattttagtttcagtactcatttttaaattgccctgtggtttttgtcattgctaccaaaagatgtctatggccacctcaaaatgaatttagcttattactggaatcaagaatttctttgtgtgtatatatttattcatacttcctacagttttcttttcactctttagttaatgaaccatgcaatgccttagaaacttttctttggttacacatttcaacaaaatctctgttccagtatagtttgatactggactctactgcttggaaaagagttgggagtctttcagattaaggtcaatgttccggacagaccacatctccacaaatggggcaacttggcattttctgaatgttttactgaattgactggctatttatctgagttaaccacatatgtttatcatggtggagtgtgtgtgtgtgttttaatttggtctctggcttttgtttggatttttccatgaaacaccttgcctcggttataaacccaaattgcccttgaatttgtcggtgggactcaattttagagcaatcttgatttagtgaaaagaaacatacaatggaagaacccaacctggatagtgaagctgtttcctaggtagcaggcagccttcactgcagcccgggagtggcaggagatggtcccatcgggctgggacccagggaatctgagtctctgctcccactttccccttccagtaccacatgctcattgaaagatggagtggaatgcattacctagtctccactccccccttttcttggtcttcataaagaagcaaagcctaaataacacatgttgacaaaccttctgctccagagcagacagtggcccagcacatcagcacaaccctggcctcctcactgcctgatataaccgttaacgtgacagctacaagggttctcatgtgggaaaaacatcaagtgcaccaggatgtccttggccagtttgcagtcaaaatatgtaaacttcagactcccagaaatggtttggattcttgagccatcttttccttacacctgtgctcctgggcaattgttttatttaatgaattttagctttttttttttttttttgacttggctattctctagagagaacacacagaagtctactgggcttgattctcttctttcatcctcctcattcatttctactaaaaaattatatattcaggaaggttcaataattcccctaggaaacaggaggactatttagtgctaaatgaacatatgtgttggatataaagggaaaatgaaaggcacatgaacactggacatgcttcgttttgctttggagagcagatatggtcttgttcatgcagacatatgtcctcaataccaaatcccctaggaaaggatgacatcaattgcacaacttctaggaaagctagagcagtgactttttagagtaaaaatggttaactcctctgcccttaaaacataaaagaaagaaaatatttaatatagaatgtttggcatttcccactagttagtagggaggaaaggaaaatttcttcatacaaccacagcagtcctaaaacagttcattttaaaatggacgaaccaattagcattgatgaatgtggctccttctggatggtttattgaaggaagtagtacaatgggggatgaagaagacaatgagtgacatttgccttagtggtaacacacagaatagatgtccccttccaaagatcctggtcctcaaagcttgctccactctagaaaccaaggtcagctcacgtgaggagctccccaggtgtgctgggaacggctattccttgtgtcaccaccgcaaggtatgcacagaaaggacagctgggcaccagctgtgggaacgtggtggctcaaaggcatgactggaaactaccacctggacaaaaagccagtgtgctttggctctctaggaggtcattgcctggaacaatgttccaatgtagtggctgctcatgctcaacaaacggttcttgaattgtacttcctataatccaacctgctcagaaaggcatctagcgctctaaaatattagctatcatctagtttcattgttgttgaaatttggttacattattagaaagttctatcatttgtgcttaaaattggcaaagacttcagactggaggccactaagcaaatactttttgttgttctgtaaaatgttaatgaaatcagacccctaactcctccctttcaaactttctgtgtttgcaggaatagcatggttgaggaccacagtggctacattgggaagactagggataaccatggcctttgaaattgtttatttggtaaattcagaattgtacccaacaacattacggtaattctaacaaacgttatagtttctcctaagtaactctgtagaccagcgttttaagttgatttagttaaaaactatgaagtcgtttccttagctcagtgatatattagcctaggctgaatccagctagtaaagaagatatgctttgagttatcactgctttctgcattgctgcctgctgcattttgtgataaaagtatttctcatattaatatcttcacacactgttacggttttgaggaaaggcccttaacttgaaaccagaagacctctaggtgcccttgcttagactgtgggttaaatctgtatccatcagcatcacctgctgcaagactatggcctctctttgactgcattacatgcattgcagtggtgagcagctggttatgaaggatgaaatgaaacagtgtgcacggattagtgcaaatcaacctcctctgctgaggaagcattccctgggcacacttctccctcagatgaggaaaccaaagtagcacaaagtgacccagagcaggcagggcagtgggttgctgatggataacaccctccacccacgctggagacttcctcactagccttactgtgaaacgtgcagaatggaaatgttttgcttagagttctgagagtagtcgttttcaaagttagaaaatgcaaagtatcttcacacttcctttggttttttaatatgtctgaatatgttgattatcttgaagtcacttgttgaaatagttttcacttaaaattacttttcattcaacagaaatttcggagtttcgctctgttcaggtctgtgtgattttgggggaatcatagccccatttctgctctttcggctagcagccgtgtggctagaactacctctgatcatctttggtaagaactcatttgctattcttaagagccttcatctacattctttgtactaaaagagacctataataattgttaggttcaataatgataatgatagtcatttatcttattataataactatttcattgataattatgatattaatttcatcttattataataactatttcagttttgagagccaattcagttataatgaatggttttaatttactttatattaaagggtgctgataaataatgttcaattagcattctttgggttctgagttaaatgctatgaaactcttatggtattggagaacataaccaataattttcaggggactaaattaaatattcaatatgtttaaaaatgagggccaggtgcagtggctcacacctgtaagaccaaaatgggaggactgcttgggcctaggagttcaagaccagcttgggcaacatagcaagactgccttgacaaaaatttaaaaattagctaggcgtggtgatccatgggtgcctgtagtccaagctactcaggatgctgaggcaggaggatcaaggctgcagtgagctatggtcacgccattgcactccagcctgggcaacagggtaagaacctatctctaaaataaataaataataaaaaataacaaaaataagcctaatgtctaattgtatttctggtgttctctctctatggatatcatatcttcattggcccgatgctaaaaatccatgtggagggagcaggtgacacaggatcccgggcacacattccatcacctcctccaggtccctcgagtgcacctctcctcctacctccagcttccataggacttgtgaaggaacagaatcatactctaggagggaccttggggaattcagtgtcccacttctccagggctgctccaacggtcctgcctgggtttcacacacttcccctgtgccctcttctgcagtaaaggatacgggttggcccctttctcacgcaaccgtttctctatctccacttccttacttctggtagagaatgtttttcatttatggttcagcagttgaaatttgaatgaaaatactgagcccatgaggacagaccttctgcttcatgcaaaagtcctttgacagtgtgagggacaaagagtcggcttctaccacttgacaccagtgacctcaatacaggatcacctcaaattattgtatgggatttggtcatcaagctgagtgttaattctgtggtcagcatgaaaaagcagaaagtgctactgtccagcaaagacagagtagtccaggagacaagacacatgaccttcaggactgcagcccacagcccagtggcaggcaggcggggcctgagactgcgaggggagacagccgaatttctaaaaactcagcgacaacagaatgtgataactgctgagaccctgaaagcagaggctcctatgagaataggtcacagggacccttgacccctgagtggaagggagcaggccagggaggaaggaagcaatgtctaggccaagaggggctggctgtgctccaggcagtggaaagttcaaagcaagaggatgccgcatcctcaagcacctggtgctagaggatggagtgcagttgtgagctgggcctgaagagaggtggtgccagggcagggcagggactggatccggaagggcctcaaggacatgccaaggctttgctctttatacacacagcagtggaaagtgactggacagtttcaccctgaggtggacagagctggccttgcattgtagaaacacagatatgcaagtgggttggaaggaccccccagcatcgtccctctgatggtagatatgcaagtgggttggagggacgatgttgggggtgacaattcaaggatgtcatcatcaggagatcacagtggcttcttctaataaagggatggcaatgggaatggagagggtggacagattgagtaaacatcttagaagccagctgggcaagatgggatcactgatgggcacagggagaaagcatggtgacctgagaagcccaggtgcctggggagaagcaggtggcacaggcactgtagcagcaaggctgagggtctgcagggtgatggggctctgtgtccgctgtgcataatttgaggcacctggaagagttcaagtggaaatagaaaccagcaggctcaacaccgctgagctcaggagggaagagtggccttgggatgaagagctggaagccacctggcagtagagaatggttgaagctgagggagtggcccaagccccccagaaaatcaggacaaagcaagaggaaagcaggaggcctaggacagagacctgaggggtggcaaagtgacagacctaggcagaaggagaggaggtggccaaggaagtggaaaccaagtgagaagcccgaggcaggagggcacgagaccaggtccaacctaaggactgaaagtagcacatgtggatctggtggccagcaagaggcagaaggaacctgactggagcagagccagggagaatataggctgagtctggaggagggcaggcagaggcaggacctggagcatggtcctatgctggtgctggcacctcccactcaccagggccaactgctaccatattagttcgtttgccactgctataaataactgcccaagactgggtaatttataaagaaaagaggtttaattgactcacagtttcacatgactggggaagcctcaggaaacttacaatcatggtggaaggggaagcaggcacgtcctacatggtggcaggtaagagaagagcaaggaaaattaccacttataaatccatcagatctcatgggaactcactcactatcacgagaacagcatggggaaacctccccaacaatccagtcacctcccaccaggtccctccctcaacatgtggggattacaattcgagatgagatttgggtggatagacagagccaaaccatatcagctacattttcaagaattttgtaagccagtcatcaagcacagatatcatcaaaaagtaaagaatatgaaatatatgagaaatagaggcaataaatgcccaacactcatcagtccctaattcagctactacaccttcagtattacctgtgctcctgagattgtgtctgctgcatctttatggtggaagccccattgatggggctcctgcatcacttcccagtggcccaggcagggatgttgtgtcagtagcctgaagggcccacagtgggagcatttaaaccatgcacattggcagatgctgccaatcagggcttgattgcccaaagagggttgttaggcatttaccagcacaccactaggctacaaagaagtggagaaaataggggagggtggcttttcaagaagtttggctctaaagagcagaaaaagaaaggatggtaatggaaggatgaggtgagattgagagaaggctggtcaaacaggaaaggtctgaatgtgtttgaaagcttctcccaataggttgaagatactggaggaagggttgatccctacagtgaggagcccaaagagacaggcctaggagaaggctggtcccggagtagacaccaggacaagctttccactgtaaggtaacaggaggaatcggagggagaggggcaggtaagtgagagtgtcagtgagcgggcgcagaggggactcccctccagcacttctgtttccctgtgatgcaggagaggaggccttgggtgttggaccctaagaaggaactcagtcaatcactgtgagatgtgtgagtgaacacatggctgccaggtatacaggggccgtggtgctactcagggtttgaggaagggagagaacctttgaagctgtggtaagggagagctggggcattgatctgggatgcagaggttgctgtggttgagagctactctagtgagcaacatggtggcttcagagtgagcaggcccatgggagagggcccagctgtgtcttcctggagcggtaacacctttcccctattccataggtatcctggcatccatctgtggtggccttgtgatgcttttgcctgaaaccaagggtattgccttgccagagacagtggatgatgtagaaaaacttggcaggtactgtacaaaattcaatgcaccctaaataaaagcaatatttaaaaccacgggggaaagaatgacattgagaaaattgaatatccacagggaaaaaaataagaataaatcctcatctcatattgtaagcaaaaaattcaaagtagatacaaaaggttaacataaaaaaaaccctccagagctagataagagtatgcattgttttttttaatgtggttgtgaagagagaagcattttcacgtaaggtgctaagactcagaagtgatctaaaggcaggaactgctgatgtgggaaagtggaaattgctgggacatacagcagcaggggattaacagtgtggcttactctacagagtgaggatgcgtcaggtctgtctagatggaatggcataggcaggttttcaagactgactacaaagtgaaatgtcactgaacaacatgttatagtatttataaaaaactaaaaccaaaggtgttttctctctgcagctggataggaagacagatgacacacagatgatagataataggtagatgatagataataggtagatggatgatagatagatataatagatgataatcatagatagataagtgatagtagataaatgataaataatagatgatagatgatagatagatacagatagataaatagacaggtagatgataggtaatgtctggatagataggtggatagataaatagataatagatgatagataataaacattagtaggaagatagagagattgagttttggaggggggtgtttaaatagggtataagtaaaactaatacccagccaatatattaacatgaggagtaatgtcaagaaaaattcacattacacaaattctttctaattgtttgaaattttttcattaaaacatagagatatgaatatgagaatgtatagtacaagatgtaaaatattaatatgtgccctctgtggacacaaatgggctgggaagaggggtagggaagggaggaccatcactttcttgccagagacttccatactgtttgattttctttaaaaattagaacacgtagtcttgtgttgcttgtgtagttttaaaaaatgatgtaacagctaatttaacaactaaaaagcaatcttaataatgacttaggaattaagaacatggagctctaaatatttttaatatataaaaaatcctgaggaacagctttcttccctttgattctattccactgactgccttctgtttacacaatgagagtgatgctttcattctttatccccaaaccaatcaggatcagatttgcaaactcatcaggaaaaaatggaagaaaagggagtcctctgaaatcaagacttttctactgcttcagtaacattaaaaataaacagctaggagaggtttttttgtttttgtttttgtttgtttttggcttggggagtgtgggtggaagggggttgtctaaatggtgtgcaaggaaaatcaatacccaactaacatataaacatgaaggattataccagcaaaaatttaaggtacccagattctttctaatttttttctgtttataatttttcataatgaaaagttgggtacattaattaattatacctagtctctatacatgaaaaaaaatctagtagaagtatggtttacagtgctacaatttaagcacattaattgtgatccatggttatttactctacaaaaattacttagtgctaaattactaaaacttgctagcatttcccttttaaaaatcacactggattattttatcgtttctgctggtttttgttcatgttaacagctcatttccaaatatatgttaattcagtagaagttcataaagaacttaaatgctataatgctaacaaacccctgtatcagaggaaccagcccccaatatttcagcataggttctattttccataagtgttggccagctgagaaataaaaagagtacaaagagaggaattttacagctgggccgctgggggtgacatcacatatcggtaggactgtgatgcccacctgagccttaaagccagcaagtttttattaagggtttcaaaaggggagggggtgtaagaacagggagtaggtacaaagatcacatgcttcaaagggcaaaaaggagaacaaagatcacaaggcaaagggcaaaaacaaacatcacaagacaaagagcaaaagcagaatgactgaaaagggtctatgttcagcggtgcatgtattgtcttgataaacatcttaaacaacagaaaacagggttctagagcagagaactggtctgacctcaaatttaccagggcggggtttcccaatcctagtaagcctgagggtactgcaggaggccagggtgtatttcagtccttatctcaactgcataaggcagactctcccagtgcgactgtttatagacctccccctaggaacgcattcctttcccagggtcttaattattaatattccttgctaggaaaagacttcagcaatatcttccctacttgcacatccatttataggctctctgcaagaagaaaaatatggctgtattctgcccgatcccacaagcagtcagaccttatggttgtcttctcttgttccctgaaaatcgctgttactctgttctatttcaaggtgcactgatttcatattgttcaaacacacatgttttataatcaatttgtacagttaacacagtagtggtcctgagtgacatacatcctcagcttacaaagataacaggattaagagattaaggtaagagatgcataagaaattataaaagtattaattttgggaactgataaatgtccatattaaaatgaaatattcacaatttatgttcagagattgaagtaaagacaggcataagaaattataaaagtattaatttggggaactgataaatgtccatatcaaaatgaaatcttcacaatttatattcctctgctgtggctccagctggtccctccattcagggtccttgacttcctgcaacacccctgtctaaggtctgaacacagacaaaaaatgatcctggagacagatattgttgttaccttagagttgggttttcatgaatgtatttgatcaaaaccagctatactattaaataataacagaacaccctcttctaactagttacataatctttcctaaagactttctcctttgttttttcagtccacattcctgtaaatgtggcaggaataagaaaaccccagtttcccgctctcacctttgaggcccccgacaaagacagaaagaaggagctatccaggagctgatcctccttgcaaagctgtgtcttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgtacatttgccctttctcttccttctaaacatgtgtctctcccacaggtcattctcctgtgacacgtgtactgcagagtgtttcaaaaccgggcaggcaattagcaatgggaaataagtggtccaccttcaatatttgcttgttgttcatttacatgctcttggcaccaatcctagactcacgtgtgccccagaataacattcagactctcagctggtcttgtgttacacatccatggaccggttcactccatcatatacagctctctgctccgtgtcccctgggctcaagtcaagcagtcggtgacagatttcattcccaataacagaatcggtttgcatgactccccatacatgttgcagctttgaaaacattcatctcagagttaggtataaagacataaaaatgtgtgtcaagccctcgttagctgatgaggtaaatgcatggacaacttcctaggacttctcggctctgccctctgtgaccttgcagcctgctcaggtctttgtgctctgttccttatcaaaaacagcacaaccccctcaatctgcccatttaaaaattggtggagtgaacaaagagcatgaaaatgttgaagaccacaaccaaaatttactcaaatcaaagttaagtacagagtttatttttaacaaatgtcatagctatgtcaccttactacagaatccagcagtcagaaaataacacaaaaaatgccgaggtttggcgtagctggtagctggggacagtgtcttcgtttgattactgccagttatttccagcatgctaaatccctacccacgttccagcctctaggtgagtcagtgcgtcactctgtctcccgtccaattaattatttctcatcactccctcaatccaagtaacaaaccttgaaacacgaacatagacaccaggcttattggggcgtgcacagccaagaccccaagaagtgactccttgtaaaatgtatttgtccttctcaaagcaaaccagaggccctccactgtcaccctaaatagaggtagggaaaaattcatgtgagggttaggctgccagccttttattgtggcatccatctattgtccatatgtatattttcccagtaattgaaattggaaaggaacttatgggcatattactggagcatctgcagtgcttaagtacttagcaaaatctattcagcgaaaccacaccacttagtttctcccaggggtaaaaaaaacccttgtgaatcctgcacacatcccttcctgtgttggtgtttcctttagactggcctagcctgggcatcactgtaaagtatgtgcagttggtctctgtcctgtaccctctacctccttccctgtcggaaaagtcaccactttagtccctggccaccagcacaccccaggagggtgagtggcctgaggtagttacggcacttaaaactcccttgctaccgatctggaactcaagccccaagacatccccttagatgatctgaatacgcattcagggacagatctaggcagtttctaaacaacacttagactggggtctaacgttgacaaatccttctagaatttgcctctttgggactgaagtctaaggggctgagaccaagaagggagagcacaagactaactttggtctcttgaccttttcttaccttgcaactgtcagtgcctccagccaaatgcctagcacagagctcagtggatttgattcttccattcagatactcatagcgattgcacactttattctcaatcacaagaagctggggcttccttgagaaggccagccccaaaggtacctgtgtttaaaagatgaaagaaatggttgctgaacccaaaacatgtttaggaggaaaaccagaagaacagagcagtggcactggacctcctgtctgtccgtgaggctgcagaacacaaggcagctcccaatgccgctggactctctgaccttggagagtgtaaacatcatatatgattctgtgttcctgagatctgggttt

SEQ ID NO: 12899 - DNA, 11330 bp, Human
agtagtgccaagattatagctcactgtaacctcagacttctgggctcaagggatcctcccaccttagccaccctagtagctaggactatagattcccaccacgatgcctgctaatttttaaaattttttgtagagatggggtctccctgtgttgcccaggttagtcttgaactcctgggctcgagtgatcctcctgcctttgtctcccaagtgctgggattacaggtatgagccactgcatctggcctggatttccttcttaatacacaaagaaataattatttataaatatccattgataaagtgtttagctctttcagaggcttaattcatttttcaagtaaacacaatttactgtcagagaaataactactttgccagtataattcatttttttttcagtttaagaattaaataagtattaacaataattgcatattgaatctgattctccaagtataggacagcctcacttcttccagattatttcaatctattccacaagggtctataaggttagcactaaaagttgaagtaggtataatttgtctgctgttgtcatagattaacttctcttttggaaaaagccttccaggttcaggtctcttacccttccataccaggcatggaaatgtcttaccccagcctactgtgtatctacagcttaagtgtaacttcaagactgaattttttaagactcaaagaaacaaatggcaagttttttcctgtagtgataggtgaagaaatattttaggacacagcactttgtaagaattataaaatggcagtatttatagagatcttaaagataatcattagttgaatttcagtttgctcaagggccctcaaattagaggctgttattccatcttttcttcaggccaacattatctccttaagataatctacaacccttgtgaaggttgttcctgggtagagactgagaggattttaggaaaattcacgagttggggtttttttccctagtaattctgcaaaaatgtattattgctcagtctccttagggcaggtctaacacccaggcacatagttttaggccgtatcttattcacctttgtatctctagtacaaatattttcagatatgaatttgtttcaacttttggtctctgcagtgtcatttagtacagaaatataagaggtaggcagtgtatcttcctactataaagaaaaaaactaaattttttttttgttaaataatgtgtctcaggtcacttttaataaatactaagctagtgatttactactgctttccaggcactcttctgggtgctaggaattaattacagaggatttgacatatgttaaagctcttgttttttccaccatttaatctgtggagccttagtctttggattttaaaaatactttgaaacaccctagtatttataatctgccaaagagagagttcacttgttgaaaatcagcaataatttctatgtaagactaatagactttgtttcaactgttgatatggtttggctgtgtccccacccaaatctcaccttgaattgtagctcccataattcccatgtgttgtggtgaaagataattgaatcatgggggcggtttctcccatactattctcgtggtagtaagagctgatggttttataaggggaaaccccttttgcttggttctcattctctcttgcctgctgccatgtaactggtggtagtgagtaagatctgatttttttttcagcatccaaaatctttttattaagagggtaggatccaaggttagtttttgtagcctcggctggcctgtcggcctctgatgcactcgaacttccagcccttggagcagacatagggtttggtgtggctgtgcggggttcccgggccttgctgaaatgctggtacacctttcggcccttgcaaatactggagagcaggacagtaccgcagccctcgggggagtccaggggcaagatctgatggttttataaggggaaaccccttttgcttggttctcattctctcttgcctgccgccatgtgcctttcgccttctgccgtgattgtgaggcctccccagccatatggaagtgtgagtccactaaacctttttttcccttatagattacccagtctcgggtgtctttatcagcggcgtgaaaatggactaatgtagctgttaatagtcaagttctcaaaatcaattgtaaaagcacagtaaggaaacttagaaaaattactgataattctaccttctagataaccaattttgatgcattttaaatctatattagattatcctacatataagaagatacaagtttcatatattttattcacttaattataccaagaacatttttccgtgtcattaaaaatcttgtaaaccatttttacggctgcataagaattcatcatatgcatgtactataatttaggtaatctcttatttttggatatttaaaccatttcctttctattatcattaacataaataatactacctgcattttctattatttccttagaataaatcccacaatgagtaatgctaaataaaaggcatgatcatatttaatgtaaagaaaaaatattggccaggtgtggtggctcactactgtaatcccagcactttgggaggctgagactggtggagagcttgagctaaggagttcgagaccagactgaccaacatggcaaaactccatctctacaaaaatacaaaaattagccgggcttggtggtgcatgcctgtagtcctaactactccggaggctgaagtgggaggatcgcttgtgcaagctgtgagcctgccactgcattccagcctgggtgacacagcaagtccctgtctcttaaaacaaacaaacaaatttttaaaaacccaaaatacaaatacagtgtcttttttgggaaaagcttaggatgcctcttaaactatggaacatacaaaacacaagttagggcagaaaaaaatatacatggctaatgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgattctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctaagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcaggcctgtaatcccagcacgttgggaggccaagatgggcagacaatttgaagtcaggggttcgagaacagcctggcaaacatggtgaaaccctgtctctaccaaaaatataaaaattagatggacgtgctggtgcacataagtaacccagctatctggaaggctgaggcacgacaatctcttggaccaaggaggcagaggttgcagtgagccactgcactccagcctggcgacagaacaagactctgtctcaaaaaaaaccaaacaaataccccccacccccaaactacacaaaagacaagaatttccaagaataaaatcaagagatctgtactcacaatttatgacagtttcaattagaaaagtctgggttttatccttgttttcctaatattttcttttctttttctttttttttttagacagagtcttgctctgtcgcccaggctggagtgcagtggcgtgatctcagctcactgcaacctctgcctcccggattcaagcaatcctctgcctcagcctcccaagtagctgggattacaggcgcccaccaccaggcccggctaatttttgtatttttagtagagacagggtttcaccatcttggccaggctggtcttgaacttctgacctcgtgatccacgcgcctcggcctcccaaagtgctgggattacaggcatgagccaccgcgtccagcctttctaatattttctttaaaacgtcccctttttcaaaattttttcaaattcatggaaaagaggataggaattatggttaaaattagtactaactgatgacattaaccgattaataaccaattatgttcttaaaaactggaaatgatatacaccactagataaaataatcttaaatgttcattgactttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacactaatcttctgtacagaaatcctagtccagcaaacattgctctcatcttcgcccatacacaacctatgtaaagaatggctttcctactctttgctggcgaacttcagctcccggattaggcatgccacctcttccaggtagctctcagcaacgcacttttccatcagcctgggtgtgcccctctgtgttcccatggcgctttgctttcagcgcttctcccaaattatgtttacctgtttattagactctccacctctgaagaccaggccatttcatttggctttttactgccacgtagtaggtacctgttcaagcttgatggaaggacttccccagcctccccacacatattatgtaaagtgatcgctgtctttgcttcctcctggagaccatttattttatttttttgagacggagtctcgttctgtcgcccaggctggagtgcagtgtcgcaatctcgactgactgcaacctctgcctctcgagtagctgggactacaggcgcgcgccaccacgcccggctaatttttgtatttttagtagagacggggtttcaccatgttggccaggctggcctcgaacttctgacagcaagtgatccacctaccgcggcctttcaaagtgctgaaactacaggcatgagcctccacacccgtccaggagcccatttatatgggagcctgcttctaaagattattacctggtgccagggtattttccagacctgtcctcacattcctgttaaacaggaggaagtgaatcgcgctccttttcatctaccttctcggagggtttatgcctccaatattaacctcagcacagccaaagaaaatcattccattccattgagcggagtcagaaacatgactaggtcacgatcacaaccccgtgtgtgccagggtgaccgagactgggtgactttatggtgtttcaacgtgtgggttttgactgattatattatgggttttccagtcaaaaactcaaagcagtggataaagcacttgcgacctaaaataagcaatggaatgaacaggaaggcgaaaccagagtttaaagcggcaggacaaacaggaaaaaggaagagtgaggcaggaagggtttaaatgcaggctcctcggaggacaagtcgccgccacacccctgtctgccgtcccgccagccgccctcacgcggcgcgggaaaacggtcggcctcgccctgggctcaggttctctccgcccgccaggcagtggggtttttttttgttttttttgagacggagtctcgctcagtcgcccaggctggagtgtagtggcgtgatctcggctcactgcaacctccacctcccgggttcaagcgattctcctgcctcagcctcccgagtagctgagactacaggcacgcgccaccacgcccagctaatttttgtatctttagtagagacgggctttcaccatgttggccaggatggtctcgatgtcttaacgtcgtgatccggccgcctcggcctcccaagtgctgggattacaggcgttagccactgcgcccggccccagccaggcagttttaatcgagcgctcacaaccactgagacgcagtgaagcacccaccataaaatcccaggaggccgaccgccggttcagactttttcttttctttaatccccgtccaagggatccgccctcaccccccaccccagccaccccaattccctattccctccccttggacggcgccggggaaaacaagctgctcgagctttatttcttcggtgcaaccaactcagaatgaattcctccgcccctgcgtgctcagtgagtcggcaccctagcagtgaactgcatttaaaacctcaggaattgagcgaactctcccagtggctctcctcaccgggatccccttccacgcctcctccccgtgccgcgcctcagtccgcactgctcattggccgcgtgccctgccaatccgatgcacgtcggctagggcaaagaccgcgaaaaagcgcgtacacctggctctgggagcgcgcgcctaacgccagccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaagttactgtcttggagttttcaattttccttcctttatattttacccatattcgtcttttaagatgttagtatgatgtgaaatttatctaaccaatcttgtttaattcccagatgagggtgctgccttgaattccaacaacttaaggggagaagaatctgggtaaacttcacccacccttaaatacagaaacctgacttggggtcttcctagtgtactcacactcctacaacttaagtgtccaaatgaaaattcacctgaatattccaggaaaatatgagctatattctggggttaaatgtaaaatgagcctttaacaaaagctgggcagaagttgtcttataattgccaaaggaaatatggaaacaaattaattttgtgacatacaggagcctgaaacaagagacagcaggcaagctttcaagtgacttaatagtgagtataaatttagtcaaacttgtttaattttctagtaaaacagctcaacttctgagcttatggcaaattctaataacatgtttcccgcagttagaattacttgggtagggaaacataattattattatttttttctggtttggggatcataacgtttttgcaatacttgccttaaatcactacgatagatttcttttttaaaaggcaaactgtactagatagtcttgtattttgttaatatacaacttgtccattttcctccatatccaatttgagattgttatagataagaatattgcaaccctttggtgatccactatcctggacttaatctttaaaattcacatccttcagagaaaggaattcatttttattttttagtgaaatgacatgactactcttttcttactctctttaaggagaacttgagagaaattcagtaaaaccaataggaaaatgcatagttaacctaatgtttttactgcacatagacgttttgatatctttccacatgatgcaggtttgcttcatgctgctcataagacaatagttatgaaagctttatcttcaatttagtagtggacccatctgtgtcattcagagagattaattttatgaataatggaatgagtaataattttaaaactagctaagaagttagcctaagaatactggcctttggtaatgaccctttcatacaagagttgactcttaagtacacataaggtgtttttttttttttcctttttagcaagcctcatttgggtaggggggaggaagataaatagccaacagtgaaattgcttcaacataaaaacctttttttttttttaaaggaaactgctttttatactctgaaaagctaaagataactccaatttatcagtgctggtgtcacattggtggaaatttttcagcaatgagcatttaagggtgtttcatggactacaggcataaatatgtgacaaactactatggtactacaaaatcaggttaattgtagctttagagtgacgtttactgtgagttttaccaagataatacccattctgttacccttttattagtcctttatttgttgaaagtgttcattccttgctctaacttcaaaatataatggagtccttctgtaaatgcagtttggtatgactcattttagacctcacttaagagattagtttctaaagtatcagaaaatgaccattggtagtttttgatcctacggcctgacctccggtagcttgctataatactaacatcaatctgggcagatacttcattttctattttgaaaagtaatttgtaaaactcaaattcttgagttttacattcttgagcattcttgagagtgtttcttatttaattctctcttttcaaatttaccaagatttgcatattaccaagataaagccaccaaagtagccattcactttccaggggtcagttgaaacttgtaacctgataactcctgggaactccttagcagatgttagatcagccatagtcaaataacagtggaaaaagtacttgatgttaggatggggctaaattacagtttaag

SEQ ID NO: 12900 - DNA, 462589 bp, Human
agagacatgtaaactaaaatccgatggaggtgtagagtagttggcttggcaaatcttaggaaaaggagaagcaaagaagaggagacagcagactcacacgtgcaaaaatgggaatggagagagcagagagcgtgtggggtttgcacaaagaacagttcagaacctcactgtcatgacagtatgaagggaaagcgggcagtactccaccacccaccaatgtagccctcaaaatcagctgagttgtttgaactttaccctaacggcaatatgacataatcaaaagatttttaagtggaggcgtgaaaaatcagaagtattttggggctcacacttgagattggattggggaagatacggctaaaagtaagtgggagtaatgagggggctgtcccagtaattgggttcagatgacatttgcttgattttagggatgtacgagatattcgtggatcttgtgttgaagcacctaatacacgatgtcccttctgaagacgggtgcattaaactggggtgaagcacaaaggccactgagcagcctggcttgactcctggctttgccagtttgcatttgcacgtgtccaagcccttgagaggtgctgtgaaaacatagaggtggatgagggaagtgcttatacagcacataccgtataaaaagagggcttcatacttgctagttgttttaatttttattattacttttcctcgctgcacatggaaatgtctttacctttgtcttattataaggtacatacgaggagagttacagaacatgggtgttagaagagatttgacatatctgttcattttcctaattttagtgatgagaaaataaagggaaagaaagcaatttagatttttgccagtattacaattctttgttcacgggcacaccacgccagcctgaaactgttcattggtctggttctcttaccacctcgtatatgtaggtttatagtttggttacgaacaccaccttgtcttaaccatagatagttcctgtgtttgccgacagcagcgatttcttgtgtggaaacccctaatttgggaaacaatctgttttaaacactttgtagcacatcactcaaaccgcacagttttcgataatcttagaaacaaaaactggggttgaggcggacagttaaattctgcagacaccacaagcttggattcgtttcagcagtcggtcctaagtggtttgaagccccttccgggatgcctcttcttatacgaacaacgcagcggcgccaggcgccagggtcctcacttctgcctcctggatttcctccgcctttctgcttcaccgagggccctgtgatccgattccatcgaattaaccgctgtttaccgagggtctgctgcgcctaaggaaggcaccgggcgacgagcaaggcggggacgcagtttggggacgcaggggtccgggccccagtccagagacaggaggtcggcgcttcgacttggcacccgccgacgaattcactccaaggttcccactggcggagctcctgctacctcccccctcccctaaatgcagctcccgctaccttcccgcgcccaggggctgctgcctgagcccagctctgctcactggagggcggcggtggagagggtgctggcccagcgtcggcagctgggctcaggaccaaggtgggcgcccgccggtcctggtccccccagcctcacggtgcaggacccagggcgcggccactcgagttccccggacgctctccttcctgatgctcgctgtccctgccctggcgtccccagcccggggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcggagttgggcacctctctgtttccacgcctctccttccccctttccccctctcctcccggggatgtctgtcttctccccatcctatcattccaggctggagggcagcaacgcctgctttcccctgtggcaggagagaagcactgggtccctaaggtcagagcaacagaaattttgtctgtgtgtgtgtgtgtgtgtgtgtgtgtgtgtgtgtgtgtgtgagagagagagagagagagagagagagaaagagagagagagaaagggttgcagactcagtgatgcttagttttcttaagagaagtcgtcaaagttgcccctaagcaggtgtcatcttcaaccacccttcccccaccttccagatttcgctggatgaacctttggcactaacttgacagctgagatcactccgacaggcagaaaagaatagcactacactgaagagaaatccttatggaagttggacctgcctcgaaatcccccatgaaggaagagtgggtttatgtctgtagatgcgccactggttatgggggctccatgcctgcgtgctccttgcctctctcctggctggaggagggtgtggggagcccgctggcaagctaggggtgaaggtgagagtggggaccatatttgcacctaaggatgagtgtatgtgtaagacaaggacagtgtgggatcaatggcctttaaattaggataaaagataaccccacattgtattagaatccaacaacgaggaattaggatttattaaggtctctctcacccctcccttccgcaggcaagaataaagacattgacaggtttggagagttgttgacactaaccctactgcttatcgatgttaaaggtcgaggtgatatgcaagcataggtttacaaagatgtacacttgctggagctcagagggtttctggaaaaggggtcagtgaaaacattcttgtaaccctactctttctgagttagtgttcccttcccaaaaaccatataaagtattaagcctgtcacaccatgtgctgttatgtaagcaaacgcagatgacagaggtgtgtgggtttgggagggtgtgttttatttatgggggcaggtgtgtgaataattgggatccccatagacatcgcctggcctggaggccacagtcactagggcatgtgctctgtgtctaagtgttgacttctgatgactcctaaaacgccttcctggtgaggttgttgcttctgcgttcctcccatgcattttgttcgctgtgcgctgagggagttccccacctgagttgttctcttagttactcacacagatcaggtccaaatggatctttctttttatactttggtttctaaaaatagacagatggtggggagggggtagctctagggaggtatgctaggacactggcagttctacttcctagttatgatggcccgtctggcccctgggggaacagggactacattcagcctaatttaggagctgtgagttggaagggggtggtgattacatgaagcacagtgtaggctgctcctggcttattggtattcatcagagtcctcactgggtaggaagacaaagccagagtttgcaagggaaatcatttcagcttgcctcttgtcaggggtcattctctgagcctccttttttaaaatgtatgttgtgtggggttttggctttctgagttgcatgctcacacatgcacgtgtaagtgtgtacacacacaagcatagacatggacacagacgcagcatgtttctatagaagaataataacattgcgtctgctttacaatccttacatagaggtggattctacttcgtgaacatcatttccttttaaataaagctttacagtctccaattcctgcatcagtgtcacctcaggtgtctggttaaaagtgctcaccaccctagacttgcagaatcaaactgtctgtgggtgagaatttttaacacgctcctcaggcgatgtttatgcagactaatatatggggattgccaccctattttgcccccaagactaaacaattgatctttgaactcataaaccctccccatccaaaccaggccagtcagtctcaaagtcagaggaaagatggtgaaaaggaggtgcttccatctggagcatgtttgtgcctgggtaacaggaaattgtctccattttgatcactgttacttatttgttttggagtaatggtgaatggcctgcccactcgtcatggcggccattggtgctggactcctgcagcagggctggctgttttactgtgggatggatgaagggtgtgtaaaaaaagagcaggtttgtcaggagctgagggtcggctccttggtggggaccacaccacctcccttctgggggcacctgaggacagtgtctggtgggagcttatggagaggaggcaggaagacctcacagaatggagtctgagtgaaaggactgagttagggtatggagcatggctgcttgcgtgagggggatcatttgaggtggaggagtggagatttgcaggtaggcaaaaaatatcttttgaagaacatgtgtatttttggaatgaaacttgacaggcaaaaagaagggggctttgggagagagggtgtgtgtgtgtgtgtgtgtgtgtgtgtgtgtgtgtgtaggggggtctcatctgctccttctgttgctaaggaacatataagctagggtttaaaaataaatgaggagtgggtgggcatatgcagtgactcctgtctttttaggaaccagagccctttacaaaaagcctttaaataaccatttctggaggcagattattcattttgcttgacttttactttgttaagtaaaataaactgctttctgtactcctagatttcccctcattatctattctgtgttggctttttttgagaaccatttttcccatgagaattttttcctttatttcagaatctgcacccctagagcaaatagtctctgtcgactgtaaagctgaaggtttgaaaaggcagtgcgagtgagctggtacttttcttttaaaattactacttcgtttttctttgcaaattatggtgctgcaacagatacatatgtgtaaatgactatatactgtgtaggaactgtttttttttttaaactgctgtaagaattcccatataagtcagtacaataaaaaaaaaaagacttcagaaacacataagggaggggaaggagaaggtagctgatgtttattgtcttctatgcaacaggcactgggctaagccttattgtatattctgtcttaattaatctttgtgacagtcctgtgatgtgactatgactatttccattttattgaaaatgaacttgaggcatagagcttgggcaggaggcagaatttaaaacacagatgactccaaaggactgtctctttagaccgcatcacgctgcttccctaaacatttattttaggcttgagctctctgtccatgtgtgcatatgtgtatgcatgcgtgtgtgcagtgtgagttatcttccccctcatctgtaatacacggcaggtcattacatattattattattatatattattgcatacctttttttggcttgtggccctttgtctatataattttagggaactcttctactatctcagaaatataaatgaatataaattcatgattgcaaatatatcagttttgcttctgagaacaaaaccacctacatgcacctgctatgaagatatcctcgttagaggtttatatgccttaaaaaaaaatttacacagggttgtgtaggcgaacctaggtccaatgaagagctggcccatcggtacctctttgggcagcacagaatgagtgatgaagtacaattttgcttgtcagtatgtctgggcagaccattacttatgagatgttgatgcctatgatttagtttctctgctcataaaccatgctggtaatactaaacctttcttaaaggaagtttttggtatgagatagaaataggagcaaggagtattaaacgctttagtttgggcaaccatgtaaaaaatgatctgttattctttataggttgatgattagaatgtagtttttttgcgtgtgttttgtcccacaaagtaaggttgtgttattacaagaaagatatttgaggagttcgaagccacgtaggataaaatggatattggtcttccttgcattgtaatcaatagtgtatgggggaacttttctcctgaatatcagtatgtatcctcttttgtaaatccattttattttgtttttatccgtgttttgcacatctgttagatttttaaagactgtaggatcagattaagatcttggttctaatttaattcctttctcagtaatgacttacatactgactgttacttcctcagttaggatacacactgggcaagatttcaattcaaccactgtccggagtacttattctgctctaagtgatcttttagaggcttgatttttacctgggagattgacactattgggtcctgtggaatctggggatagggaagttgaagagaggtctttgctggtgttcaattctgctgtggcaacaaacaacagcattgcctcatggggccaaattcaattagactagagctagctctttccaacaccgcactttctagtctgaggaaatgagggttcctagtgagagcccaggctgtctacaccctgtatgttcgtctggcctgggatctgagaacatgttccctacacaaccccaaggtatccttgaagttgagtacactgtgagaccagaagcatctggaagaactattgcctacacgttgggctgtgacatttgctttcttccatgggtatgtgttggtaacactgatcctgtggagactaattatttttcctgaggtcctgtaactagttttgggacagtagttactgcaaataaatgatggcatgtgagcttttcttacagtggataactttgaaagaaaggtcagaagtaaaatgaaatctaagccataaaactttttttcattaaaatttaatttgctcaaaatgcctataaaaatgggctgatttctaattgttggaactgattgaaacctatttcaaggcacaaaaacaatgcagataattggagaaataaaaataccaagctaagtctgtttgcccataatgcttccacaactcattgctggcttgttcaccaggaaaactcctcgattggtatgagctcaaaagcgtccacttggggtgatgggtggctggtgctcccctgttctttcaaatagctttgttgagacaagtgtcattttctggtctgggacttagactagggtttgaacttggcatctttctgctaatctcagacaagctatgtaactccttggaggcccagccaatgtgtttctaaaatgagataatagtaatacaggtttgttaggaagattaaatgagttactttatttaaaggacatggcatagtgccctacatagagttaacttgtgtacttattaccattccccaaactaagttgttagctcctttgaagacagaacttgcacctgatcatttgaatcgatgactctgattcttcttgcttggtaggtgttggataagtatttattgaataaatacatttcattggcattttaaaataaattactactgttattcattcttggttcatctcaattgtgagtttcttttctactaaagaaacctctgcctttttcttatttacactttgtccagcagcccaggactgcgttactgtttacagcttcctgtttgcgtacctgcatcagccatttaggcagctgtgaggctggagaggggtggcagaaactcttacttaaccagctatttgcagcttgtcaaagaaaaggccttaatttgccttctgagtagcactaattagctctccggttctctttctgtctgtctcatccctttccaaggggcagcattgattttctcctcagggaaatttctgttgacttttccttcagtgattaaaatgtaaaaatgcagaaaaagggctacccagcattcctggagtcctgaccattgtccagccagccggaggtcactccagccacctctgttctatattacttcactccctctttccttccagctcatctgattgactttggtgaaaaagttattttaggaagaatgcattagtccgcttagtgactctaagcttttgctttgtttttaacccacttaataaaatcttcagaaaagcaccagctactttttattcatgtaccatacagagcacttgaagaatggctcacgagtgtcctgacacccatagtgtttagggagaggagggatgagcactgcttgggttactttagagaaaattaaatcatcttgtgtgtgcatattagctgaaggagggggctgtgattgggtagaggtgggaagaaagatctttgcatatgaatgttaatgttctttccttccagccctgagttttgtgagcctttgaaataaagcaaacagcattttcttttaagggcaacagctttctaacaggggcttctgtcattcttgcatccaacctagttttgctgaaatggaaatttgcctttagatttccagactcataaataatgttctgataaaagaaccaattctggtttaagctgtaatatttatagcctggcttttgttagatgttgggaacaacattcgaaacagtaatatttaaaccacaattaaatttcatttttcttaactttcaattacttgagaggtagaggagagtactggtgaagagccctgctacctgggtccaaagcgccacctctgcctgctgtgtgcctgcaaaagttacttaacctctctgtgtcttaatttccctatctgcaaaatggtagtgatagtagtactcatcctgtagaattatttgacatttaaatgagtcacaaagtacatgctatatgtgtgtttgttaaagtggtattatctatactcaagtccagttaaggaacagatttgtctattattcttcaaaatacagaacatcatcaaatgtcagcagctggtgataaaattattcaggtaatatgaaaatgagatagacatagacttgagaaatttaactgacaggttttggcattctttaaggtatagaatatgtactttttctttcataacttattaaaacacaattcattgttactaggggatgtgaaggggagaaagctgcttcttagtgctttggaaattggagcagacagaaggcagaggtcggaggagagaggcacagtcagtgtgcggaggaatcaggtagcagcaatccaaactcccagctggtcatctgagagcaggaagccagccgtggaggggtgggtgagaggggtctcagagcttcacagtgtcaggaatggataagctgataaagaccgaggtactagaaatagaattgtcccctgtgattccaggacagaggttatttctcttctggcctgtcttgatgatgcctgctttgtacatacagacaatggccggctggcatgccctggcaatcacagaaagaagcttcgcagatgctacctgccctggattatttcagaaatggaaggtgcagccttctgggatgttccatcagttatttgaaccaggccaaacagcagaatatattttaaaagatgtagatggttattaaatatttgttggacaaataaaacggctcaggactgtgaaataaattttgaggaggtgaattcattttttttcccctaaaaaaggcaaagataagacagttggactgcttttgtgtatcatgtagtctttcaggaaatagccagaaaatagattccttgaaaggaccaaagtacattttaaaaatgtgtcattcctttgtacatgagaaagatgtcaggcttgtaaggaaaaatacatttttgcttttttaaaaaaaaaacttgaaagcaatttgttgaaagataaaaagagctttacataagcttatgtggaagcggtcggaaagggttccgtgtatcatttagagacaaacttctggaacattcctcaggctgaaaggcctcagatctcatcattgtccttatggatgtgtcagagtttgagacaatctctttcagactgaaagcattctctttaagagttttgaaggaagagcctgtaatcccagcactttgggaggctgaggcaggcagatcacaaggtcaggagatcaagaccatcctggccaacatggtaaaaccccgtctttactaaaatacaagaaaaattacctgggtgtggtggtgcacacttgtagtcccagctacttgggaggctgaggcaggggaattgcttgaacccgggaggcggaggttgcagtgagctgagatcaagccactgcactccagcctggtgacagagtgagactctgtctaaaaaaaaaaaaaaaaaaaaaaaaagtttctcccttttaaattggccccctctcaatgcaaagactaaggtgtggcatgtttcttttcctatgcaattgaagcaccgtcctcagtgtctgaagttacacaggaagctgccaagcatgggcttccctgacagcgcacaacctcggggctgcttggttttcatggctgtcttcattagcttgggctgctgtaacaaagtcccatagactgggcggcttctaaacaacagacatttctttctcatcattctggaggttggaagtctgagatcagggcaccaacatggtcaggttctggggaggaccctctttggggctgcagacagctctcttctcatggtgtcctcacagggtggaggtagtgaggctcctgggggtctctttctagaggggcactcatcccattcattagcgccccacccttgtgactgaatcacccccagtggccccaccttctagaaccatcacattgggggtgataatttcaacatgtgacttttgggaggacataaacaccagcctaccctgctttttctcacaatattccaggaagccacagacatcactcctcttgtccttcccagtggcctctgaaggccattcccagaggcagcaaaggcaatccatgcacttccaagctttttgtaagtgcagctcagagaaggaaaaagcttttcttggttcaaatactgaccgcaacgattaacttacctccctacctgtgaatattaatcattataagttactgattttgccaaatgcttacactgtgtcaagagctgctaaatattttacatttgggatttcactggaccgtcaattaagtagggactattattatttccattttacagagaaggacattgaggcttagagtttaagcagcttgcctgcaagtcacatagctgagtggcagagttaagatctgtgcccatatttgcatattgcttattacttccctattgcagcttttcttgtcctcttttcaccctttcccattaccctctctgtgtgcaaatagccatattttcacaatctagtggtttattagaccaaactctcttgaggagagagacccatgtgtttcatcttcatgggcccagccagacctcacacaagacatagagagaggccttgacaaaggttgattggctgagtggatgaacattctttttatgtctaagcataaaacttagctctgtgaataatcatgtgctactgtcagttgtagggaggccaagattgagctttccatggtgtttttttgtaaaaactatatgaattttccattgcacaagacgggggaataaatccagtttcctggggccaagaaatgattgcagggattatagactggtactgctccttttaaattctacagtacaagaccttgtgatttgttgtaatcacagtggaacttgaagggaggtgatggtaccatggattggggtccagtgaagaagctagggttaacttatgtgcactttacatgtctgaaatggcatagtcagccccatttgatttttacaaaagatattcttagaagagtctggtcttttacctttagctcgaggacctgtttgagctgcaagtctttgcaatatgagtttttccataacaacatccttcagaattcgtcagtatgttcatgagtgcagttagagacacctagaaagttccaaaggaacattttgaaaacctgagtcattctttctcatttgaagaaaactttcagaatttcttaggaaaataaacctctacttcaaaaataaatgcccaagctatttaaagattaaaacagaagctttctatgagccagcgtggaattacttataacaaagtctaagggattttttttaaagacaaatttctggagatttcttaaactgttatactgactaaatttaggtacttaataataataaaaatgtgtgtggtgctttcacagcttaccatttataaactcctttcacataattaatctaactactcacaaaacaatcttaggcaaccccgtattgttttcatagccattgtacatttaaggaaacagtcacagtagctaagcgactttcccaaggccatgtgccataagggacattgccaggttcaggctggttttcggatctgaagtctcatactcttttcactgcaggatgctgtttcaacacatgaatctatggaaaaatagcaccatttccctctcattaattttacttacttgaattaatctcactggtttatcacaatggacaaagttggaatcactagctggtattctaaatccatattgcattgacaatgaggatgacctcattgccattgtcattgcccttcctgtacacatgaaaacatgaaactacaagtgtgatggtatatgtttaacactcctcttactggggaaaaagaaaaaaaaacaggtagagatagagtcaggctctttctttgcattagttgctaagcagcagccatttcattgtaaaggagacccagttcaagtaatggcataggtattccaagaatagtatttcatttttatagcaattgcatttcaggtctccagaaagcatatgcttctgtagctcagtgatttttaggggaagaaatagccacctcaacatatttgttgaacatatggagaaaattcagtatagctgattacctaataaccagacttccgtgagccgcacacggttcacaggggcagcaggttcaggctacccacagtttgaaggatttggaagtctccagaaaatactgctaacaaacaggtacgttttgaggctgtatttgacattcaccgataccatctcaatgaaatactctgggtaatttagaatgctaagggtattgaaatgacatggtatagaacaaaattttgttgttgcagccaaggggttggatggtgccaagatttcattgtattgagctttcgctggcagctgaaagctcttcaaaatgaagatagaaaatacggtacaagacaagcataattcatggagctcagtttatcagaaggatctgagtgcagaggaggacgtatacttaatgtcccaatgggtatgtgtgtgaaggggcgatgtcaatatacaaagctgtcaggtgctatattttttgattgcactatcactattaattttgaagatggattgatctgtgtgtggaagccttgaagcccttggccctgccttttaaggcataaaaggcatttctgccatctctgttgtaatttgccaaactattgtgaaacttatgtgtatctatacaaatgtattttcttcagagaattgcttcatggagttgttaagggagcaaactttgttgttttctaagagtgtgctgcataatactgctcctcaccattcccctcctcaagatatttgagagaaaatgcccctttccaggagcagctgggatgctgggaagcttgtctttaatttccagtaagttgcccttccatttaaggcaaaatacctcttccaggaactaaaagtcagactcagaagaagtaatacatggatgaattcacaaatggtgaatggttattcccattgtggtgctgggttcattagtatggttggttttagcatctctcgaacaattaatgcctctcatatatgtttcatcatgcacttttacaatgactcaaaacagctttagcaaaagcacttgtgttatacgaacccaatatatagatggtgaaatcaagacaagaaaggctggggaggagagatctaaaacattgacttcccggcctggcataaaacccatagaaatgcaagatcctaagtgtctctcagaaaaagcatatctgggaggtgctcaatgatataccttcaacattaatatgaggtcctacttgccaagaactgtgaagtgctttacatatgtggtttcagttaattcttatcacaactttataaggtagatgcttttactatccatagctttacagaaaaggaaactgaggcacaggataatgaagtaatatgtcagggtgtcaccaccagccaacggtggagccagggtttgaattccagaaccccctgtctagtgcacttaagcattattctgtgctatattcctatatgcatccaaaaccctgtttttccttttaggaatgacctctgtcctcttgtgtgtagccttgaggggctgtacatcaaggtgcctggctctccaccatggtaaccaatgaggcctttggaagctgttgtagggggcttcctctcaccaccctgatagcatcttggggcaagtgtatgacttgagcttggacgaccagactctcttggacttggactcaaaggattgtcaaagggattgccaatttgttcatatccactggcagtgccctggtaggacaattcctgctgctctggttcctgtctttattcaaagcataggttgtgatatggtttggctttgtgtccccacccaaatctcatcttgaattgtactctcataattcccatgtgttgtgggagggacccagtgggaggtaattgaagtatgaggatgcgtctttcccttgatgatctcatgatagtgaataagtctcatgagatctgatggttttatcagggtgagtttccctgcacaagctgtctctttgcctgctgccattcatgtaagacatgatttgttcctccttgactttgccatgattgtgaggtctccccagccatggggaactgtaagtctaataaacctcttctgtaaattgcccagtctcgggtatgtctttaccagcagcatgaaaacaggctaatacagtaaattggtaccaggagtagggtgctgctgaaaagatacctgaaaatgtggaagcgactttggaactgggtaacaggcagaggttgaaacagtttggagggctcagagaagacaggaaaatgtgggaaagtttggaacttcctagagacttgttgaatggctttgacaaaaatgctcatagtggcatgaacaataagatccaggctgaggtggagacaaggaacttgttggaaactggagcaaaggtgactcttgctatgttttagcaaagactggtggcattttgcccctgccctagagatttgtggaacttagaacttgagagagatgatttgtggtatctcataaaagaaatttgtaagcagcaaagcaatcaagaagtaacttggatgctgttaaaggcattcagttttataagggaagctgagcataaaagttcagaaaatttgcagcctgacgatgcaatggaaaagaaaatcccattattcaagctggctgcagaaatttgcataagtaatgaacagctgaatgttaatcaccaagacaatggggaaaatgtctccagggcatgtcagaggtctttatggctgtccctcctatcacaggcccagcggcctaggaggaaaaaatggtttcatgggctgagcccagggacctcttgctctgtgcagactatggacttggtgtcttgtgccccagccactccagccagagctaaaaggggccaaggtatagcttgagctattgcttcagagggttcaagccttaatccttggaaacttccacatggtgttgagcctgcaggtacatggaagtcaagcatcaaagtttgggaacctccaccttgatttcagaggatgtatgggaaatgcctggatgcccaggcagaagttcactacaggggcagggccctcatggagaacctctgctagggcagtgcagaagggaaatgtgaggttagagcccccactcagagtccctcctggggcaccacctattgaagctgtgagaagagggccactgtccttcagaccccagaatggtagttccaccgacagcttgcactgtgcacctggaaaatccacagacactcaatgccagcctgtggaagcagccaggagaggggctataccctgcgaagccacaagggtggagctgcccaagaccatgggaacccatctcttgtatcagcacgacctgaatttgagacatggagtcaaagttgatcattttaagctttaagatttgactgcccggttgaatttcagacttgcatggggcctgttgcccctctgttttggccagtctctcccatttggaatggctgtatttacccaatgtttgtatccccattgtacctaggaagtaactagcttactttggattttacaggctcataggcagaagggacttgctttgtctcaggtgagactttggactgtggacttttgagttaatgctgaaatgagttcagactttggagggactcttgggaaggcacagttggttttgaaatgtgaggacatgagatttggcaggggccagtggtggaatgatatggtttggctctgtgtccccacccaggtctcatcttgaattgtactcccataactcccacatgttgtggaatgagcccgatgggaggtaattgaattatgggatgggtctttcttatgctgttctcataatagtaaataagtctcatgagatatgatggttttataagggggagttttccacacaagctctctctttgcgtgctaccatccatgtaagttgtgactagttcctccttgccgtctgccacgattgtgaggcctccccaaccacgtggaactgtaagtccagtaaacctgtttttcttcccagtcctgggtatgttttatcagcagcatgaaaacggactaatacagatcatcagtctttctattcattgtgaactatccaacatcttcccgataaaattcctttttgtttaagttaactaggtggtttaaaaaaagtctaactgataaaatatcattggcgaatggcccagcagcctctgcttgtgaatgtcctcagtgccagagagctcttggatacattaggggcatagttacgccgttggtcaattctaattgttagagagtttttgttataggaaaaatgaatatattatcatttagtgaatacttaatatgtgttaggaactttcttgcctcctttttgtgattttcttgtttaattctcacaacaactctgagtagttatcactattgtacagatgagaaaactgtctcacacaggggaaataatttaagtcaaagggctataattgatggagtcaattaattggattcagactcagttttaagtcacccaaagcccctatcttttcccattacattctgctgtcttcatgttgagtctgaaactgactccttaatttttttacgtacttaatattacactgtagttctggaggacattcaggataataccctttccttttctgtataacaggtcttcgaatatttgaagtcaaatatcacatgcctcttcagctcttgtttctttagactgcaccatctccactttcattctatcccttatccaaaagtggttttcaatcaacttcacttttctggctctttctaatttgacagcatactgggttatccatggctttcttcataaaaatgcagcactaaactaaaaatgtggtccaaccaaggtcaccattagcacatatggtgcctttgttcaaattagaaacaggtttcaagtctgggatgcatgaatttacaaaaattctcttgcactccagagcacagtcagctccagctaggacctctcctgtggtggggggcactgaggctgggtttctgtccccatctgctcctcctttggattctctggtgcaggatacacctacataccataggcatagctttggggacttcattagcttgctgtggctgttggttgtggatagggattagtatgggtgtggaccaattgctgtgaaactcattccaaaagttgaatatccagactgccagtttaacaaattgctgataatatttccaaagttttgcttaggttgcagccatttcacttaagactggccattttagcttggctaaatgtttacttggcttgtttcctacttatttcagatgccatgcccttttagaatgttccacatccatcccttcctctgtccatccatctgtccctccttccctctctctctcatttttcctagataagaaggggcaagctctctcttaagttctatttactattatctctatttttcagacttatgcctgcatcgtcctccttttgaccctgctgctagtggagaaatgcctgtgaccaactcttccaaaaactggcttaagctatttgagaggttttggcgaactttctttcagtgagttgacacagagccaatgaagaaatccatgtggactttggctaaaactatatttggtggccaagaaaattacttatcttatccagaggacagcattttcctattttaagtacaaaggctatgccgttcaatacagtgggcactaatcctgtggacctaccaaaactaattaagtaaactaaatttgaaatccggttccttctttacactaatcacacattgagtaaataagggccttatgtagctagtagctgtcctgctggacagcacagttacagaacgttttcatcattgtggaaagttctattaaacagcacagcgttgtgggattagggtcaagatactaatttatcaaaattacagaagcctctagatagccatccttgaatgataaccttgaatgatgaagttcttgaattacgaagtctagtttcccaagttaagaagttgtactttcagggtgtaactaggaaggagagagaactgtagacaggaaatgtggggagagtcctctttggtgttccgcatcatccttactgtcctatgttcctctcctcaccacagtggtgactgaggataaggttaaagacagagagtttgtcttctctttcctttgcaaactgcatcttcctctgctttgccagacatattgagcattagatgtaagagaatgtgttctatagcttttgggtggcctagctgttttgccatctaaaatagttcagcttgtggtggctgcacttggaggtagaataaaggttatgggaagagcattattgcttctccagcaattaattcctaaaatttgggtaagaggatcattcaagatgaaggatatgaacttagaatgtggatgtgtagcttcaggttatgtctgtgtcacagaaattgtttcttatgctcttattcttatattattcttaacatcagttcccatcatgttaaataaatatttattgtaaattcacttgggaggcatagaagtaaatgcatggacttatacttttactgtggctcccctgattcctaggggagagaccttaggaagctgtgaaaagagcttcaaggacagagcaaaagccccaggaggatctgtgtgtgtttgtgtggattctatctggtgctttgaagtgccaatattgcacacaagggtgttctaaaaataactcaagtaatgtgcattctctgctgaagggagtgagataattcatgaggatgatgagaaatgaaaaaggaaaaggagagaagctttagaagatgagaaatgaaatacatgcatctcaatggtctctgaggctcttccacgcactgagtgctttctttcaagtcttggtattgaaagctgggaaaaagtacttaaaaaaaagcatcactgggagaacattggggttttctcacctgttttatagcatgaggaatcctctcgataaaaacttacctaagttgtaagaatagatatggaatactaatttgttatatgtgcaaaacactatttcaagcacttggtgaagaatccaaaattgaataataaatgatttttaccttaaagttgtttcaagttgcttataacttattggagaaagaaataaaaaaaatagccactatgtgccaaatactatgtgaagtgctagaaataaaagagaaataagagtctctgttatcaagaatttatggcttggtgatagagagaagcaagacattgacctgtctacaggctgataaatacaaagagagcgggcggtcagcgggcaggataggggagccctgagagagggcacttatgtctgagtggagagtggaggatctgcagcaagtgatggttaaatgtgccttgaaggaggaagagaagataaccaggtggagagaggaattaaaggacttgttcatgtcattgattgaatggagaaaacatactcagggttctaaatggcaaactagaaacagaattttagaacacagtccatttgcttctaatctctcctgaaaagctctcaaagtagatcatttgaatatttgaaggaatgaaaggctttaacaggttccactaacctagaattccacacataagtgagctttactagaagttgtatctattccgtgcttcttagacatcagcagcttgaacaaaggtaaagcagcgggcatagcatgatgcacatgattgtatctggatctgggtgataggaacacaaaagtgggagaggttagttctgtttgggagaagttttcttggagcactgactttaaagagttggtaggatttcaataggaggagatggggacacaaggagggagagtatggaaagcgttccaggcagcaggaattgcatgagaaaggatacagtggtagaaatgtatgacgtatttgtgcagcagtgtgaatggtgatgaagtagtttgggttgagcataaggatagagtggaagataaggcagggaaggttagttaaatgctcattatggaggactttgaatgccatcagaagaatttggattttatagttaatagggagccattggaggtttttgagcctataagtgatgctccatactcagctgtggggaggtccttgttctctctgaagccattgctggttaccctgcatccagagtcactgttatagctgcaagtcattcctgtgcaagtgacacctccaccctgccatgcctccagacactccagtatggacaataacttttctttctcctctagcacatgaagaaggaagggggacccctgttctgtctgcaggggccatggtggctgagaaccaggcttttctcatgccttaggaataataggaagtagggtgagtttctagtctcaagctttgggaaagattgagtaaggagaatttgagatgtccacagagtttgaacgtgaaactcatttttacataaaggaatataacggatggtgtttagatttgatgccattcattattactttagcaaaataacattgtcctaagttctatacaggtaaatacacagaaaattctggaacgtggcttgcctctgagctaggcactttccctctaaactgtttggataaactcgcctgcccccgccgcccccttccccctgccagatcacatcactggactttaaaaaacaaaaatgaagtggatagattttttcccccagattccaatacctagaaatcattgaacaaattaataggagaaatgtgtgttctgaatttattagaaaacagtagtcaagcagcttaaacattgttcactgtcagagggctgtgttactgtctaacactgttacatgaatagagattggctggaccagttaatagaaatacagataattttgcagctaagaaagatttgcctttagctgcaaaccacacactcttttcagacataatcttcagtaaatggagtgcaacattgtggaggaaagtcagtgtgaccaattctgactgctggctttcaggcctgttccagaaggattaggacgatggccggcttattctctgcattatgtacatgcattgcaatgcctgagagctggctcacgctctgcattttggagaaatcacctttcttctcatataatggaaaatagagaaacatagaaaagagagcaactttgagatcaaagtattattaacaggcaggaaaaaatagagtcttggtttaaggccacccagagtgatgaacagtcttggacccacaggcccacatgacctgcctgacttggagatgcaacctacaaactgatttcatgattaagaagttaaaaacttgatttttcaactaaatccaattgttaataatgtggagactactaagcaagttcataattctagtcaacaatactaaattcaaagatgtaaaacttcatatttttttcttgttacttaatagaggcagttttattttaaatgaaaaaaagtgtgtcccacaattttctttcttgatagccttcattcaaaaaggtttacttttcactgccctagattgacaaagacataaacaaattcagaaaacaagtctgttactgtgtcaccgtccatccatgttagaaaatactactgcctaccactgagtgtgtgtgtgtgtatgtgtgtgagtgtatgtgtatgtgtgtgtgtatgtgtgtgtgtgagtgtgtgtatgtgtgtgagtgcgtgtgaatgtgtgtgtgtgagagtgtgtgtgtgtctgtgtgttggggggtgcatgcctgtgtaaatgggcgtttttcatgtcacttgctaatcctcagataggtctcattctctgagccccaatgtcctcatctgaaaaatgaggctaatgatacctatttcccatcatggctgttggtgctgaatggaataatgtgtgcacattgtaaattttatagccctacagccatgcaagatattgctgtcaccaccaccatgcttcatcacatgtatgccgtctgccatgggataacgtgaagacattacaaacttcttagggtaatgaaatttcttaacaccagctctggagcctaggtttataaatggtacagattgttttggagacgtgcaaatgcagttatgtgagggttggccagcttttgggtttcgttgttaaatataatatttatttaaccaaagtaatatataagcaagacttaaggcatagctcatagttagaactacagagctttattgtggaagacagtgtggcaattcctcaaagaaataccatgcaatccagcaatcccattactgggcatatactcagagaaatataaatcattctattatgaagacacatgcatacatatgttcactgaagcactgttcacaatagcaaagacatggaatcaacctaaatccccataaatgatagactggataaagaacatgtggtgcatatacaccatggagtactatgcagccataaaaagggatgagatcgtgttctttgcaggcatatggatgaagctggaggccattatccttagcaaactaacacaggaacagaaaaccaaatactgcatgctctcacttataactgggagctaaatgatgaaaacacatggacatacagagggaagtaacacacactggggccttttggagggtggaggcggggaggagggagaggatcaggaaaaatagtgggcactaggcttaatacctgggtgagaaaataatctgtacaaccaaccgcttgtgtaacaaacctgcacatgcacccctgaacttaaaagtgaaaaagaatgacagggctttaaataaaacccaataattccattttcttttctttttcttttttttttttttgagatggagtctcactctgtcccccaggctggagtgcagtggcacaatcttggctcactgcaatctctatttccaaggttcaagtgattctcctgcctcagcctcccgagtagttgggattacagacatgtgccaccatgcccagctaattttgtatttttagtagagacagggtttctccatgttgctcaggctggtctcgaactcctgacctcaggttatccacccgcctcggcttcccaaagtgctgggattataggcgtgagccgctgcacctggccaatagttccattttcaaagtctctcccatactttcatttcttcagcgttgttatgatatattaactgttttttctgattctgcatttgtatttatacatcacatgctactaaccactaagtgctgtttggtaattttttttaactgtcccttctgaggtgaggatttagtagttctctttttatcccacccttatgtgtttcttcttccatccttccaatacatattacaattttatttaaatcattaataaatgcttatattatcatgactttgtaaatcttatccatagccgagtcacccagtgtgctatgaaaaccttttctttcttgtattattggtcttattttaaaacttattctcatatggacttactcatgattcttccacaaagttcttaacaagacaataaatgttttattgcatttaattgtatcaaataatgagtcagtttcatggtttttcttgtagacagcccttctggttccttccatcatcttgccctgtctgaactggtttttacatagcttccgttcttctccaatactttgacatccttctgccattttcctcaggcggatcctctgacttccagatttcctaagcgtcacacctccttttctgacttatgccttgtctgatggaacaaacaattttaagaaggagaagaacaacaccagcctcctcaatgaggttttttccccaggaactctcttcctatttttagatgaccaagttgaaaaagtttttcaggatgtgaaacatccgcaggagcttctttgcagagggtacatgggagtcagatatttagagtccttttatgtctgagaatatatatacattttaccttcacacttgactgagagcttttcaggttatggagttctagatgggaaataattttacctcagaaatgtgaaggcatatctctgttgctgctgtgcttacagagtcacagctgagaaaaattccattctaattctcaataactttacatctttttctttctttctggtttatttttaacatttttccctttatatacattgtttaggaatttcaaaactggtgtactttgtataggtacatatattcatgggttttgggacctttttagatctcttcgctctaaaaacttttaatgccaagaaattgtctggtattttttttttttgggttgggggagaatattttcctcctccccaatttaccagttgcttttttcctggaatttatattaaatagccaatgtatctactgaactattcctctgattttttttttctattaaagttctcctttaccttttattcttctttctgggagatttcctcatttgtttgccatcctttcactggatttttaaattttttgtgatcatactttttatttctatgagctctttcttgttttctgaggttcctttttgttttattttatttttgttacatagctttaatatcttcttttattcattgagggtattaataataatttttggatgttgtattcaccctacattaattctgttttcttcaaaaattttcttctcttcatgctgatagcttctctttacattggaggctgttcaaatgtctgatgatccagtaatatttaagagagaggccccaaaaggctgaatggaagctcggtgtgcatgtctgtgacttatgcttcaccgtggggtcctggtttgttttattgaaaaaaccctaaactttagcattttctgtttagttttctcagagaagaatcctccactttccttaagagttctacatctatcttttttctgaggctgaataataataataattattattattttggagacagagtcttgctctgtcccccaggctggagtgcaggggagtgatctcggctcactgcaaccttcacctcctgggttcaagtgattctcctgcctcagcctcctgagtagctgggattacaggcatgtgccaccacgcctgactaatttttgtatttttagtagagacagggtttcgccatgttggccaggctggtctcgaactcctgacctcaggtgatccaaccgcctcagcctcccaaagtgctgggattacaggtgtcagccaccgctctgtgccctgaggctgaattattattattcagtggataggctttcatttgctctctctgcttttagtagagggtctcacactcaaacccagctgcggttgtattttctagttctctctggtgtagcttttttagaaactaaatctccagtctcatagctgtgtgtggcacatgggagtagtcagaggtcctcagaatgggggtctaattactctctagaaaggattcttcctgtttttggctcctcctcacaccctcaccttcagcactacctgatgcctctagtttctgagcttttctggaactctgtggggtgaccccacctctttttgtttgctgcttccttcttaacacatttaatttctggatttgtctactctgcctgcattcagctcacttcgcagcttccaaaaaggttgtcatctgtctcttttattgtcatctcctgttttctttcttttctttctttcttttttttttttctgatgtatgtcttttatttccttgactttcatcttactgggagtttctggagagagctgggctaaaagtatgtgtccagctcaccatagtgacctggaagttgcttattctgttttgctttacaacaatagaaaagttaacatattcgtgtatttcttcagaatttttaaacaatgttgttcttagttcctcttacttctaaaggacttttaagagtttttttaggtatttcatctttcccaattctctgtctgtgaccaggggtgaattggtaattttacatctttttttcaagcattccaagtagaggaggcaccccctgtgacttccagtggcattctgcagcaattaagttgcattcattcagctcatcatttaccttgcagccatcaactcctttcaaaatatccctttgattgtcagtaactacggacgtgaagctgtgggtttcttccaggaacaatgctcttctctgtagcctgtgttctcccagttttctgggaagccctgagacttgtcattctcctagcagctcagatgtcattctcctcaaacacccagatttcatttagcaccaacgaggtgctcagtctgggatttctgagggactgtcactggggagaggctgttgctaatgaggtgcaaattggcagcagctggggaggagctgctctctccctctagggctgggccccaggggaggaggggagggttgctctgacattttcagaggaggttggtgaggggccgaaactagagactcctcaccctttagcaaggcctgatgccggctgggggaggcccttgcgtcttgctgagaggctggtctggtctcacacagccccacctccagagttgctgccagctggctaatttcttggctgccttttctggctggctttacttgcaagcaggagaggccatgatcagacacggggttttcccagacattggagagacagctaagaagacccacagcccccagagacactgtccttgggattggtgttctagaaggttatgaggttggggtttggtggtggaagaggggttactgtagcaactgttgaaacaagagagcccatccatctccccccagcatttgcccgcctgttttacatggaagagcctcttatgcattaaactgttcacctgagtgctcccaccagctgcgcttctctgcttctgcaaggtgcagggctctcacagccattttcatctgcaagggtctctgccagagctgtggcagagttttctgtgggatgaatcagaaactatgttctgatgaagagaaaatggagggcagtgggtggatgtggaatgtcagtaggtagttaagtggctttttgtctcctggtctgtctgacaaagtgtgctgattggggcctcctgctgtgagattcatttgggtgatcttgagcaaatctcttaatttctctgactttagcatccttcatcttttttctctgtatctcattttttctaactttttaaggagcacactgagtgctagcctagatgcaaggatgagtgaaatgaataaaatgcagtccctgtcctcacagaactcaccttctggtggaagaaggtggacatatgaataacatagacttacacatgatgagaaatgcactatgtcgaaggcatgcaagaagtgtcatgggatgatgaaggaaggggcaacgatgctctctgagagggtcagagaatgccctacagcggtagtgacatttgaactagttgttgaagactgattctgtagggggacaaggaatagtaatggaggtttgaaaaaacatggtgtattctagaaaagacaagttgtttgttgacactagcatgcatgtgcaggatgaactggcaggctgtggggctggcagtggactaggtcagatgatgtagagtgcttgccatacaatgagtttggatctcaccttcttggggatggggagttgtgctgggctgtgcagagaaccatgatcaaatatttgctaaatgagtaggctgggccatatgatcatttaagatcccttgtagtctggctgggcgcggtggctcacgcctgtaatcccagcactttgggaggctgagacgggcagatcacaaggtcaggagatcaagaccatcctggctaacacggtgaaaccccgtctctactaaaaatacaaaaaattagctgggcgtggtggcgggcgcctgtattcccagctactcaggaggatgaggcaggaaatggcatgaacctgggaggtggagcttgcggtgagccgagatggcgccactgcactccagcctgggcgacagagcgagactctgtctcaaaaaaaaaaaaaaaattcccttgtagtctgaagttcttggattttctgtgtgggtacaaagctgtgggtctgggaacacagcttcgttgaggagtgttatctggtgtaacgtctgtgagtaggtgtttaaatgtgggctgtactcaatagctatattaagaggtagcatcaagcagggagtggagcaccaggttcccagttaagctggagtttaaatatgcaagtcttgtttcagcctttgatcgtgcttttgaccatggctaaagcacttaatctgtcgaagagccttaggatcatcacctgtaaaatggaaatttccacttctgtgcagttgggagggctttttgtagaagctttatttgacaatgatttttctgttgcttaggtcatttgaggggaaaaacattattttaaagtttaacgttatttctaattgtcttaggaactatcaacatacatggaaatagaaattatctgtgtattgatttgtgtgtaatacacttatgctgagtttttcctgagtttttgatccatagatagataggaatctggtgggagttggaaatatgggcaaaaaatggtgggagggccaggcgcggtggctcacgcctgtaatcccagcactttgggaggctgaggcaggtggatcacctgaggtctggagttcaagaccagctgaccaacatggtgaaaccccgtcactaccaaaaatacaaaaaattagccgggcatggtggcgcatgcctataatcccagctacttgggaggctgaggtaggagaatcccagctacttgggaggcttgaacctgggagtcggaggttgcagtgagctgagattgcgccatgcactccagcctgggcaaaaatagcaaaactccgtctcaagaaacaaacaaaaaaattgtgggagatgggaatatgtgccaaaatggtgtgacaggagctcagttcatgaatgtacagatacacaaagcttaatggtccacttgagccatctgaggagtgcacttgtgtggttgatgacacatttctggactcctaaatattagtttatgcttattgaacttttgacctagaggattattatggaatggaatcacatgatgagcagtttggaccaacttcagagcaattctaaatctctgagttgcttgtttgctttcgggttgggtgtatttccttcaattttgtcttagaaggtttttagcttggtagcctgccatcttctcaaaatattcccagttagctcatctttgtaaccaaatggaataaacggtttctatatgattctcatgctgtaagacaatgtcattgatagtgtgtagccaagtaatggtgaagccaataagaatattcaaaatatggagcaactggtactggttgtggatgactgataagttcgtactagtacatagtgtctgatgttagcccctgctgtggctaagaaggcctgggacacatatgcataggaataaaacagatgtggcatattaaagactgggtaagaacgggtaagaaaggcatgggaaggtaccttttagcattggcctcactcagatacagtttgcattctctacattcataggactcttatcattgaaataatccactggtatctgcagattgattttccagtaggagtgatggtcagtgtgacctaccaaatatcctcacatctggtctgcaagggctttattaatcactagtgaaattatgaccatggtctgtgactataggactgtattgggggaaggtgagtcacaattcgacagcaacagtctttacttgttctatacacataagaaaagtactcattgaagagtatgttttcctcattctgaactcaaataaacactttgttattattgaatgtacgtcacttatcacctttagtattatttgagagttataggtatatatatcttgtggcctctaaataattgtaaaatcctgagggcaaagtagttaattcattcaataaatatttattaagcaccgagtatgtgtcaagcacctactgtgtgttatagacactgaatacaaatgaattagacaatgagacactttgaactgatgacactttgaatcgaattgatgaaaggatgatggggaattgttcagctgaagaggggtgggaagggtcttctacaaaggtcaagaggtcagcataagcacaggtatggccatgggaaatgacttggctgattaggaaataaaaagcaagttggtaaccgagaaatataacatgatcagttgggtcaagaagtgagacgagaatgataacagtgtttatcacttaaattgtcattttagtgttgctattcagtgagggagattttgtcataactcctgggatgctactggcatctagtggttagaggtcaggctgctgataaacatcctgcaatgcacaggatggcccctcacaacaaagaactctctggtccaaagtgtcattagtgccaaggtcgagactcccttcttcggatctttttacatttggattgcatcattcaggtcttaactcaaaagttccttctttagcagcttccttactcaccccctattgtcatataaaaatttgcctctccttctctgtcactctctattacaaaacaatgttttttgtctttataccttttgataccatctaatgttatattatgcatttgtttatttttattatctgtctctcctcttttaaaatataagcaccacaaggtctttgattggttcactgctgtatctctagagcttagaatagtgtgaggcacattggaaaatgcatggaaaagttcaatatatgggtgttctgagtggaagaatgtggtaagttggacatagactctgagttcctggaataatcacagtagttaacattcatttttaccattgatactaggccctgttccaagcattttgcatgtattaactcaatccccaaaacaacctcagggggtaggtatctgattatttccattctacatatgaaccaactgagaaagagagttattttcccaagatgtacatctagcaaggggcagtgttcaagaggtaaattgcccaaggtgatcttgtgtgtttattcacacatgctttttgtggctattagtctgagaatgctatggggagttgggggttaagtgacttgggaattggatttgaggggtttcaaacaatgcatccaaaacatagatggacgggaaatataatgaactaaatgttggtcatatcgcactcaagggacctgtgagccatcaaggtgaaggctaacatgaaaaggattctctcattcaagagaatggtttcagatgaagtgtggaatttgtaatgggaactgaaatcaggagagcagacttgattatttagggacaggttgatgatgggaacagacccagggaacaccctgacatcacaaatatataagggcctataatataatataaaagggtacccataatgaaaatagaaagagcagtagagtcacatttcaagttctgctttgggcacaagcttctatctaaagtctcttttctcccttgtagaactaatcttttctctctctgttctacctacagtattttatattttcaatgtattaagtgacataagagaggtgttagataatagctagtactacgagtgtcacctaagcccgtaaacttccacaggcctacatcttcatctttgttcatatccatgtccctagcgtgaacatccatagctgacatctagtagtctttcaatattaataaatagatgatgttgaatatgtgaattagaaaatgtttattgggagaataaatgtatcatttcattagaaaatttgtttgtaacccacatcaaaagaagaagaagaaatgtgtagatcagtgaacttttctgttgttttttctatttcaaaatacactcaacccccgacttcttaggcaagccatttagctaatttctgaaagggagcagctaatccagcaccaaagcctgtgcagaagctgggccagcaactcaaataagatgattttctgagaatgaccagccatgttggcttcacatatggaagacgagtttctgaattctccctcctctcgggtggcacatggtgtcttctctttctagctgctccaggacgaaggaggggggatgaatttttaaaagattcaggggaaggaattcaggttctagaaatatccaagaaaagtaataataaaaccagtaattctacttttatgagccaaaggtcaatattatttagtttttttttttattttttcctgggaagaaaaaagagagctgatcttttgggtaattattgatatttccatgttttcagcaggattcaagttagccaaggagaagcataatctttcattatccaaactggagatgtcttgagtaatccagtggcaggaattgctgctgaaggagtgtattttcttttagttcatctgcctttttgacctaaaaccagcgtaccatttttttgttttaaaatatacgtgatatacatacatggtttgtctacctctggaatatttataggctcatattcctttctatacttgttctctagcgggggtgcttataacatttaataatacttacagagtctgtttcttagtctcatttcaaacctcaatgtttgtgccaggttgtttggagcagctcaagtctctgaggttattttcccaagatgtatatctagcaaggggcagtgttcaagaggtataatacccaaggtgatcttgtgtatttattcacacatgccctttgtggctactagtctgagaatgctatggggagtgggggattaggggccttgggaattggatttgaggggtttcaaacaatgcaccccaaaacatagatgggtgggaaaaataatgaactaaatgttggtcatttagtccattattagcctcagagaagctagaagctcttaaaatattcaagagtatgagagattcaacccttcgaagagaagaggagttgatgatggaatttgaatcgttttttggcatttctttactttataagaacacatgacggtgttccattccagtgcagaggagctgttcttaactcttaaatggagagccctgctgttagagaaaaggcttcgtgaaggctcctgtgtgtggggtcatcctactctccgggtggcttcctcctcccattcctcaccttcatccatcactgtacttgcacatccatcctttcattctgctctggagatcctttggaaagggagaatagaaaggacaaaccattgatcgatagaggcagtaaagctgtcctttggggtttcacaatatgtcctgtactatttttgtgtttagcaaaaatccattttgcctcattatgagcctgttttcccttgggctttcacttctgagattatttcaagggaaattatgtctatatattagtctcatttgcccacatctcactcaataactattagcgttattagatatcctgaaccaggaagctgcattttgccagcactaaatgcagcttgaaattcaaagattcaatttggagaaaaatcactacatttgagtgggttaaaatcttgccaaaaatgcatttttccatctgtctcatggcaaaagctcttttaagatttgaaatttatagctaaggacttccagtcatctttgcaaagtggtctggaactagagaatatgataagactggaggtacttgggagcattcctctgaggtggaggaaggagttgacatcagtttctttctgttttaagtttattgaatggtggacatcctcagtatcaaatgctgtgaagtcagcaccagcacactcaacacccaagggggtggttcacaaagtgcatccatagccctgccacgcccagtgtgacatgactgaaagtgatgatcatggtcactttcattctttcttcctgacctgaatctgcctgggaatatgaacattgggttcatccttactgacctactctaatacatacaaagaaggctgtcagcttgccaaacccaaacaagaaatcagaggccaagtcaggagttggttttcagcctcttcactgatgtgacccaggagaagtgatgctcccgagagtgactgtctgcactttgtcttagcagtgctgatgagaccagtgagcactagcaccatcaccagtgagaactgtacctggtccccctaagtctgttcctgtgtgggtggaccctgcctcttagggttgttcctggtctatttactttctttaaacagaggaactcccttccttctggttgcatatcaacttgtgtctctggcatactttctcagggtcattgtttggggctctgctctgttgacttcttgaccatttctgctgttctcgcaactgatgctttctgtacttcggtgcattgtgcagcaatgatttgagaggttcagtcttctctcttacacatataagacatcctgtattgttattgcctcaaatatgactatatacctaattagtatcacacaaaggcgcaacatagcttagtgagtagaacacaggctttaaaagtcaaccttcttgggactaaatatttaccactttccaggtctgtggagtcaggcaagtgatttaaaatctcttggcctcaatatccttctttgtaaaatagagatattagtatagtctgtcacatagggttattgtgagtgatgattaaatgaattaatatatggaaagggcttggaatactgccatttatgcattaagatatcaaattttagttacagtgatgatgctaggggctcagcataaggacctcaaaattgcgcctgaaagggcagggtttctttatcagtcatcctgccttggcaccttactgtcctctaagactctagggaaatataaaacaaaactaattaagaggttgagtgtaagctttgctacagttaaatgcctcccgtctttataggatatagaacctagatgatgatgatgatgatagtcaacatttattgagcaattaccatgtaccaggcctgtcctaagccaaatatgtaatcatatttattcctcataaaaaccatatgatgagaagcttatctctgttttttagttgaggaaactgcaactcaaagacttggagctagatttacacccaggtctaactatgaataatcattatgaactttctcctttacactagactggttctcctcaaaacaggaagcctgagggaatggaaagtgaagggcatctccctgggatctagtcctttgagatgttggactttgagcaagctacgcaacttccccaaagttcagaattttaatctgtaaactaagataacagctatttcacaggttgttgtgagggagacaaaacaagctaaaatatataacaaagcaggcaaagatgtatacttcaagagtcactacctacctaggctggggcaattagaaattctaaatatatgtacataagtatttagcaaagttatatacttcaagagtcactacctacctaggctggggcaattagaaattctaaatatatgtacataagtatttagcacagatgataaaggatgggcaattcattctgagattaggctgtagttcttcttcagtatggaatcagagctcaattatctttaaccattgtgatttggggaatagttttggtcctaattgggtgtacatgatgcctttgtcttcagaagtctgatcaatcaggggatgctgcaccacaacccttatactacgttttagtgtttctcaatgtcaagagacttctgtaacagatttcagttctttctgatggctttgaaaaatgctagtaattctctgtctttctaatggagtattttgtgtttgttgtctcctgaggtcagaaaattactttggggaagttgacttttgtgagctgtgagtatggtgtgtgtgtgtgtgtgtgtgtgtgtgtgtgtgagagagagagagagagagagggagagagagagagagagaaagagagacagacagagagaattaaatctgtattgttagttcttggttagaatagagcttaatggatcttcccatttgtgaaaaccccataactcttcctgtgtaatatcattaaagagcctcctgacagcagtaggtaaggagtagctctggggtgttactttttaatcactttaagcccattttcgtgtgttattacagaaccatccctcttctttatcactgcatcttccaatagcacaccattgctccaggaccagaattcagcaacaattttagtttttctgttgacaataaatatgttagcctgactgatcaaggctgatgcatgagcttgatctttgggattatttccattctacatctgagtacatacgtagaatgtactacgtaagatagagccagttctgccaactgtctgtggttgtcataggtatgcttcatcaaatattctggcgcatggtaggtgtacttcctggctttgtatatttgagtggggccacctaaccagttctggacaatatgttgtgattggaagtgatgtgtatcacttgtgggatggaatgtttatttgccacaaataaataactaaaaaaaaaacttctccagggatctcttttccttctgccacagttacatcttcttaattgtcagcctgggtccagaaagccccagccaattctttatagacaggcagtgctagatagacataaactgctgttattttaacaagtgggatatgtcttatgttcctacagtataacctacttcatctcgactaacacaatgatccatagtcagggacatgtgctttttggtgagcagtcaaggtgtggccttgatgtcccttgttttctctgctttgcctttactgtgaagtctgtctagcagtctgagaaaatttaagaccctaataatagatgtcttggggcaatgaaacttagtacctttcatagtttcgttttcttttccttaatttttttttctgtatttccttgtaccagccattaatgttttgcctgtcacatagcagccactcaataagtgagtgatgaatgaatttgtacagaaatccattgattggtagggaacaattagcattagcattatagaagtgttttgattctccctgaacttattgttgtcaattactcttttactcaattcaaccctaagtcatactgttttctatttccagggctgccctgatgagaggtagctttggcctatcaataggtgcattggcctctctgagacagcagcacaggggacctcagccttctactgcctacactcagcaaacagaaatatatgaggctcttggctgtgaaagcagaagaacctcttactcctgcaccattttatggccaaggccgtagcaaactgctgactccagagaattttttcacctttttttttaacttatgtggatttttttttttccaactgggttttgcgctgttgctcaggctagagtgcagtggtgcgatcatggctcactgcagcctcgacctcctcagctcaagttatcctctcacctcagcctcttgagtagctggaaccacaggcacacatcctcatgcctggctaatttttgtattttttatagagacagggttttgccatgttgcccaggctggtcttgaactgagcttaagcaatctgccttccttggcgtccaagaatgctgggattacaggcatgagccacagcacctggcttgtagttttaactaaactaaaacttctctggccctggagaatttccctttctctaaacttacgcatatcaggacatgcctaaagtgtctattttatgataaagtgatgagaaggaaagagacaagggttaggacagcccgagactgcaggctgatacctggtggcaaaatactagtctcttaaacactaggcacatatcctgcccaattagagatctccctggaatcaattccttctctccattcctcctgtcattgcttcagatcaggctttcaaatctgttgattacactattaaattagaactgtgcccgagacatcaatgagtatgagctattattatctttattattgctattctgtagcctcctgttcccgtctccagtttttcttcatttcaatccatactgtgtatcttttaaaaatagatcagattctgtcatttccctgtttataaagctctcttgcctccactgcctagaggataaagccctaaagtctgagctcattgtacctcttcagccatgttctcactcatgttagctgtatctgaatcatcaaggaagcttgtcaaactctctgtgccccaattcttttctccaagagattctgggaagcttttgggtgatagggaagggagatatgacacattcctgggggggtgtggagtttgagaaagctcccccagtgattctgaggccacttcttccttacttagccatccccacgtccacagctagaacctctaatgttgccatgtgtaatgttggttccagccacgccaggcttctggagttccttagtctcaccatgatctttgacatcctcatggtttgcaggtgtattctcatcactctttatgttcttcttcctttttctgctcgggtctctcccatggttttttaatatttcatttaaatgttagttcttaggcctttcctgatattcccagatgactgtctgtctcctctcatggcatgttgcattgacctacattattatccttgttatattgcagcctcattatttgtgcctgctactgcctggacagtgggggctaggggaggcaggtgcctggttctgtaatcttctgccagatttgaaccgagtttggtgcatagcaggcacttaatgagaagcacactttatgaggcagcactgtgtgatggttgagtctgggctttggagtcttccctcttggggaccttgtgacaagtaaatgaaatactgtaaacaaggcacttagcctagtgtctggctcttaataaatgcacaataaatggcacctaccatttttttgaaataaatattttatgattaagtctgtatttataagattaataagtctctcatttatatactaatttccaggatgcatagatttttcatccagatagtttatataccagcaaaatgggaaataacaacacctgacttttttactggaaaaatattggttgctgtggagattatctactacgttgtccttactctcaaagagattacagttaaaacacaccaatatcaacatgaacaactaggaaatagcaatgagccaatcacagcagagatcttaattggcttcataacaaagtgtggtctgtaagccaatgggaatgaaaggagaatcaataaatcccaagagacgagagttgcctttttgggggacacagtcatacacacacctatattcgctctggaggaaaaatggtggcaagagggtgtatgacttgatgagtgggggagacatggtcaaggggacaggcaggcaggtgagagtctgggctgactctgggttggtcctagtgttagggccatgccactcaaagtgtgtttatggacagtagcagcagcagcggcacctgggagcctgctggaaatgcagactctcaggctggccccattattttttccagtttctagtttcagggcttgcctgatgggagacagccttggcctatcaatagctgcagtggcttctctgaaagagcagcacagagaacacggatggactataatctgcattttaacagggtccccagatgatttgtgagcacgtgaaagtttgagaagtgctggcccagggatgtgcagtgacttggatgggccctatttagcgctctcctgtgagctgctggaacaaaatagagggtacttaaaagcatatgcacttccactgtaggcttaaaactgcagaaacgaggtagctcgtgcataaatgtaataattctttgttccaaatgtacctagatgtcattatgacaaaacataaaatccatttggaactgttactgattcctagcagctttttgccattagacattttccaggcatccaaacctaaaataacatggatcttgggtgaaggtttttgaaatgccttatattaaaaagtccttgtatttgaaaaccagtaaagaagtatttgggaaccattatgcgttctttcagtactgcatatgcagaatattttgggtcttcacagatagacttgtgacgcaaaaataaaataaactatctcgtaatcacacagaacagatcactgacatatatggcaagctgttgcagtgacccaggattaaaagtttagcatagttcttaaatgtgtgcctcatactgcatcagctccttatttcgagggctcatagtggatgaagcaattacctggatggccctgtttcttgccctttccctggtcttctgccacgtaggttggtggtgatggttgggaaatgggggtggcaaaagtgtcctttatggattttatacagttcttattccactttttggtgggtcactggcctggttgctgtcatgcatggtggggaggtgggcagatgagaagcccagctctattgccaatcttagtcctgagcatagatgcagaggttcaggccgggtgcggtggctcatgcctgtaatcccagcactttgggaggccgaggcgggcagatcacgaagtcaggagatcgagaccatcctggctaacacggtgaaaccccatctctattaaaaatacaaaaaattagccgggcgtgttggcaggtgcctgtactcccaggtactcaggaggatgaggcaggagaatggcgtgaacccaggaggcggagcttgcagtgagccaagatcgcaccactgcacttcagcctgggtgacagagcaagactctgtctcagaaaaaaaaaagaagcaaaggttcagtttctgatattttgtttccaatcatgtggcattgacactggaatcagctagacctgcattcaaatcctgactccatcacttaagctgttgtgtaactttgggctggttacctcactaacctctctcagacctctctcagtttcttcatttgcaaagtggggaataacaacacctgatttagatgcaacgcaagttgcaagtcattcagcatttactcatgatcagtgagagtcactgatatctccgtttttctcgtttcccctgccttctaaagccatcaggtggggaccttcatctaccaaacagacgctaaagaaggatgggcacggtgagtggaaaaaggaggttgaagagttgtttttgctcccaagtgtttcataatgaatgaggttaagaagagaaaataaaataccctgtccccttgctcttatctggctcaaatacagcctgtattatttagcgtcaaagaaattatcttctcatgctttgttcagaccactccaactcatggccacagttctgacactggcttagccttggctgacctgtatgaagtcaaataagttccttcacctttcttaacctcagtttctttatcttgaaaatgagagcatgaacctttgtgatctctaaggtatttccaattattcagttctaagagattatgcccatctgagaacaagtggaattaatgttatgaagggtgccttcaaaggagaaatgcttgagatgggagcaagaatagatgcaaatcatgcctgtttttgagctcgggaaagctttcatatggcagggttttatattcatctgcctggttgcatgcttatgcactgcccttgtttggccttgaagaacatggttttttccattgtttctggtggagataatcacaatgactatgtcacgtctgcttgggaaaccaaccacggctgctgatctttggatccttgtctgggaagctctcaagccagtagtagtttgcctcaaccattcaggggtagctcctctctggccaggaccttgttatgccttccctgcagacagcgtaagggatggtaggcattctttctccattcgctccctcgccagaatcagcactggtgattgtcaggcaggtaaggagaacactgtcatgctcaatggagatgtcagactaatgtgagtcagctctagcttccctcaagcacagctggaagacaaagaaacagatttactggagatgtgcacaaactagtgcctattatgttaaaaaacataaataaaacgagggagaaggcatacagagagaaattatcttttaaaaacatcttggcaaaatagcactcaatacacatcagtacaatagtggagtcatccatgtgtgtcaacctgtagttcttaatgacagggatgtataaacaagtaggtaataagcagcccagctgcttctggggtttctcttaacttactttctttgaaaatgagttggtggaaatacagctgaaaacacagactcagaaaatgaatgagtcatttgagttgaacataaaaaaggagacctggatgaggatttagagagaagatccattcaactccgtaagcctacaaagtaagattagactaaatagatagaaattttattctactcccaaaggataaacatcattttccatttctttttgtagacaggcaaagctctgccgtgaatcatggttttaatgcagacttctttacagaaaaagaaatatatccatttcctttcctttcctgtgcccatccaagcttgttatcgagaggagtgcctctgtaccctctgtcagctagaatcaatgttaaacactgagcacacaaacaccaaaaacgtttacatctttttatttttcttcaaagacttcaaaactgccttgcctttgttcttacagataatttttaatagctggtctagttgtatttatgttaaatgggggcacaggggtcaaagagacttattaaaaggacggaatgagtgaaggacttctcttctgacgaatgaacagggcatcgagccaataattaaatcttattgaagcagagaaaactagcctatatttatatgcctagaatgttctgagtgctttcttgtaggatctcttttcaataattgtaaagtggtaattttcttcattttcctgaagagaaaactgatgctcagagaggctaaataactgcacaagctcacatatccagtagagagggggaagagatggaagtccaaagtcaatgccacactgcttcctatttaacaatatcaaactcaggcatcaagctcctgctctatgccaggcatttgctgggtactggagatgtgaagagagaatggtctaagcgcttactgttgagtgcttcccaaagcatgtgctcagtgtttgctggttgtcacttactctcacaaaggagctccctcagtctagcctcagagaagataattgtgcaaagtgggcatgcttgttagcttatattttcagaaaatgaaaaacgcatgcccggactatttacctcacgaatctaagatgatatagtgagcgggtgttagggatgggacctgggccaaatccaaataggttatgcatttagccttcaaatccttgctgtgttccaatgtccgtttaaagcttgttaaattctccaggatatttgatacacacttacttaatatgtttcatttgcagaaatggttgtattttaattgaagctcctggaagtgaaactgcgcttttgtaagaaattcttaagtaagtggaggaaaacattgtgctcaggaaaagttttccagagacttcaaaatgacatgaaatgttaaggccgtgtccagtcaagatgcctgtatataaatgtgaaaggtgcattgtcttagtagacatcataaagaaaaatagcatcaaaaagaaagaaaatatcatacagctaaacaggtgatctaaataatatacataacttagaaaatgtgaaatcagtggataggattcatatgaggatctttttaacatgtttcctatatcagaatcaaaaatacagttccagtcacattactttcttgtttgaaaacattttttggctctttgttactgacctgtaatttgtctaaactgtatactggaatgtaaggcctctgaagagtgatcacagccccctttttcaaacttacctccatcttctctacaacccagcaaaactggtctcctcactgtgtcctgaatttccttgttttgtctcacctgcgttttctctcagcttgcacccctccatcccttctctccaaatgtagaaacctttaatcgctcacttgcttctccaggatgcatttatggatctttccttaatgcaagcgacctgccctggcctttcctctggattcccttttgtagtgttaatatttgcatagtgattcttattttgctttgctttgtattcattatttttagtgcttgtcttattttacctcctaaactataattttcttgagagtttttctcatctaatttttttgtctttgtagcatttggcatagtgcttcatgaattgtattaatgaacatcagtaggtattagttaaataaaattcaattaaataaaggccagagtaagatgtgcagttggaacagccaggtgttagattttctctgactcagagatgaacagcttcccagcaagggaagaagttcgaggagagaggccggtaggagaggaagccacttctataatttggcactaataagaaatttactctggaaaatctcagtttttcacaaaccatctttcacttttctcatgatggagaatatccctttattagtcaggaccttctgcaaattaatgggcaagtctcatgtcctcataaagccataaccctatttatgacattacaattggttacttagtgataattataatgtcacaaatagaggattattatgatttgaggtgcaaaacagctgtaacaaagaaagtcagcaataagtggacatgatgtagtaaatttgcagctggaaaagaataattcccagaaagatattaaaaatcattttaatagtttttggggaacaggtggttttaggttacatggatacattcttgagtagcgatttctgagattttggtgcacctgtcacccaagcagtgtacactgtacacaatgtgtagtcttttatccctcatccacctcccacccttccctctgagtccccaaagttcatatattatccttatgtctttgcctcctcatagcttagcttccacttagagaacatacagtatttggttttccaatcctgagttacttcacatagaataatggcctccagctccatccgggttgctgcaaatgccattgtttcattcctttttgtggctgagtagtattccatgctgtaattataccacattttctttatccactcattggttgatgggcatttaggcccattttatatttttgcaattgccaattgtgctgctatgaacacgtgtgtgctcgtgtcttccaaaaatgcatttttttgcataaagttttccactgagtgatggggcaggggggcacatgctaaagttgaagcttttgccaaggagagagagctgagggctgcaattcttttggaggatgcttttcccagccacaaacccatattgatttcttccagaacatttactaatcctctctccccagctctcacccccagtgggtgcaagcctgtgcatataaacacactcccttgtttcccattcaggatatggaatcttatacatcataaaagagactgatctccatcctgattcataggactgtcagcagatggcagagagagtgataatgccacttactatcaggtcactccgaattattatttattctgtggagagtgagactgaggactgaaacctgatgtttaatttttcaaaatcacatggttagaaactggagggtcccaagctttctggtcctacatctaatgaactaatgcttttgttgtttatttttgcactatactttatagctatgtaatgatgtaaaggacacagttgttttatgaaatccatttccccttgctccttccttttgaaaccttgatcttttttttctctttctagtagctaatgagattcaggaaagccgatcccatttccaactccagggagcaagaaagtataatatttgaccttccagcctcttagcatcagctggtacttccttcttttctcttcctgagccatgagtcatgcttcatcaaaagtttcccaggctcctgaagtgaaaatgacaaatcagtgcataagagtgataggaagagaagtacaagattgtattagacagtatagaacaaaacactttgcagaatgaaaaattgcagagtgctgacacttgttctacagaaagggcatcagcacttagatcactgttgaacaacattcattttgggatgaatattgtctaaggtgaggctgaaattctttgcttcaaattctacaaaattcttattctacagaatggtggattatttagctaccaaactttactgagtatatagttattgaggatcaactgggagatgcataattgggcatcatgagcattggatggagcattgggtgggggcagaaaatgttaaggtcatacttgaaatatcaaagtgcacaacctaggaatagacttcaatatcaacaagatttgactcagctgaatctctgttttgccagtcttttctaggtctagttttatacctgttaaacatgaacattaaaacatttcactctgtgttagtcagttcttgcattgctgtaaagaaaacctgagactaggtaatttgtaaaaaaagatgtttaatgggctcatggttctgtagcctgtacagaaagcatagccctggcatctgcttctggtgaggcctgaggaagcttccaatcatggcggaaatcgaagagggagcaggtgtctcacatggcaggagaaggagcaaaactgagagttggggggaggtagcacacagttttaaacaaccagatctcttgagaactcactcactatcctgaggacagcaccaagccatgagggatctgcccccatgacccaaacgcctcccaccaggccccacctccaacactggggattacatttcaacaggatatttgggtggggacaaacatccaaaccatattacactccttgcctgtaaccagtgagaacccatttggctggtatatcactccagtttgttctaaggatgtagtaggtatttgccaattctgttgagcaacaatctcaactccaaccttgccatattctataggggggaaattggaatccccaaatctcttgggtacctgagatttctcattctccttaaaaggtcctggttgtcctaaagcaaccatgcctcctatccctgccacccctggtatttgcttcctgttttatttctaacagttgtctagagagaaccgtactgaaaaactgaatcaggtgatttctaatgccattaaatacttaaagttagcatagaactaatcattatagaagaagatttcaaaagcttcaaatacatggttcataatctcattgaattaaaaagctggctaaagattcaaaatggacgcacctaatgggacagcaaacaatatctaagttgtatgggagatgttgtaattaatctctcatttaatcatcctttcattcaagcattcctttgattggtagatgaggctggctggcttacatcagaagcagattttgatcagttttccttaggaaagcatgtgattgacttcttaaccaatccagcccaaaatggatgaaccataatatcaaaataatcacttttaaaagagtaaattctaggcagaataactgttctcagtatgttcttatgaggagttggactggttttgttaataatgacattatgagatacaatttatataccataaaattcatccttttaaagtgtacacttttgtatattttagtgtgttcacagagtttgactatcatcactactttcttggcaatcttttaatcatcctcagaagaaattgtgtacccattaatagtcacttccccgttccccacagtccctggcaaacactaatctactttctatctgtatattggcctattctgggcatttcaaataagtggaattatgcaaatgtaagtttttgtgactgtcttctttcatttaacataataatttcaaggttcatctatgttatcggatgtatcaggccttccttccttgtaattgctggatattattcaattgtatgaatataccagtactgtgttgaatagaagtgatgaaagaagacatcttttttgccttatctaagagagaaaacattcagtcttttactattaagtgtgatgttggcagtgagtttttttaaaaaaatagatgtcctttattaggttgaggacgttcccttatattcctagttttgttgagtggtttttaatcatggacagatgttgggtttttacaaaaatgctatttctatgtctattgagatgatcatgtgggtttggtcacttagtctattaatatggtatattatattgattgattttactgtgctaaactaaccttgcactcctagggtaaaatctccttgatcataggtataatcctttttatatgttgctgggttgggtttgataatattttgttgaggatttttgcattgatgtatttaaaagagtctggacacagtggctcatgcctgtaatcacagcactttgggaggctgaagtgggtggattgcttgagctcaggagttcaagactagcctgagcaacatgataaaataccctctctacaaaaaatacaaaaattagctaggcgtgatggtgcacacctgtggccagctactcaggaggctgaggtgggaagatcacaggagcccaggaagttgaggctgtagtgagccatgattgtgccactgcactccagcctgggtgatggactgagatcctaactcaaaaataaaaaataaaaataaaaaaagcagatatcggcctgctcttttcttttttgcgatgcttttgtttggttttaagatcatgataatactggccacgtagagtaggttgaaaggttttccttcctctttcagttctcacaagattttatgaatgattggtatgaattctttaaatgattggtagaattccccagtggagccctctgggtctgggctttccattgtgagaacttttaaaattactaattcagtctctttggttattataggtctcttcacattttctgtttttttctttagtcagtctcagtagtttatgtctttataggaatttttaaatttaatctaggtcatctaattagttggcatatagttgtttatagtattcccttatatttcagtaagatcagtactgatgttcccccatttagtaatttgagtcttccttctttttttcttggtcagcttagctgagtttttcaattttatttattacacttttcaaagaatcaacttttgattttgctgattttctctattgtttaagtcctctctatttcatttatttaggctctaagttttattattttcttccttctgtttgcttttggtttagtttttcttcttctagtttcttaaggtgtgaggatatattatttgcttgaaatctttctttatattttttctccattctttcattactgtcttcttttgtgttaaacatctatttcctaatgtatcattttaattatctcttccacctatttttgagttactttattactgcttttttctgaggattacatttgaaatcctaaaacaatgtagttcaggttaatatcaacttaattttaatagttttcaaaaacttagttcatatacagctctgtttccttctcttttgtgtaattattgtcatatcaatgacctctttacacattataactatatcaacattatcttataattattggtttatgctgtttccatttaaatctgatagaagaattataaacaaaacttattaatactgtccttcatatttacctatgtggttacctttattggtggtctttatttctccatggatactcaagttactgtaaagtgttccttcattttagcagaagggttctttttagtatttcttgtaggatggatcttcttatgatgggttctctcagtgtttgattatctgggaatgtcttaatttctcataaaatttgaagaatagttttgctagatttggtcttcttgctgacagtccctttctaccagccttttaaatatgtcattccttctgactctggcttccatgttttaggataagtcagctgttagtgttattgaagattgctggcatattatttttctcttgctgatctcaagattctgtctgattcggtttttgacagtttaactatattaaatgtataggtatgaatttctgagtttatcctacttggaattcattgtgcttcttagatgtatagactaatactttttattatttaggatattttcagactttattttgtcaaatacactctctgtccctttctttcttttctctccttctggaactctccttgcatgtatgttggtatgctggctcatgtcccacaagtctctgaggctttgtttattttccttcattcttttctgtttctcaaactggatgatctcaattgccttatttccaagtttgttaattctttcttctgtccgcatagttgtgctgttgacctccttcagtgaatttttcatttacgttattgcactttcgaactctagaatttctatttggctcttttttaaatgatttctatttctgttgaaattgtctatttggtgagacatcattctcatattttcctttaactctctaggcaagatgtactttagttctttgaacatacgtaaagcttttttttttttaaatggagttttgctctgtcacccaggctggagtgcagtggtgcaatcttggctcactgcaatctccatctcctgggttcaagtgattctcctgcctcagcctcctgagtagctgggattacaggcatccaccaccatgcccagctaattttttgtatcttttagtagagatggggttttgccatgttgatcaggctggtcttgaactcttgacctcaggtgacccacccgccttggcctcccaaagtgctgggattacaggcgtgagccaccatgcctggccttaaagctttttatttaaaactttgtgtaaccccaatatctaggctttctcagaggcagtttctgttggctgtttttccttcatgtgtatggaccatgctttcctattttactatgtatcttattttttgttgttgttgaaaactggactgttaaagtaatataatagagcatccttggaaatcatatccttactttttgtttttgttgccattactagtagtagtagtagttgttgatgctgtgtgtttgtatgttttttagtgacttttaaaattctgtaaagtctgtgttctttgttgtgtgcagcatctaaaatctctgcttggttagcttagtggtcagctaataattggacagacatttcctcaaatttattcaaccaataactttcccactacttttttgtgatctatatgtgtgagttagagtatgcaataaatactttggtaacttgataactctaccttagcctttacttcctgctttgtcagccaaaagtgagagattggggtcttctcagatccttcctgggaatactcacagcttgcgcatatgcatggctttccagattcccaagaatatgtcagaactttccaaagctcccgtggacttctcatttcccatattttgatttttaagtttttcgatcagcttcttaatttgccgcaacagatagggccacctcaggcagctatgatattaaacaattcctgattcttttggaaaaatcccctgggtacagggatttcctcactgagtaatagctgacttaggtcaaatgaggataattccatgtgaatgagaatttcccagggagcttccaaacaagtacaatagtgataattctctgaggatgggccttttgtggcggatccaaacctattctgctctctccaatagctactaggccactggttttcacagctaccatctttctaaagctgctggttttcaagggtactgcagagatagggaaagggagatgggaataggaatagggtaggtttaagtatcacagagctcactgttctgtagaataagccatttttatttcaaccttttggttaatttttagaattctgaaaatgttgattttgacaatttttgcaactgctctcatactttcagggagcaccattctgtctggagtgcttctttttcctaggtggttttcatatcaggactgacttcttttgagacacaaatatcagactaggaagttgttttgtgagtacagaatcagaaaaagggaaatagatgtgttaaaaaggacgtagctggacgatgaagtctgatgcttgtctcctctttaggaagattgatatctgtgtctccaaggggaatggtatatctaatatttctgtgaacaataaccaccactaaatatttatcttaagtcttgagatcatgaaatgaggatgttggtggtatttgctgctgataaaacctgagtagatatctgtctcaacttagaaacctgataaagccagcagaacacaactgaggcagtaaagctttgggattgactggggactcttgagatacacttgctatccacttgctacttgaagtatggttcaaagagtgcagcatcagcatcacctgagaacttgtcagaaatgtagaatttcaggtcccactccagactttagtaagttagaatcttcatttcaacaaggtgatttatgcacacattaaagtttgataaatacatgcctgtagcatgtttacatcttcatgtggttgtcctgggaggattcctgcaatttgctagcttcatctatttaatgttcatttgtatcaacttaaatttcagaagtatctgctcctaaagtcttggagaatattaatctttgtacagtcttgtccttcttgtaactctttatggtaagaataaatagttgagcttcaagaatatcagagagggagaaaatctgtgcaggctggaatggtccaaaaggcattatttgagttaggctttgaggaaaggatggggagaaagtgaatgcgtgtcatgcagatgaaagaacatgggccaacctacagaggtgggaattatttattatgtgcagtagaggtctaaactgtaacatttttggggacatgcattatgtcttgcttatatatgtatcctcagtgactggatttcatagatgctctataaattattttcaaactgaatagtaggaagattagtttaactcaaggtgagggtttatataagaattatgggaattgatgcaaatttattagcatatggctagatgatggtgactttgaaaacttggtaggagtttgtatttaaatttgttgggtaatcttcagtaagttacgtgggaatggaaggggactaatttgtgattattagaaaattattaacagattaaataactttattcaaactccagaaaataaagtccttcaaaatcttcttggctcttccagatatgtggatctttgaatgagaacatattgtaggaatcacattaaggagaaaaaaagttgaagaaatatggtaaacattagtagcccattttaatgttttatataagttcttaagcaggggaatgacatgtgaaaatggtgtttgtaagagattaaaatgtaggccgggtgcagtggctcaagcctgtaatcccagcaccttggccaggtgaggccaaggcgggtggatcacctgaggtcaggagttcaagaccagcctggccaacatggtgaaaccctgtttctactaaaaatacaaaaattagccgggcatggtggtgtgtgcctgtgatcccagctactcaggaggctgaggcaggagactcgcttgaacccgggaggtggaggttgcagtgagctgagatcataccactgcactccagcctgggcgacagagtgagactccatctcaaaaaaaaaaacaaaaaaaaggcagcaaaatgctagatggattggaaggggaagagaatgggtcaggtagactaactagggctttttttcgttatctagagatgaaggcagatggacagagaccaaggtaatgtcaggacagaggaacgaacgttgctccttgaagtccctagtattacaaagtagagacatctaattaagcagtttagcttttacacaaaaagaaaaaagaaaagaggaaagagataaactatctgatgcaatagcaataatagcaactattctttaccatcctcataagacaatggtgagaattaaatgagtgaatgcttgtaagttgctgtattaatctgttttacattgctgtaggaatacctgagactgggtaatttaaaatgaaaagaagtttatttggttcacggttctgcaggccatgcaagcatggcaccagcctctgctaggcttctggtgaggccctcagggagcttttactcatggcagaagcaaagggagatcagacatgtcacatggtgaaagagggagatgccaagttcctttaaacaaccagctcccatgtgaactaatagagtgagaagtaactcatcaccaaggggatggcaccaagccattcatgagggatccagcaccatgacccaaacacctcctgccaggccccatctccaacaatgtggatcacatttcaacatgagatttggaaggaacaaatatccaaaccatactagttgcctagaaaaatgcctggcacatggcaagcactcataaatgttagtgataagctattgttaactggaagaaagaacctcctggtgctatcgagtagcacttctgtttctcaaaatcagcacccaacacagtgcttatttgtaatagatgcttaatagatgcttaatgaatggatgaaggggaaataaaatatctctcaatgtaggaatgaaatatgttgattatagggtcacattttgctgttgatttctattatacatataatcccccaatggaggattgggggaaagtagttattgatttctcatattctgttctccaaactaactttatctctatctcattctctttctctctttgtccacacccatcctaagggatttccatctctatgcttgtgattcttggaagccggctccccctgtctgtgtttcatagcacaggtgctcagtcgacatttgtgttcattgctaaaccaatatattctagacctatggctcatgcctcagagcagtgctctcagggaaaaagacactctcttttctctgctgtatttaattcagtccttttcaatagtttatcctttctgaatggccactgagatgtttgatacagccaacttaatgagttgtggctaaactgctttattttatgtggctgaaatgtattcaactgcgcatgtgtacataagacttaatctctagacatttcatgataatttgacagcataattgaagtgagggggaaaggattgagtggtttgtttcacttacatttcttcacccacccctaaaataaaatattctctgaagcaaatgtcaggaacttcttccaccactgtcaccatgtgacaatgagttagggaatggaattaaattcgttatctagcgtctctttccaaagagctaaaaggtttttttgttcattaccagagcatctctccaacagaatagagaccttcccatatacagctgcagctgagtttcacacttaagaaatcttataggatcttataaattttaagggacatagctctacctgaaaaagtctgtagaaacctgaggtccagctcttctgattgccttgggtccttttatttaaagttggcttgccttttgtaatgaaacaagccttttctttagtgtttaataccaatgaatcttttggagaagatatgctagaaagattttgagcaggggtagagaatcttcctatgtcaggaccactgacccaccaaaataatcaggcacatttaagaaaggacaacctttaggtcacttgcaaaagaatgcaaacccattaaataagtattcttctagttcatattatggccagctgaggaagatgagagaagagatataggaggagaaatagagtggataagaaggaaagagagaaaaacaggagaggtagacacatacacacagaaatcaagagggatagagaggaggaggtttgtgagtactgaggtgagagttactgagatgtggtgcttgtcacatgccattgctcacttgggctggtttccttgctaatgagttgcttaagccttgctcacagctccttctacagcagtttttcaggtgaaaaaaattatcctttggactgtagcaacactgaccccagtggtgcctctctgagagaacagagaaaattaagccaagtgctgaaggttgcctaatcctttgaggggaatgcaactaacattaattgaattcttattctgtaggaagtgctttatagaggttatctaatttaatcttcaacaaatctaacaacaggcactgttatacccattttccaggtgataatacagtcattaagtgctttgtcaggtaacaccaccagttagcagggagagaatgggattcatgcaccagccatcttctgagtcctgctctttctgtttcaccagctgcatccacgtctctttctagagcttaaagaaatttcagaaaatcatccaagtttgcaaattggtagaaattgctccacgcctcagactgataataatttgctttattgattagtgcgtcattgggccccatgccaggcatctgagctttttatctatttaaagtagagcagcagccagttggttggaagtattgtacctacccttctttgacagatggctttctatttggcttttgaaattccataagaaagaatttcacagtttctcacagtagcttattgcagtcatatccagagtcagtcttcggatcatgaatacattgatcccttttctctggctttgaatgcagcatactgtcataggcctgggcgaaagagtggttccagtgtgtgtgtgtgtgtgtgtgtgtgtgtgtgtgtgtgtgttggtaatacacaatctgtaacatagtcaaagaagaaataaagagtcggcaaactatggcccatggaccagatctcgctggctgtttttgtaaataaagttttactggaatacagccatgcttattcatttatgtattatctgtggctacttttgtgctacagtgacagagtggagtagttgtgactgagattgtgtggtcttcaaaggctaaaatatttattttcttgttcttttctgaagaagtgtgcaatccttgctatagattaacatatcaactagagaattcttgaaaagaacagagcatgaatatagcaaaactatggtgttacctaggtaatagtactatgaggatctactacagataatattttccaagtgccccttgttgtgtttgggggaatacaaagaggaggttctcttacttgtatgttgaaataactccttagaataaggttggagaatttctgataggaatgttgcttgtgtatcaaaatacagaattgcgcttctccgttctgactgtggttcttgtccaggcaagtttggaaattgtgactccttgaaaccattcaggcagccaagtgttccagctgatgttttgtgtgtttttttttcctccttcatttaaaaatacactttgtagaatgttttctttttcacggctccctaaatattctgttttgaaacatttaattacccaggttatttatatggaaaggtttgataatgtttctatgggagtctgttatttatttcttttgctaaatcttatcttatattaggggaagggctgaggttggttactatggcaacattctcaaaactgcaacaatcccattacggatgctaaaactatagtcatttcagtgggagggtagcatggggagtgggtggtagtctttttatttttattttattttttttaaaaaaacctctcccacttccaaatcttttgcattcatttattttaagctttgcagcttagggtactaaaatgagaaacaaaaagtaaaaaagagtgtcatgtctctctccattaaatttctgtagtcctttatcagctccctttgtggggatacccagttttctacctactcttttattcatttatgctttcagttattccccaaactttcattgagacctgtgttatgggtgaataagagaatccttgttcttgtttctccttttaaattataaattctttgaagccattaattcacttcactgtaattcatttaaacaaatacttattgagcaatttgctttgtatcaagaatcatacttgcataagaagacaaaaaagaaaaaagggattctgttgaagattaacattttgttttgttgggcagcacagggaagggcacatagtgaagcacagagatgattgaaataaaatttgataaatgcttacacaggggcacttaatccacttaactccccagcctagaaagcatagaaatgactgcagggaggtgacatttgggttaccagataggcattttctggttagggcctagatgtgtgtgtgtatggcagggggatggaggtgtgtgtgtgtgtgtatgtgtgtgtgtgtgtgtgtgtgtgtgtgtatttatgggtttgggtatgcagggcattccaaccaatctagaccaacaagaatagagatatacaggcgaggagtccttggccatgagcaggagaatttagaaaacacatggatgattggtagaagaacagtctggagacgtagccatcaagagaagtcatgtctgggaggttggatttcgacattgggaaccattgaaaagttcagaaggaggagcaattgagtgttccagtttagaagtggaagacagtgaagggaagggaagggggaagatgggattgggaagagatatggagacttgtaaaaatggcaagattcaccttgggacatgatgagttttaaatgaaccccatcaagttggaccgtccagtaggcagctggaaatgtggctccagaactgacaagaagtgtggatgggacccagagatctggatatgatcagagaaggctttgaaggaggaacaggaacctcaagagaaattacacattatcgtatccctaatatgctgtctcacttttagtaaaatattaagtatttctaaaaagatttttaagtgttgatgtgaccaaaatatttttataattttttattttttatttcaataggtttttagggaacaggtggtgtttggttacatgaataagttctttaggggtgatttctgagattttggtgcaccatcacttgagcagtgtacactgtacccaatgtgtagtcttttttcccttgctacccctgacagtttcccctgagttcccagagtccaatgtgtcattcttatgcttttgtgtcctcatagcataatagtgtccagtttcatccaggttgctgcaaatgccattatttcattccttttcatggctgagtagtattccgtctgtatatacaccaaattttctttatccactcattgattgatgggcatttgggctggttccatatttttgctattgcaagttgtgccgcttaaacatgtgtgtgcaagtatctttttcatataatgacttcctctgagtagatacctagtagtgggattgctggatcaaatggtagatctatttttagttctttaaggaatctccacactgttttccatagtggaactatgtactagtttacattccaccaacagtgtaaaaatgttttcattgcatccatgccaacatctattactttatggttttttgcttatgggcattcttgcaggagtaaggtcgtatcaaaatgcaattttgatttgcatttccctgataattagtgatgctgagcatttttcctgtgcttgttggtcatttgtatatcttttcttgagaattgtctatgcctgtccttagcccactttttgatgggatttttttttcttgctgatttgtttgcgttctttgtagattctggatattagtcatttgtcagatgtatagattgtgaatattttttaccactctgtgggttgtctgttaattctgctaattatttcttttgctgtgcagaaggtttttagtttaagtgctatctatttatctttgttttagttgcatttgcttttgggttcttggtcatgaagtctttggctaagccaatgtctagaagggtttttccaatgttgtcttctataatctttatggtttcaggtcttagatttaagtatttgacctatcttgagttgatttttgtataaggtgagagatgaggatcaagtttcattctgctacatgtgacttgccaattatcccagcaccatttgttgaatagggtgtcctctcccctctttatgttgttgtttgttttgttgaagatcagttggctgtaagtatttggctttatttctgggttctctattctgctccactggtctatgtgctgatttttataccagtaccacgctgttttcctaactgtggccttatagtatagtttagagttgagtaatgtgatgcctccagatttttttttttttctttgcttagtcttgctttggctatgcaggctcttttttggttccatatgaattttaggattgttttttctagttctgtgaagaatgatggtggtattttgatgggaattgcattaaatttgtggattttttttggcagtgtggtcattttcacaatattgattctacccactcatgagcatgggatgtgtttccatttgctgtggcatctatgatttctttcagcagtgttttgtagttttccttgtagaggtctttcacctccttggttaggtatattcctaagcatttcatttttttgcagctattacgaaagggattgagttcttgatttgattctcaacttggtcactgttggtgtatagcagagctactgatttgtgtacattaattttgtatcctgaaacattgctgaattcatttaccagttctaggagctttctggataactctagggttttctaggtatacaatgatatcatcagcacacagcaacagtttgacttcctctttaccaatttggatgccctttatttctttctcttgcctgattgctctagccaggacttctagtactgtgtttaatacaagtggtgaaagtgggcattcttgttttgttccagttctcagggggaatgctttcaacttttccccattcagcataatgtaggtggtgggtttgtcttggatggcttttattcccttaagttatgtcccttctatgccgattttgctgagggttttaatcataaagtgatgctggattttgtcaaatgctttttctgcatctattgagatgatcatgtgatttttgttttcaattctgttagtggtgtatcacacttactgactcatatatgttaaaccatccctgcatccctggtatgaaacacacttgatcatgtggattatctttttgatatgctcttggcttcagttcactagtattttgttggggatttttgcatctgtgttgatcaagggtattggtctgtagttttctgtttttttaatgtccttccctggttttggtattagggtgatactggcttcataaaatgatttagggaggattccttctttgtctatcttgcggaatagtgtcaataggattggtactaattttctttacatgtctgatagaattcagctgtgaatttgtctggtcctggacttttttttttgttggcaatttttacattactatttcaatcacgctgcttgttattggtctgttcagagattctctatcttcctggtttaatctaggagggttgtatattttcaggaatttatcctgaaatttatctcctccaggttttctggtttatgcacgtgaaggtgttcatagtagccttgtatttctgtggtattagttgtaatatctcccattttgtttctaattgagcttatttggatcttctttcttcttttcttggttaatctcactaatggtctatcaattttatttatattttcaaagaaccagctttttgtttaatctatcttttgtattgtttttttgttgttgtttcagtttcatttagttctgctctgatctttgttatttcttttcttctgcttggtttgagtttagattgttcttgtttctccagttccatgaggtgtgaccttagatcgtctatttgtgctctttcagactttttgatacaggcatttaatgctatgaactttcctcttagcactgcttttgctgtatcccagaggttttgataggttgtgtcactattatcattcagttcaaataattttttaatttccatcgtgatttgtttacccagtgatcattcaggaacaagttatttaatttccatgtgcttatatggttttgaggggttcttttggagttgatttacagttttattccactgtggtctgggagggtacttgatataatttctattttcttaaatttactgagacttgttttgtggcctatcatatggtctatcttggagaatgtaccatgtgctgatgaatagaatgtaaagtctatagttgttgggtagaatgttctataaatatctgttaagttcatttgttatagggtatagtttaagtccattgtttctttgttcattttcgatcttgatgacctgtctagtgctgtcagtggagtattaaagtcccccactattattatattgccatctatctcatttcttaggtctagtagtaattgttttataaatttgggagctccagtgttaggtgcatacgtatttaaaattgtgatattttcctgttggacttgtctttttatcattctataatgtccctctttgtcttttttagctgctgttgctttaaagtttgttttgcctgatataagaattgctactactgctggattttagtgtccagttgcatggaatatctttttctacccctttgccttaaatttatctgagtccttatgtgtcaggtgagtttcctgaagacagcagaaacttggttggtgaattctttatccattctgccattctgtatcttttaagtggaacatttaggccatttacattcaatgtcagtattgagatgtgaaatactattctattcatcatgctatttgttgcctgaataccttgtgttttttacactgtgttattgttatataggtactgtgaggtttatgatttaagaaggttctattttgaggatttgtttcaagatttagagcttcttttagcagttcttgtaatgctgacttgggagtggcaaattctctcagcatttgtttgtctggaaaagactgtatctatccctcatttatgaagcttagtttcactggatacaaaattcttggctggtaactgttttgcttaaggaggctaaaaatagaatcccagtcccttctagtttatatggtttctgctaagaaatctgctgttaatctgataggtttttctgtataggttacctgctgcttttgcctcacagctcttaagactctttcctttgtctggactttggataacctgacaactatgtgcctaggcaatgatcttttcacaatgaatttcccaggtgttctttgagctgcttttatttggatgtctagatctctagcaaggccaggaagttttcctccattattccctcagatatgttttccaaacttttagatttctcttcttcttcaggaacaccaattattcttggttttggacatttaacatagtctcaaacttcttggaggctttgttcattttttaaaattcttttttctttgtctttgacagattgggttaatttgaaagccttgtctttgagctttgaaattcttccttctgtttgtttgattctattgctgagactttctagtgcattttgcatttctgtgtgtccttgatttccagaagttgtgatggtttcttatttatgcagtctatttcactgaagaactttcctttcatatcctgtatcacgtttttgatttgtttaagttggactacacctttctctggtgcctccttgattagcttaatagtcggccttctgaattctttttttgtcaattcagagatttcatcttggtttggatccattgctcatgagctggtatgatttttcagggtgttaataatcttgttttgtcatattaccagaattgtttttctggtttcttctcatttgggtagactatgtcagaggaaagatctgggcttcaagcgctgctgtttagattcatttgtcccacggggtgctcccttgatgtggtgttctcccctttcgcctaggaatgggacttcctgagagccgaactatagtgattgttttgctagccacccagtggagctacagagctctgagctggtactggagagtgtctgcaatgagtcctgtgatgtgatccatcttcaggtctttcagctgtggttaccagcacctgctccggtggaagtgacaggggagtaaagtggactctgtgagggtccttggttgtttttgtttagtgcactggttttgtgttggttggcctccagccaggaggtggtgctttcaagagtgcatcagctgcggtcctatagggaggatgcaaaccttccccagggatacctggttagtattcaggtttctcaggtggtggacggggccatagagctcccaagagattatgacctttgtctttggctaccaggctaggtagagaaagaccactaggtgagggcagggctaggcgtgtcttagctcagcctctccttgggcagggctccctgtggctgctgtgggggatgggggtgtggttcccaggccaatggagttatgttcccagggggattttggctgcctctgctgagtcatacaggttgtcagggatgtgggggaaagcggggagtcacaggcctcacccatcgtccacacagcctgcagtcctaatggccggtctcactctcatcatgcccccacgacagcaccgagtctatttccaggcagccagtgaccagggctgagaacttgtcccagaccatgagccttcccattgagaaagcaagcagactcacagttttttggtgtctcaaggagtctgcagaggtgatctagttcgttacttgaaagggtctgtggattttctcagcttttctggtatgttcctacagtagttcttggagcaaaagttcatggtgtgagtctccacatgctgctctgtctgtctgagcaggagctgcaagctattcctgcctcctatccaccatcttaattgacagtggtaaccaaaatgtttagagccattttgacagattgaggaatcactgctatgattaaaatgtagcacttgagatgaccatgctcaactcgtaggatgccatcatcaaacagctttgccttctccctccatttattctttaaacctgcacagtgggacatgtccttccctggcaattccggtcactcttaggcaattaaaaaacaaaacaaaacaaaacattcaggttaaaaacaccagataattcagtacctgaaacgtccagcattatgtactagcaaaaacactggagttgatttagaattgagctttcttccctcctccaacaggggcctgccccagccctgcagtcatggaaggagagtggtcagcttccctctttctcctcagtattccttcaccccttttcttctctaggctagcctcagtctcagaccccattaaattgggttgagagagaggaggaggaaggaaatataagggaaacagtaaagtgcttacttaactgctgatgaattgttagtctagtttcagtgctttctgaatctagcagatatgtaagtttacttctctgtggagttcttttgtgtattctttgcccaaaaagaacataccctccccccattgctaagggtctcatatctgtagttctctgagacaaaaacaatgcgttgctactgggctacacctttcccgacccttaggctcctggccacacctccagctaatttctgctatgccttttgagtagtacctgaacagtcctgatatggctgtctcagatgcacagcccacaccttgttcatggaagacactcaaataccctttgcttctgcaaactctgggagtgcaaccacctctcctagatccaccaacaaaacagccagcaagcctagatgctatcatgtctgatgtcagatgtggttcagacacaaatctatttgttccccaaactgcacagactgctgaggacagatgtgaagccctctgtctgcctttttaaagtccctctttcttgacatgaggtgaagcggcaagccccactaaccactggctctccttgattgaagggttgtggactctcaacacatcaatagcttccttgaacaatccctccaaaactgtccaattcttgatccttttaaggaattatgagttttataaacagtttatagcaccttttttggtaaattttgcaaaacgtctagctcttttaaaaaaattatttcttgatgcttgaaagaaaatattcactgaaacatcatgttatgtgagcatcatttttctacccccatttagaaaaaagcatttctgactagttgcagaaggaattttgttacatggatatagaattggctgcatctagggatagattgaatggatgacaaagtgaaaccacgctttctttatgaaggttgtattttcaccttccttgtagacacccttccttttccagggtgcccttagataaacagctgtgcatcttacaggaattgcttacaatgatagatttcccctaagctcatgactgccaaatttgtctttgtagcccagacctctttctgagatgcagatccatatatctgatagcttactctacttctctgatcaaagtattacaagtttagctcacatcatcattactctaaataccattcctcattctgaatatctatttgccttcatgtaatttatctttagtcttaagaaatggtacttagaaacccttagttgtttaaatcagaaagttgggagtcatcaacagattcttaagttcttgtcaaccatgccactttagcaatctggtgatgtctctgaccgcctttcaaaacagtgtttgtaagaatacaggactactatggaaaccaatgatatggaaacacagttctgttatgaatgacttggaattcatgaattgttttccttctcatctctcacattgattcagtatatcattcacagatcatctcctgaatagcagtcagactcattttattttctctatcttcactgatgctttcttacttcactccttcatcatctctcactgaatgactgaagtttcatttaaaaaacaacttatactgataaatttcaaatatagacaaaggacacaaaataatataatgtaccccatgttgctgttacctagttttacattcccactccccactctattataatgacgaatttatagactttattttaagtaaaacttataaactgtcttagtctgttttgtgcagctgtaacagaataccacagactgggtaattcttttgtcaaacgtctgttcaagtttttatttttgactatttttaattgtttaaaaatgtttattagtagttgcaggagttaaaaaaatctggatacaaatcgattatcagattcatggttggtaaatatgtttttccaatctgaagcatacttattaattttcttaatgtaatttttataagcaaaaacttttaatttttaaaaatgatattatgttctatgtccttctgagaaatctttacttatctgcaagtcatgaagatcttcttctgttttcttctaaaaattttatgtgttagctttcacacttaggtctatgtatgattcatcttgaattaatttttatgcttgctataagatagaggttgaggttcattctttttttttccatatgaacatctagctgttccagcataatttgttgaaattattgcttgctttattgaatttctttggtggctttttcaaaaatcaattgactatagacttgtactatttctggactctctattctgttctgttaatctatttttctatctttatgccaataacaccctgtaggtttaaagtaaatttcaagtcatgtggtatgaattctctatcttttttctgttttcaagattaatgtattctggatcctttacatttccaaataaattttagaattaacatgtcaatttttattttcagaagacctgctggagttatgattgggatttcattgacttagaagattaacctgtatgtatagtttattttttagccagtgatttgggagagagatttatttgcagattttagggatcactgcctttgtgacttctctctatttaacatattccccctaactttctgcagttttgccttcccctaagttatctgatactttgatcaagtaaggaaactgaggctttctgcaaccccagctatgtgcaaattgggagtgctaacagtcaaatatttgcaaacttgcaaatttcattcattgcagtttgtcttttaatgggggtctctgctccagattttgcctaaccatgttcactttgtagtgcctttgagtagtttttttttttaattgtccagatctaaaaattgttatctgtggaacaattgttctgacctagctactttgctattaacagaagacagagcacctccttcttgcctcctctttcatctccctgtaacacacctgcccattgtcccctaagtaatctttcaaaaaagcaaacccaagcaaaccattttctggttgaaagcccatcaatgactcttcattgctttctctctgctttcttatcttccttttttagattcctcctcacttatcctatgcactctctggctttattgaaccatttggcatttcctagacacacccttcccttaaaagtctccccttcttgggcttatatcatgatcctgactaaaatgcctctatgttctttgtagccgggctaactcctagttcttcaaaagtcagctcgaagtaccaactcattggtgaaaacttctgggcgttattgaaagtgggctactcatactttcatattttcctaatgtttttgttatgttttagtatcacaaaactcatcaacttatatttaattgtttaatcacttattacactgtgagctgtgtacgccttggtagggtccatgtcttacctgtgattgccaatcgcctagtattcttgttgaggaaataagggaaggtgaacggactgaatagccacatgatggttgcattttaggtgtatttatgacgaaattttaggtatctggtcattcccaaatattttccctttgtcttctcactcatggcactgaatatttaaataccaatatgcgattaacaaggtaaagttagaaccacagaaatgcctcagttatccagaggaaagctttccaggagcctcagaaaatgaaccagatgaagacttaaaaatctatgtatataaatagaagaattctttaaagagaataaaagacattgatgagtcgaaagcagtgacatagtaaataactaaagagccaatgatgccaatatttcatctgttgagatatgacttaaagttttatgaacacaaaggaaaaggctgattctgatttcaaaaattaagcagctcttgaagctttaattggcgtggctacagtatgacacagaggaacactgagggagctagaccatagccgtcgctgctgtgagacacagggagccagaatcctttcacattttcctggacatgtcaacctttctttgtttcttttttgactgctacataatcatataggcattgcatactttttatggagattctttcttggtggaatcccagttttaattactgtttccatgtaagttattgttggtgagcagacaatgccttttccactttttaaaataatgccatagaattccatattactaccatgcatatatactaaagtttctcccgcctcatcctttttttaacagattggtgggggtctcactctgtcgcctgggctgaagctcagtggcatgatcataattcactgcagcctcaaactcctgggcttaagcaatcatctgctctagcctcctggttagctaggactacaggcatgtgccaccatgcccagctaattaaaaaaaatttttttttttggtagaaacagggtcttgctgtgtttcccaggctggtcttgaactcttggcctcaagcatttcttttgcctcagcctcccaaactgctgggattataggcatcagctatcctgcctggtctttttaaaaggccttttcttacaattgattattatctcattactcctccttttctcatgtatttttcgtctcttctccagtccatttttgctttgagcctctcccacatacacctgccccctcaaatatctgtcatttatcacaaaggctttctcatactgtcatgctttaagacactgataatccacttcttccattaagttgccctgtaccaatcatagatgatcgattgcgtggttatatgaaatagataatacaaaatgaaaaatgaacgtttcttctttaagtacaccttcctcagatacacctcttcccctaccctcagaggtaaccacacttaaccattttctgtgttgtgtaatccttctatattttttctaagcatctatgaataaacacacacacgtaaagtaagatgatggtcaaaatgtttaaccactgcatggtaatataaaacttagcacttaaaaatatgttctattctctaggcagaccaaactatatataattgcctaccaggtgatctatgttagaggttaaatcattcatcaaactattccaataattttcaaagcatttattgatttttaatgggtataatcttttgtttgatgcagctgtcggtagttaagtgatgtccctgtatcaaccatgatttgaaacagggaaacacatcaatctattccaatgattcactcattgcataatactgccacttgcttctttcatttaagaatatacttttagctgggcgtggtggctcacgcctgtaatcttagcactttgggaggccaaggcaggtggatcacctaaggtcaggagtttgagaccagcctgaccaacatggagaaaccccatccctactaaaaatacaaaattagctaagcatggtggcacatgcttataatcccagctactcgggaggctgaagcaggagaatcgcttgaacccaggaggcggaggttgcagtgagccgagatcacaccattgcactccagcctgggcaaaaagggcgaaaaactctgccaaaaaaagaaaaaaaaaagaatatacttttgacatctttccctgtgagactataataaatctactttattgtatctaatgataggatagtatcccataatatggatataagtttatctatcgagttccctactgtttaaatgtttccagtgttttgctattacacgtaatgttgctaaaacattctcttacatctttgtctgcttcggtgcatacttttgtaagatagacttatagacgaggaattgttggttcaaagtagatgtgccaatcaagaatttgcccacttataagtaactacacacatcttgtgtgcacatgcaccgacatacatattatcacctgaaaatataaacccagatgcaaacacaggtgagcactaaattaattctaaaattcatttgaggatttggcaccatgaagttgcatagccacataccctcaggtagacaagacaggggaatggcagaggtaccttggtagaaagtgaaggagaagaagaaaggttggtggtccagagaagtcagtatttccttgcctggaatgagtgcctgcctatcgaattttgataaaacttcttgattgtcatccttgtttcattacggtcctcccaggaatattttgcttttttctaagctttaaagatcatagcttcgtgacttaatctttggactggatttccccacttatatgagaagaactaataatgccacatggagcacaccttttcaggactcaaggagtctaaaaaaaagaaaagaaaaatgagtcagaacttctgcctgtgagtctgagtcagcttagtgtgttaaaaaaaataataataaaaaaagaaaagaaaaaaaaaaccgtgtgaggagacctgcctggaaaaactgctgaatggaaagacttgagaacagcttatagatattgacggcagatgaagaattttcatgtcttttcagaaatggttagcagccactcataacagtcctgtgacgtcacagaaatcttgactcctgcttgtctttctcgttctcctttaagcccttccctcctccttttcatataggaccttaacacaagagggtcaggaagagaagagaagggttgctcacaggaggaaagaaggcaaggggtagctgttactttacctggtgggccatgtgtcgctacaaatcaggtggtctctttggaggagatgccacttggtaagggaggcttcctgagcactcgaatactactagcaactcagaatgtgggaccgctggaaggaaaaacacccctggatggggcgaaggttgagttcaattttattttttactctgtgtgtgtgtagggggagggtaatgggaaatgtgtgttttgcagacacattaacataaggagaatagcggatgcgactttattatcctcattcacgtaaaggtggacatttaaatttttttttacagtagggaaaaagaaccttctgagttgatttggtatagtggaaattgcatggaaatgtttagcttcctctgttttcacaaacatgtaaccttctaagaaaatctctctttgacctatttcaaagtttgatttttttttttaaaacagtttggaaaataggagctaacatgaattgccccttttccaacagtgaaaatgtttgtaatgtaccttttcatgttgctctaattatgaccataacttcttttttattcaatcctgaatctgttatattttaaaattatataaaattataaaacactggccaaaattagtcacccaggaaatagtataagggacccagttaagaaagtaagtgtaagtgactgaaaaagtttggtgccttctcattgaggcagacttgcttatttgtttgttaacctcagaagtattaccatacatactgtctatggatttagatacatgatttttctcaccttctagacatccaccttgttgtgatagaaggagcatggatttagagtcaggcagccttggatctgaatcactttactacttctgtggcccttagcaggctatatagcttctgtgagcctcagtttcctcatccataaaatgaaaataatgtctacaggttagtattgtaacaagggatcactcagattaactttggaaaagctttctgctattaagcatttggaaaacatgagtttctattttttttttgtattttggttatcattattggcttggttttctttctaggccttggattctccttcactttatgtagaatatgatcttcttgtagtagatagatgtgagtcctgccaacagaatttttctgaattggcttcttgtcttttctttaccaatagctgcctattcagttcagctgcctgatcaacatcttgtctctcaattcctgtgtgccctcacagatctattaaagcatcctgagaagagggtccctcagagtcaccaggtttcagggctccagcttttcctggggatcagaataccccttcagaggccaacactctaaggcagtaatgtgtttctctggccaaacgcctgatagtatcttcttggcaagttcattatttattcccctttactggtgtgagggttttcccaaagtgtcatgtctttgcagagtttttcctacccttccgtgctatacgtgtggtaccattttatgcatttgtttttgctaatatgaaataaatcccattataaataattccaagggattttgcagatgattgtactgttcagaataagaggagtgttccgtgaatcatggagctgctttggtacacagtttgtagaagtaaaatgtggtataatgtaattgacccatgggtcccttcttgtacagagtgtcacttgctgagaagtaagcaaaaaagggagtgcattcctgcatctggcaattcacccccatcctgcaagagtaactcatagagcagcagcttattccattgtgacactgactcacccttcctctctccacccccattgtctagtgctgatgtgttctgtccccactaattctagggtcacactgacttatgccttcatcatcctaagtggagaagaaagcttgtctgtgttgatgaaagtatgaaaatagaaatgccataacttttaatgcaaacaatatatgtttgttgaatgtatgaatacaacaacttggaataactgctgacagtgtttccaaatattttgggtctatttaagtaaagagacatgaataatttgaaactggcattctttttcttcttctttttttttgaattagcaatacatgtgatgaaaccttaaaaacaaattctcatagttacgaatggttgcctttagtgagcaggatggggaacagatctgggggcttaggtcattcattataaaccattctgcaagctttcttttttctaaccagatgtgtgtattactttaatgtttttttgatacctcccttaagtaggcccagtccagtttaagtgcaatctcttgagtgccttgtgtcagacactgtgccggtcacccagggctccagggtgaatcacgaatagctctcacatgtgaattcacagtctagttggggagacagaacagaccaaaagcagataatatttaaataacatgatgctggctaagagagaggtagccatggagttaagtatcttcctctccattttattcagccttttgttttaaaattctacctttatgatgtatttcaacagagttctgtgtcatgattttggatttagtggaaaaagaacagaggagattttcttgttaccttaattttcccaacatggaagatttgggaatgaagaaggacactgcaaagagtgaggcctaaaatggaaaccagtcatgatttttattttgctactttctttacggacacgaatgcacacagtgtagagcagccttaactctgaattggaacaaggtcgtgtaagtgccaggacgttatttccagaagcccacagctgctgattcctacacccagtgatttccactgccttttcatgattctggaattcccaagaacagtgtcatcttattagaaggtatttcccagttcgagttggagacaaaccaaccttccctcacaggctgagtccttctggtttcactgccaaagcttccagactcacccagggtctgttagacatatttgaatgaatctgtcagattgttcagtcgttaatgaggtcacactttccatgaagaccatagtggcgtcattttgtgtaccaacaattgtatcaagtcatgatgattttttaaatatcattgaaataatcattaaaatattattgagataaagatgcatgtttattggtatctatttattcctttctcttgtttaagagagaatttacttagatgtgtacaaaactgctttctggcatacttaattttatgggtttctgatttccacatcactgaaagtatctggaatacctatgatgcaatgtgaatcttgtttccactaactagtaagtaaatgctttgttcgagatttaagaaagttggcctggcacggtggctcacacctgtagtcccagcactttgggaggctgaagcgggtggatcacctgaggtccggagtttgagaccagcctggccaacatggcgaaaccccatctctactaaaaatacaaaaattagctgggcatggtggcacgcacctgtgatcctagctactcaggaggctgaggcaggagaatcgcttgaacccgggaggtggaggttgcagtgaactgagattgcaccactgcactccagcttaagtgacagaggtgagatgccatctcaaaaaaaataaataaaaataaataaagaatgaatataattgcaaagataaaacgtaaacccagattgggaataagaagcagaattataccaaaatggaagctgacgattacacagattcactccttatttactcattcaaagcttgcctcacataccataggtaaagtgggtaactctttctgatttttttggttcacttcaagactatatgatcttgaaattttaaataaataagctaaaaaggccctaaaatattttattaaaacccactgagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaacccactgagtataatttattgatttttataaaactaattctttttttttctgttttacttataagttttgggatatgtgtgtagaatgcgtaggtttgttacataggtatacatgtgccatggtggtttgctgcacctatcaacccgtcatctaggttttaagcccctcatgcattaggtatttgtcctaatgctctccctcccctgcctcccacccccagacaggccctgatgtgtgttgttcccctccctgtgtccatgtgttctcattgtttcactcccgcttatgagagagaacatgcagtgtttggttttctgttcctgtgttagtttgctgagaatgatggcttccagcttcatccatgtccctgcaaaggacatttcatttttatggctgcatagtattccatggtgtatatgtgccacattttctttatccagtctatcactgatgggcatttgggtaggttctaagtctttgctattgtaaatagtgctgcggtaaacatacatacgcatgtgtctttatagaacaatgatttataatcctttgggtatatacccagtaatgggattgctgggtccaatggtatttctggttctagatccttgaggaatcgccacactggcttccacaatggttgaactaatttatactcccaccaacagtgtaaaagcgttcccatttctccacagccttgccagcatctattgtttcctgactttttaacaattgccgttctgactggcatgtgatagtatctcattgtggttttgatttgcatttctctagtgatcagtgatgatgagctatttttcatgtttgttggccgcataaatgtcttcttttgagaagtgtctgttcatatcctttgcccactttttgatggggttgtttttttttcttgtaaatttgtttaagttccttgtagattctgcatattagacctttgtcaaatgagtagattgcaaaaattttctcccattcataggttgcctgttcactctgatggtagtttcttttgctgtgcagaagctgtttagtttaattggatctcatttgtcaattttggcttttgttgcaattgcttttggtgataaaactaattcttaattgttatcactcagtgaatggtactagtttgatcttcccttgctgattaatccagttctttccagttcacttgaaacccatttctttgactcagatagctttcactttagttccaaattttcagggacatttggtaccaaactcttcttacagaactttaccctcgaccaccattgctggatctgccacagtcagagttcatctaccgggtctaacacgtctcggcttcttttgcattttctcccgtgtctcccttgggtgtcgcagaagcagcaagagattattatcatgtagtagggctccgtaatcagaatgcgaaatccctatgcataaatgctgtcttttctcagaatttcctgacccactttctattttttgagaagacaaaattgacttttttttctgacttcttcagaaatctcttatagtgactggtattttcatctgctggcacctctgacaatgactattacaacgtgcctcagaatacagagtgctaacacctcatcttctaaaagaaatgcttcctctgtaaaagtgttttctctgatgaagccgccatatagaccattgaataggaactgcagaagactccggaacacaatttgatagccgttcagccaagcggctgcaatttattttgtccctgagtgtgaaggaggcagcccaaagaatgttggctctggaggaggaaggcaaggatatggggaaacaggggccagagaagggcaggatggggcaaagattcagggcaccttatgtaatgaggcacagcgtgattctgcccggggcctgtacgtgcatgcagtcgggttgcctccctttcccctggaaatgtgccctttgcttactttttgtttggttttaaagcagctggaaaggatattttttgctcagaattggtgcttagcttttgcagaagctgcttcttgagagtcgtctcttgtcatccctctgggttttagctcagtgtgacgaagctatttaaaatatgtgtgtttttaaatgattctaaaaatgaagtattcacattgttatgcctcactccctccccactattgagtcctgctcccctgacagcaactttccatttctctagcttatccttctggtatttatttatatctgtgtttctaaatactatgtttatactatgatcatttggtttgccaattgtagacattatctgttaggttggtgcaaaagtaattttggttttgccaagatgatagtattaggtaccgacctaataccatcatctttctatgagatggtaccattttagatgaacatcttgtgtccacttaacatcctcccactttctgtagcttcctcatatatgtagatcaaagttcttggttagactcatgatcagattatttgttttttgtttgtttgtgtttgttttgtagggacagggtcttgctgtgttgcccagtctggtcttggagtcctggcttcaggtgatccttctgcctctcatactggaatattatataatatttttaaaaatagctcacctttattatgtattttctgggtgcaagacactgtcgaagagctttagacatgtattaactaatctttatagcaaccatgtaaagcagatactgttattctttccattttgcagatacggacattgagacctgggttaactaactttccaaagtcatgtaggtagtagctggtggagccagacttcaaaccaaagtaaacgaggctccagagtctacttttaaccactacactttttaaatgattaagattttacaaatactatttatagtggagccacatgtatattattatctcttctccttctcttctcttctcttctccttctccttctcttctcttctcttctcttcctcttcctcctactctactcttctcttctcttctcttctcttctcttctcttctcttctcttctcttctcttctcttcccttctcttctcttttggaactcttattagatggaagttgtatgtcctgaatttatcctctaattttcttacctttatctcttcattacctttgacctacattctgggagattgctttaactttatcttgtaactcttaccaaagagttttttttcccctgtgacactttaaaagcccagtagctgtttcttatttttgttctgttcttttatttttcagttctttcttcctaattgagtactttggccctgtctttcatactggtggctttcctgcaatggcaggagatctgcagccatcaggtcacatacatgaacaaggctctgaagagctgacaggataacttccgtgggtggcccaggctcatctggtagtggcccccccatcaggtcacagacatgaataaggctctgaagagctgacaggacaccttctgtgggtggccccggctcgtctggtagtggccccccactgcagagtggcctaggatcacagatctgttcacttggaggatcctcagatgtcagcatctggaagcttttcccttgggctggccagaatctccataatagaaccacccagacttgttcctggggctgtgcacctgctgcaggtgttgtgggagccaagtttggagtgggaaacagaaagatctcattgtgggtgttgactttcactcaattctctcttttcagactcacgtttacccatgcaccaccctcaccaccctgcaagccctccctatttgagtccctagttcctgaggatccctctttcagtttctctagaaaaagaaattcctcctgtcctgccctgggtgtgctgagtgggaaggagggaataaggaagattctctttgccctggaggaagtccatgacacttccaattcctcctccaattcctcagcttttctgaggggctccgtgcaaattggcttgctttttcttggttttgctctttgagatttgtaactttctttgtgctaataggttagtaataacttgtcaattcactttccatcttccagaagactgttaacatttatttctacctctccatttctctgtgtccttgtggaactttactttttaaaaaaacttaattactttcattatgttggaggttgggaagggagtagagatgaacatcacgttgacacaaccatatttgatggaagtccgattagatcaccattggaaatatttgtttcttagagtttgcttcattttcctgttaggctggaggatcccatgatatttgtctcagaataacgggagggttcacttttcattctgtttgagctttcctggtgtatacctttcttcctttcctcttaggatcgtaagtcctgaacaatcttgttctagctcttttctcctcttatcttcatctgtaaatgaaaggggctgagagctggtttcaggcaggaactagatctgacatttaggaaatctcctgttcaggtagcttctcttggccttttcctttcagtgatattttctgaaaacctgacttgccatactgatttaaatgcctgataccagtgtaaggtatagatgtgacttctcctaggaacatagataaagctttgggggtgaaattgacaatagagtgtgtctcctttctctctttagccagtgggaaggttgggtgacttggggctgcaggattccgggaggcctccgtatcgtatgctgcctgtccttagagtccatccagacctgagggctacttagctgaattgtttagtaaacgacgtgggattcagctgcatcatctctatgaagactctcatgttgacttatcattacaaagggctgatggtggcagtggttctaaaccttgacaagtgaacggtttctgcaggaaggctctttggaagactgtgacatcacagacaagacaaggaatatcattagtgaggtcattttaaaattctcagatcttggacttgctctgggcagtgactttgccagcaagttggaagagggcacaagaagtgtgctcatcaaatttgtggcagacacaaaactggaaaggatggccaatgtaatcgatgacaaaaacaaaaatatgtctcaaaatgatatagatatgctggaatgctgggttaaaaataacacaatgacatttcaaagggataaatgtaaaatcttattttggaataaaaaaatcaacgatacataatggtgggagaaaaaaatctactggcagtagttctggtagagaaagacactgaagttttatttgactaaaagctcagtataagccactaaatctgactgaggcaactaaaaagctgcattaatggaacgttaatgtattgaactcaggaagtaacacccctcttcaatggttggactgcacctggcgcctcatgtttgcccagagaagggcaattagcaggtgcctgagggtctggaagcatgtctcaggagaaaccatggaaggaactgagtatattcagatggaaaagaaaactgtcttctccttattagctgtgaaactttaggcaagttaccctggaagcccctgtagcctcttgggtaaaatgtggaaggagaccatttctctgtggtataggtagggggcagaaagaaggaagtactggaggaagagattggagaggtaggaggtggggatgggattgagaacatattcatagctcagggtaaggcattcacagtttatcctgagctgcaggaaaataatatgggcactgtattatctttcaaaccaggacattcagagtgaaagccaggcttattcaataaaacaggacaaaaggtaccaactagggctgttgcaggtaccctagacaaaccaggaggaaaggccatactgccgaagagcactgtcagtagaggacatctgccttttggggtggtgagtggtctgcctttggaggcatctaagcagggcttgaatgaacttctcttgtggaccagcacaagagaagtcgggtggaaatgaacgaaatgaactttcagatccttattgagtactgctacaagggatgctatgttagagaatatatgaaacaaattaaacaggagccatcctggctctctgcaaattcttttagatgtgtatatttggcaaaaagagggcagaaaaaggaactctgaccctttctcaatgtaaaagttccttctgaaggatgaaattaacttaaaggttcagaatctgttcacctggaacaataattctggtgtgctcaggaagctttttaaaaacacagcttcccagggtgccaccctggacaaagagtcagaggaggggaggggcactttaaggaatatgatctgtcctagggcaacaccgttcacatctagggtgagcatccacctactgcatatttagtaaatattcgtgggctctgggcctagatctgtgatagcgtctgatcaaagtccatgtgggagccatcacttgacactgttaggggcttaaaataaatgttgtgacaatatgcaaacactgaacaaatgccaaagcaggtagacgacctgtcccttatttagcggtctgtttttcaggcctagactaccctatccttactggttagaagtattacagcatgctttgctaattattacaagagactgaaaattgctctatgtggaggttgagaccttattggagacttggagcagacaggcatggcctgaaattctctctggatgaggaaggtgtaaggaaacactggcctgagctacatgagtcaaaactttttagcccagatgaattacattctagatacagagagaagctatagaattactgtttagaatctttggagaatcgtggataataaatgggacaggagctggaaagctgagataggcaaacattttctaagttttcaaaaatgaggatactttggatttcacacactgtagatgagagaatctgacataatttccataaaacattcttgaacaggttatgaaacaagcagtttgggagtcgttggacaggagatgagtgatccctaaatgcaaacactggcccactgagaatgttaagccaaagcagcatgatttctttttaggaaaattaaagttgcaaagccttaaatagagcaaatacagcagatgtggcatatctaggatcctgcgagacatttgaggtgtgtgtcagttcacacccgtagcttcctggacaaggctggtgcatataaactgtataataggacagtcagatagtcagatagcatcattcttgtttgaatggcctctccagtatttcacaggcaggcagacatttgacggtagtcattctgttgcctataaaaatataaaagtgtccagtcctttgcagtccttaccataccacttgagtgaatgagtacctaaccagagagaattctcatgtggactctgtaccttggcccctgatttgaaacttttcatcagcaatttagatgagaataaagagaacatggaaatcaaaatgctaagtgatatgaaattgggagggaaaatgaatactttggatgaggccataaggttttgaacagatatgaatagctggacaatggagctaaagcctactggaatcattctttgtcactcagtccacaatattaaattccctatttgtctggaacaggctaggtgctgagatcaggagatgtgcacgccatagcaaggagagcaggaggcagacgtatcctgtaatactttggtggaggtcagccccggatgctataggagcacacaatgaaccagatctcatgaaagcttgaggtgggtaagggcttggggagagctattgaaccgagcaaggagatcagatatctggagaaggtgatatttgaatggttttgaaaaaaaggagttagctgtgatccatgctggggtgagggtgttccacattcaggcagcaactataatgatgtcataaccaggacctgggtgtgagacaacatggaaaaccaatttgcaatgctcatcaatggcagagaactggaagagagagaggtgttacatatttttctcactttagcgttccctgctgctggagtatagaatgtgagaaagactctagggatactctaaaaaggagcagttgtaacataaagggcatgctcttttatcttagaggccagcattttccaaacttacctgatcattagaatcacttggtccttgttacaaatgttctcaggccactttcttggcaaatctgatttcaggtgtgtcagagtgtttcccaggaatctattaagaagatcgctagttaagtttgggatatactgttatagacatggggaactattggagatttaatatcgggaatgaactggtcacattggcattaaagtgggctgttctggctaccgtatacggaatgatttgagaggggtaaatacatttgacactctaggccagaaataatgagaaataattaagaaaatcagtaatagtagacagctgttggcttgagagagactgaagtggaaccaagtgggtttaattactacctggacttagaaaatgagggatgaggacgaggtgattgacggcaccagttttcaggcttgggcttttaggtggtgccatttattgggatagaatcttgcttcggtcaagttgagtttaggctgcctgtgagacattgaggtggagatatacagtaggcagatgtatgggtctggagtctaggagagaagtctggaggaacatagagatttgtgggcccaccatctactgtggtagttaaagccttgggtataactcagattgcttagtgagaatgtttagttgagaggaacagatggtccagaacaggaatctgtggaccattctatgaaagaaagctaatgaggctttcaaatgggagcccaagggggaaaatacagggaaagaagaagaaagaggagaacatggtgaagagtatcaagaggaagagatcgctgagtgctgctgagggattcaggtaagaaaatagtcattaatgatttctgtgtactttctttgagtgagcactgctgtggttgttttacaaatgttgtcttatttaatcaccacaataaccaggtgaggtagcccctgctatttacgtcaaggaaacatggggaaactgaggcagcagaaagggtaaataacttgaccaaaggcacaaagttgataaatgccagggccaagatttgaacataaatgaaaggatgccgaagtcctgtgtgttgaccaccacaatcacttgttaggaaacacagtggcaaaaaggctacaaagggcttgcagaatttaacaacagggaagttcttcataaccttggctctggcatggtcctgaagcaaaccaccgtgcagtggcttgaaggcaaaacaaagaaacagacagaaaggggagatgactttccaaaaaggtgagttgctggttatcaaagggtaatacgggccaactagggatgtcgttttaagatgggaaattgtgtttcgatgctgagaggaaagagtaggtagagagaaattggtttaagattcaagagaggaaattttggttgaattaagatctctaaggaggcatgggagaacagagtgcagaacagcctaaagggaattgcctggactagagatggaaatgtcgtccctctggactggaaggaaggagggatatgacataaggatgcaagaggaggggaaggattacctctttgaagcaggatgtaaggtcttattctgaggggtggcttgttgggtgaagtggtattagtggacctcagcagacccatctaataactttagccatcagcttctttttgccaaccgaaatggttcctattggacttcccccttctggctctcctctctccctttctcctccatttctggagcctgtgtagaaccttcattttcaatcactgcttgttgctgtcatgagtggtgcttttccattcgggaacagaaaagaaaccctcccgataaaatccagtagactagagtggggtagggggaaggaacagtgattgctgttctttccttttatccctcagggaaagaaggggacgaagatggggcgggagggaagtagtgaaggccacagaggtaggaagaaccaggaggtgggctggagcagagccagcttgtttagcaagcaaagcagataaagattagagtaaccatgacaacaggctactggcaaaggcgctcagcatttggggaggagagagggaggtggaatggcttggctgggtataagcccagagttttggaaaatgccgtttcttcccgcagggctcttggttgttagagaaatcaccatagtcaccaacagtgagtgcaagggaaagaaaggagagggcccgcaggaaagattagtaggtgaggtgggctctgctgattcaaagaaagagggagtgactcctctgtgactggaggcacagaagaggattaggaggattccctgtcgattgcctcaattgcctcagtctatctgtgtgtctcagggtacatatatttttctgtttagctctattttctcactcacgctatggtagcaaaggcgccacaactagtatgcctttttgtttctagtttttcaggataccacattttttacttctggagaatgaggcatgagaatatcaagactctgtttttttttctgaggatgctcaaaatgtgtgtgagggagggagggacgaaaaggaggagagagaaacagagaaagaaagggagaatgagttcatcttggtgtaaactcttcacccagcctaggcctgtaattagttaagaatttcttggaaatctttttcccttgttctattgccacccacttctatagctgcttgagaatctctatcaataagaatgtagaagggctgggcatggtggcttacgcctgtaatcctagcactttgggaggctgaggcgggcagatcacctgaggtcaggagttcgagacgagcctggccaacatggtgaaaccccgtctctactaaaaatacaaaaattagccaggcgtggtggcaggcgcctgtaatcccagctactcgggaggctgaggcaagagaatcgtttgaacctgggaggcggaggttgcagtgagctgagatcgcgccatcgcactccagcctgggggacaagagtgagacttcatctcaaaaaaataaagaaaaaaaaaaaagaatgtagagcagccatagaaaataatgaaattatgtcatttgcagcaaaatggatggagctggaggccattgtctcagtgaactaagataactaagtgaactaagaaatagaaaatcaaatattgtgtgttgtcacttataagtaggcgctaaacagtggatacacatggacataaacatgaaagtaatagacactgagagctccaaaagctgagggagtaggagagggagggggttgaaaaattacctgttgggtacaatgttcactgtttgggtaatgagtatacttgaagcccaatccccaccagtatgccatgtacccatgtaacaagcatgcgcatgtatcccctgcatctaaaataaaatttaaaaaatttaagaagaatatacatacttttaacatctgtgaatatagttgttcctttgtgagtaagcccaaagcgcctatatgggaaaattaaaaaaatggtatgattacaaacaaatggtgctttaggtttgagtatctatctcctgataacacccagtgtgatcttgcccaaaaaagcaccagcactgttggggaaggacatatcacactcttccttagtctgatacgtcagactgagatatatatatatataattttatttatttattattatttttgagacggagtcttgctctgtcacttagacttgagtgcagtggtgcaaccttggctcactgcaacctctgcttcccaggttcaagtggttctcctacctcagcctcccgagtagctgggattacaggcactcaccatcatgcccggctaatttttatatttttagtagagatggggtttcatcgtgttggccaggctagtctcaaactcctgacctcaagtgatccatccaccttggcttcccaaaatgctgggattacaggtgtaagccaccgcacatggcctctgagatatgtttttaatataaagtgtatcacaagcatggctttgagaggagagtccactcccttccttttctaccagactactacttcgttgcctacagaaatggatgctggagctaccacttgggccaggacctgagtcccagaatgagcccatagctcacccaggggctcatagaaccccactggttccataagtgtgggtgtttcagatatcattgctgagacttctccgttttgattgaggaggaggtagtaaagtggattcatttccatttccaaatctctttccttccaaataagcatgtatagcccaagatattggaaaaagaaggttcttttgcacaaaggaaacttaaaccaggagatacaggacttgagctttgttctaaactgtcataaatagctgtgaaaagagaaaacattaagaagactgatttccccagggtgcagaggggaacaagctctctcaaagttggaaagagtgttacgattctccaatttcgctatatgtcttaaactactttttagagaaatatctacttctgccaggtggatatagttatcttgttcttctcagctacgttctaattcatgaacacatagatttggccagcagtgatgtcaagtgcccagtgccttggggaaccggcttggcattgagattttattggttaagagagagatttcctgaaccaatattgagctgtttgccaggttctggcttgagtaatttttttttctaataggaagtagaggtggagggacaggtgttgagggtcagataatgggtacggttttagacattttgaatatgagccattcccttccagcgggtcaggagaatggtctctgacagggagagaatgttgggactccttaccgtatgggactagctggggcatgaaagtggatgacttctagggaaatcacatggagaggaagaggggctgaacacagaatcccagctgacaccaacggttaagaaatgggaagatgagaagcctgggaaggagagggtgtaggaaaactgggaatgaatcatacacaaaagttagattaagaaagagtggtaaagagaaggaagtggttaccagtgtctgtggctgaagagcaggactgagaaatactaaggggttctgtctccatggggatggtattgctgactctggggagagatttttcctgaagtggggtgggggaagcccgatgacccaggtttaagaagtggatgcagcgttaagtggagcagaacatagtgttggtacccagggcaccagtggtgctttgaaaagtcaggggcggctttcatgcctttattttggagaggattaaaaaaaaaatcctggagaatgtttactgagaaattccagagaagaaacaaatacaaaaaggaaatattaaaaaatataaccaaacagttatataccccaaacacatccaaaatatatggaacccacatggttgagagaagaaggcagataaatatatctggatgagaaattgaaaattaaattgtgggtaggtattagtggtccttgtgtggttaggagagggctttggaatggaagggcaagggaaatgtgttgggcagttagtcttaggaacccagtactaatcaactcttaaatctacacaatgtagtctctgaggcaagttcattttaaaattggaactaattttttttttaaacccacaagtcaaaatacttagtcttttagatcgtagatatggatgaagttaaatagctctttaagaacagcactgcatggaaaataactaggtttactagctaagtttagcatataaagctctttactgaatggcttctttgtcaaccccaggctggaggagttcaattcctttttatttggtgaattccttaattggattttgtttgccgatcttactttctcacattgtaagattttaataaatcattataatcattccctcatgtcttacaaaaataacctttctgacggttcccgaatgactttttttcttctgtgtttgcatcatgggattattagtgtagcttacaaatgaatcagaaaagggctgtgcagctgagggtatatttccattattttctaggtgtgaacttggagcctgataacaaggaacctgtgaggtcacgcttggctgggagggcacagcaggtcttggcatattatctcctgtctggattattgatgagatccactgcttggaaacaggagagagatctcctatctgcttggttattaaagcctctgcaggaaacaggtttattggtgatgtatgtacactggggcttctgttgcattctcagctcagattcttctgtgtctgttactgttgatgactgcataaggaagaacttattttgttcaactgacgtgtttgttgaatgtctggctcaaaatatacctctcctaagaacttccatgactgaccttttgcaaggctgaaggacatgcttggttacccattaggaactggaccaggaacccaagtctttttctttcaattttcagagttttgcagtttgctctttggcttgtggatgccaacacttagagtttatatagtcagtttctgcgatcctgagatgtatttttttttgcaattgcagttggttgtttctcctcctacagtttgtttagcctcttcctcatccattatcctccaggctgtatctgaagtgggcataggaggagtgcccttcccatgacctgcacaatgttcacagcccctttcctgttggtggggcttttggagaagttggggttcccttgggggattggcagttacaagatttttcagatgaggactgtggtttatttggcaattcaatgccctaagagacttaagagcattcaggtcgatttgtttccactttgttccacgtgtgagtgaccaaggcaaagatctcaatctagacctagaagcaatttttaagcctgaaaagctcacttgtctcgattctctgtttctccctcctccctctgcccttaaactaaagtcaaccatcttgaggccatgtgaaaaaataggcttggatggaaaggtgcacccttaatctaatctttgccatggattggccccctcgtttggtggggaactcttcatgggacatgttgaaaaagacctcacatctttatcattttttaattcatgtttcttaccatattgaattggtttttgccacttgtaacaaaaggattcctgatgaatgcctcctgtgtttggagtcttattttattcttcctctctgtagctgcagggtctaatatatacctaatttataatctgtgtaggtgccaattacatatgtaattgtgtgagcatatgtatataaaaacttagaagcagatatgcccctgagagcaaaataaagaataaagttcctaaaacatacagagaaaaagataatgtaggagaaagaaagcagacgttttaaagtatgcgttgtttgagcttttatgcgtctgtcaaacaaccctgaaagttccatcacgtgtgatattttaaattttgctcccaaatggagaaaggcatcttcccacccctctgctgtgagtcaaaccactcaagcagggctgtggctgtcagtgtgaagccagctcttccaaggacccaggggaagctgccatcgctgccgtttctgcctctgcctttctttgctcaaaagttggcaaatgctggtcatgtcgtggatctatttatagtaggcacacgtctacccaccttgttcttttcttagcatcaacttgacatgctatcaattatccatgaggtgaatgacaacacaagggaagttatttgaggcaggtgccctgaggtgagagatgagggggtggcagaggtcgcacagtgacagctccgaatgaaaagggtaaaacaaacgtcccttgctgcatctggctggtgaatgattgcagacaggttggtgggaaaccctgagctggtcacgcagcagtctcccactgcccttcttccctgtgcctgctgatgtttgaaaagcccatttgaaacagacaaggggcaggacctgaagatgtgatctccctccagtggaggtcatttttgttattctcttaagccacaggaggggaggacacaaggacctcctggggacagggggtggatgtggcagaggctgatactcttcctccacgtaggagcatttctggtgggagtgaagcagccaccgggggatgaaaacagggtgccccattcctcactgcctttgaaccagcagggaggctattcctggcagcagcagtgcacctgcccctggcccacagtgcctcccaccttctttacataaccccccatgacccctcttggattctagactaccctgtttttgctcctcctcactgacaacatagttcccagttaggggaactactacttcttcttctcctccccctccacgctcctcctcctcctcctcttttttaatgttgtaatagaaacattgattgcccatttcagtgggactggctaccctggtgtcctttttttatttatatgccattaatttggggctgctctgtaggagctggtggcatttactctcaaagctgctctaacgatgatgctgatgttattgttttagctccaggaattgaattgctcatggcaatagaggcgacttctgctttgtctgtagcctcatagatcacccctcctgtctatgtcctctgtccaccttggattttgaatgtgaagagagagagaaagattgaattatggtcaaagagagtggaaagcaaattaattaaacctctatcagccttgccttcagatataaactgactcagactttacaacccgttcctctctaagtttgctcaactcccctcctcctgctcccactctgttccgttcctttgggcaatgaggtactaaactacctctgtgataaatgtgtgtgttgattccttagggatagagcggctgtgccctgaaaggccttggaaccctcgcaaaattcctaaatacatgtggtgggcactccagcagttgctggcagactctcccagggatcccggctgagtttaatactgtctgccaggctaatccactttccggggcagtgtctagcaccagagactctctgtctggaagtatcctggccatttaaatgactccaggttcctggggatcagtttgcagcctttgttatcttttggcagagccaccttgcttttcctttctcatcttctctgtagtcagaccactcaagtgtaactttgtttattatttagggacctcatggggagaagttgagatgattatcctgagtacagaatagccaacttccaagtgggtattgtgggtgtgcgtgtgtgtgtgtgtgtgtgtatgtacattcgtatgtactagcatgcactagtaacacgtgtatgtttgtgagtgatactggctgtctaggaaggatgagtagggtttggatgaatctcttttgcaggaaccaaaacaggtgcaaaatacccgtgtcagagtcctcagatggctggtgagtggaggtgtagcaggacaagccgcagacaaaacccctcagacactgagttaaagaaggaagggctttattcggccgggagcttcggcaagactcacatctccaaaaaccaagctccccaagtgagcgattcctgttccttttaagggcttacaactctaagggggtccatgtgagagggtcgtgatcgattgagcaagcaggggttatgtgactgggggctgcaagcactggtaatcagaatggaacagaacaggacagggattttcacaatgcttttccatacaatgtctggaatctacagataacataacccgttaggtcaggggtcaatctgtaaccaggcccaaggtgcggcgctgggctatctgcctgtggatttcatttctgccttttagtttttacttcttctttctttggaggcagaaattgggcataagacaatatgaggggtggtctcctcccttagcggaattccgtacattttgttctaagttataaccaaaaaactgaagtttataaatatgaggccttccttttccctctttgtagactaaagtttgtgaaccaggaccccctatcgatacctttttagggattgtgagatctgactttttttttttgtattgttgattttgctatttctcagggatgggagttcaccacccacacttttgtgctgttactatttgaccacctcttcctctttgctccccccacaacttttattatccagggagaaatcttttggaataggatagaagaggtttctggggataagttttggaaataggcaaatttttagtctgaaggacattgtagtaggatttatgattctgaaatgtagtgattgtatgtagttatgtatttgggtacacagccttatgtacattgcgttaaatacatttaaataattggataatgcctagacataattaataaagtgatgctgctttgtttcttttgttattatcatgttattattattttatatcatcttatgcttgctttttggttctgaggttgattgcaagggttagaaaatgacagcgtacaggtcaatttttgtaaataaagttttattggaatgcaggctggctcacttgtttatatattgtctatagttgcttttgtgttacaatagcacaggaaagtagttgtgacacagattacctggccaacaaagcttaaaatatttagtatttggcctttcgatacaggtttccaccctcaggtttaatttagtcttttcctttacatactttcaaaagtgctagaacaatgctttagaaagtgctagtgtctttaatggaagaatgagtcattatctatactcaagcatattctaaaccaatcagaagagcttgagagacacgtctgaaacgtgtgtaggaacacatatgataaaaatatatgaaaagatactcagcagatgtttgtcagatgccaccaagtacaaggtagcttttcaggtgctatgagaggtactcggtgaatggaataccatcttattctcagagagttaactgcccaataggaggaatctgctaacataacagagatgtctgatagtggctatagacaatatacatttttataaaactgaaaggaggtagaatggcttttgtagccaagtctatgtgtagaaaatttggaatggaaattaagaaactgtagtgatgactgctgcttctaacagtaaaggaaatatttatgtgtatcttccagatgtttactgaagtagaaccttagtaagttatttgacatgaagcccaaagttataatagacacaaagatgcttcatttcaagccttagataggaacaaaaatatgattgaaaccaaaattagcctagaactagaagtggcctttacagatcatctactaatatcctgctcattttgcagctgaaaagactggggctgagagatctagttgtataaaattgtctctgaaacctaggacttctgacttccaggtctttactaaattccagtgtaatttttaaaattttcaagccagattctctgtggatgtggagaatatcaacatgaagtcttgcactgccttaaagatcttcattagcatgctattcctttcctttatcttcctgagtccccaaggtcacagatgtaggagtaaagtattgaaaagccattcaggactctgtcttctccccgttgccttgttgaactgcttatgggggtgatgttcaggggctgggctagggcattccactagagtgcccaatatctttatacagatgctgattgctgccctgaatacccacagcaggaatttttttgagagaggaaggtgagtgtgggcaattgggaaaacagcccacaggtaatggagggagggaaccttaagtttccttttaactgccaatcagtaattctttgttcatttattcaagtatttattaagcacctactatgtgccaggctttgttctaggcacttgtgatacaacagcgatctacacaggatcctccccttgagggctttgcattttggtgtgcttcatggtggaggagtgtgtttttcatggtgaagccatttggaatctgccaggttgaagcactgaaccaggagtaggaagacctgcatctaggcctcagcactaccccctcaccagctctatagccctgtgcatctcatttctctgcagccgagtcctttcttgttagaaccttcaccctggctcctctacgacaagggtatctttcttctttattctggtgcttgcctccttatctggtttccccacttcttcttgcccttagtttctgctgatatgttcttttgtccagttgcctcttactgggtctccctgatgccagttgtgtgtccctgtgcaggtctctgctctactgtgacaatatgttctgcctgtttgcactttctcagtctttgcacttctgctcctacccaaccccactgagcaggtctagctccatatcctggatcccacccataggcttatccacaccagggagagttccacccctggctatgtctggaatcaggacttgctgcatgttgattcactcattcagcagtatttattgagcaccatttagggatgtgattggaagaagatctagtctcggtgctcatagacctcatgtgaaccaatgaggaatcagaattgaattttgattaaactcagggaccctgattcctcaaaaaaaatgataaatttggagtaaacttcaacaaccctttaagctcaagcactcagtccacaaaatttctctatttcagacatttctccctagcccttaaatcctctgtctacaagctgattgactaatatattcagctaaggttataaaagcaaccagggtttcttaggcagccaaaaagaagtcagagagcgaagaggagagaaaaagccaagaatgccatagatcctggatcaggtgggccagctaggggagcaaggtgggaagtacaagctttttgatgcctgagaccagtggtttgagtggggagcttgcttgggaaaaatcagcagggtccacagaaatgaaaggggatgtctaccaggagcagctaagaagagccgggagggaggtctggggggctcctggtcctcaccttgttttagggtgctgcccttgcctttttcaattaaagaaacagaaacagcagctatttggggttttgagcatggaaaggtggaggacagaggagctgtctgagttatcttaagaatctggttttactgtttattgaaataaaatggtcagagcttgaaggaaaaagtaatttaatttataaatagttgctgatcactcttgtgaatagtatattctgttgtcttcagaaataatcctgtagacatcacctgcatgtcaatatttggttcagaaaatataatcaccagttgctgttattgtctataaggcacgatactaaattatcttgtcatctaactcagtttttatcattatctcttggtaattttattgaaagaaaccagtaacttgtaaatcataaaaagatgaataatcccagttataaattcttttccttaacagatgtctttaagacaatctgacttaagttctcaattctgactaatttttttctaatggtttttagagagctgcatcatgatctgtgtgatgggatatgtttgggaatggtggatttaaaatggatttctgatagtatatgaagggtatatatctttgaaaaaattgaaggcagaaaaatatacagaagaaaataaaagttccccatggcttcctcttttccaagaactaatactagactgtaagaggactgtgaggggcagatacattgtctgttttatgctctgtgcctgtgtcaaaaagtgcttggcaaatagaagggactcaataaatagttgtaggatgaccaaatgaatattttgtgcgtttccttcaaaccttttttctatagatatatgtatgaatactatgtaataatgattacttttatatctttaaataatattctgtatttcagttttatattccgcccccattcttttttttttttctttaaccacaatagatgtgtttatatacataagtttttcgggggatcagaagaaagtataatacaaatagtattatatgtggagtgatttaaaatgttttgtttatattttaatagttagtgactaagaaatttgaagtcagccttcctcctttgccttagtttctcagctacaaaactgtgtttgtagaattagcacttaggtacagagagccaatgttcagggatgataatgataaaatgatgttatatagataggattgagagcttatttactagagtcagaagagcctgaatttgaatcttttccctctcatagtattagattatgtgaccttgggcaagtgaccttggacaagtgtcaacctttataaatcttatttccttgtcgtaaaatgtgtttgcatttgttaggattggctagctagagtgtgttgccataacaagtcctggaatctgatcaatttagcaaaacaaaagaatgtttcttgctcacacaaagtctgagtagagcctggatagtgagtggcagtaggggtttaggttgcctactctttgttgtgctgccatcccatctaaacagatctttaatgtctctgcagcaaaggaaaaggaagcttggtgatggtgttaccagtagaaggtctccaggttcttggtgtcttgaacaaataattggacaaaacacacgtacaaagcaaggaaggaatgaagggttttattgaaaataaaagtacattccacaatgtgggagccggcctgagtataggggctcaaagaccccgttacagaatttttgggagtttacataccccctagaggattccactggttacttcggttatgccttgtgtaaatggagaggatgaggtaaagttacaaagtcatttacggattatgccctatggagagggtattttctgttatagctgaagtgtgaatcggccttatgttccctgcctccagaccctattttcctgcctcaatggcacactagctcttgctgccttgacaatgaagttacacattacatattacttctgctcacattttgttgtgcagatctagtcatatggccacacttgagtacaagggctgaaagtaaactttttaggtgcttaggaagaagaggagacccagaaataggtaagcactagtagtttttacaacagaggtgaataatagtaacttcaatcaaaattggtgtgatctaatcccctacccgcttgtgattaaaaaaaataggattacactttttttaaaaaaacctaaattattaggccaaggagcttcccactagcaaatcgctagaaataaattctcctcaaaatggcttttaatgattttgaggaattcccagggtcctgactcctgggtattttcaaagagatcttttaggtttccccattctagtcccttcatcttgccccaggctaactctgatgttttgagaggacttctttgttgtgcctatctgtcccccattggtggccaatgctctccctagttcttttcaggacacgataaggctgagttgatgagaacatattaaagtcttgaggataaagccagccaaacccaaggaacagcttacacctgataccaggtgggtttggactcacaacctcagatctacacctaaacttcagagtctccttttctgctagttcttagctcggttccatcttttccctgccatagggaataaatcaagcctgtgcatgcttgagcacctagacccaaatggtttgccctatttctaggcttaaaaaacaaacaaacaaacaaacaaacaaacaacatctctggattacttcctcccaggatggctgccagtgggaaattcattttcctccagaagagatttcacagtgtggcttggctccctgtctctgaatatgtaatgcgacgcttgacagcactttactctaaatctagattattcatgcgcaaatcatgccaccatggggaccaatagcctatccagattgtgctttgtcaagtttgtatcaccttcatgtgacttttcttccagcagttgatgagggaaaatagggctttacctctctcttgatattctaggtccagctccatcacccaaaagcagatgcctggacaacttaagcacagtctctccagaacaatccagaatgtcaagcattgatcaattttaatttaagctttgggaaccaaaccaaaccaaaaaaacctccaaaacaaaaacaagaaacacccctatctctgcacatacagttctgttagtgcagccaattccatcgttaaatagatacagtatccccccttggaaagccccccagtagatgcctgaaactgtgaattgaaccaaacttgattcccatcaattgtagcacatttctgtttgtctcttccaccgacaaatttaatgccttttccatcttaactaagcacttgtcatagactgtggccataatttttgcaatttgaggtgcaacagtaaatctagaacgaatttatttttccttcttcacgttttcaccaatgaaattggtcttactgtagatcttagtaacctcagcatatgtttttttttctatcctttttaagctgagaactctcatctattcactgaaagaaagcactttatggcttctctttggcatatctgagttgccaccatcactactcttgcattttggaaccattattaagtaaaacaagggttacttgaacacaagcactgggatattgtggtagttgatctgataattgagcccactactgagtgactgagggacaggtagcactgacagcatggataccgtggacaaagggaggattcactgcctgagcagaatggagcaggacagtgtgaaattttatcatgctagtcatagtgatgcataattgaaaacttgctgtttatttctggaattttccatttaatatttttggactgcagttgactgggtgtagtaactaaaaccttggaaaacatgtctgaataaggggggactactgcatttaatgtgtttgtctgaaggttttatactgggtgatttctttggacgtagtcttccccaaggaggagagagaggtactcactgccttccatctacataaacaaaggggtcatcaaagtaatcctttccataacaccggctagtttgtatctaacaacaaaacaaatacattcttcactttataaggcagaaacccacaaacggatgtttttacagctgcactacattttttttatttttatttttaaaatattattttagattcagggggcacgtgtatagatttgttacatgggtatattgcgtgatgctgagatttgggcttctaatgatcctgtcatccaagtagtgaacatagtacccttatcttgttccagttattagggggaatgcttccaacttttgcacattcagcatgatgttggctgtgagtttgtcatatagggctcttattattttcagatatttttcttgatacctaatttgttgagggtttatatcataaacggatgttggattttattgaatgctttttctgcatctactgagatgatcacatggttttgtttttaattctatttatgtggtaaatcacgcttattaattttcatatattgaaccatccttgcatcccaggattaaagctgactttatcatggtgaattcactttttgatatgctgctggattcagtttgctagtgttttattgaggatatttgcttctatgttcatcagggatattggcctatagttttattttcttggtgtgtctttatcagattttggtatcaggatgatactggttttgtagaatgagttaggaggagaccctccttgatttttttggaagagtatcagtaggattggtagcagctctcctttgtatatctggtagaatttggttgtaaatccatgtggtcccaggtttttttggatggtatatgtatatatttttttaattactgattcagtttctttacatgttattggtctgttcaggatctctgcttctgcctggttcaatcttcagaggttgtgtgcttttaggaatttattcattctctcaagattctctagtctgtgtgcatagagatattcacagtaatttctgataatcttttgtatttctgtgggatcggttgtgatatctttgtcatttctgattgtgcttatttggatcttctctttttctttgttaatctaggtagcagtccattaatcttatttatcctttcaaagaaccaattatctgtttttttgaccctttgtatggtttttgggtctcaatatcatttagttctactctgcttttagttatttctcttcttctactagctttgggattagttttttttttttttcttttttgagatggagtctcactctgtcacccaggctggagtgcagtggtgctatctcggctcactgcaacctctgcctcccgagttcacaccattctcctgcctcagcctcccgagtagctgggactacaggcgcctgccaccacgcccagctaattttttgtatttttagcagagacggggtttcactgtgttagccaggatggtcttgatctcctgacctcatgatccacctgcctcggcctcccaaagtgctgggattacaggtgtcagccaccgcgcccggccaagattagtttgttcttgtttttctagttcctttatgtgtgaagtttagattgttaatttaggacttttctatcttcttgatgtagacgttttggtatgttgtgtttctgttttcatttgtttcaaataattttttgatttttgccttaattttttgttgtttacccaaaagtcattcatgtgcaagttgtttagtttacatatatttttatggttttgaaggttcctcttagtgttgatttctatttttaatccctctatggtccaagaagatgctttgtataatttctactttttaaaaattgattgagacttgttttatgatcaagcatgtggtactttttacagtatgctccatgtgcagatgagaagaatgtattttctttggctgctggatgaagtatcctgtagatgtcaattagatccagttggttcagtgtccaatttaagtccagaatttctgtgccagttttctgcctcagtgatctgtctaatactgtcaatgtgttagaggtcccctactgttatcgtgtgtctgtcaaagtcttttcttaggtctaaaagtaattgttgtataaatctgggtcctccaatgttgggtacgtatatatttaggatatttaagtcttcttgttgaattgaattctttatcattatgtagtgtccttctttgtccttttttactcttgttggtttaaagtctattttatgtgactcaagattagcgactcctgctcttttttgttttctatttgtgacttcactataattttaaagcccagttcccactagaacttcgttttgttagatgctttgactgtaataaaacagccttcgatttttccatttttatctttttattcattatcttttgtaataaattccattatgcataaaattttagtggttacttctgggatcaagcctgttaacccactcacacaattaaattttcctttctgactttattttttttcccccggtagctgagtacctttcttgatgtaacattgagtaaaacattggctatttatacatctaggctttcattctcataagtgtgtgttttaagcatgggtattaatttcattatgtgggtccaaacctgtctctgacttggaaatgacttacgggtgcacatgggtctgcatattaaggtctcttgtggctgtgggagtgagtgggagtgacgggagctactgtgggcattcttgtgtacatctggccatagcagtgggtcccaggctagatcactggcacttctttaattaaggctctgtttctgcccagagcaaatttgaggttctctgcttcttttcctattgcagaaggggccctacctaggaaggattttgaagttctgtttcttcctttattttttttttatccttttggatgtaacagcgcaccaaccactgccagagctgacagaattggaatggaagtaggtgggtgggggttgggggtggaaggagggatggcagtcatcagtttgggaacaacctctgagccaaagaaatgcctttggcatatgagaacagtgtgagtttatctcttttcctgtttggaagaaggtacactataaatccgactctacccaggaactgtttatgggagatcgttattaaagaatagatatttgatttttccattggtttggagaaactaggagtcaggcactaaggacgtgctgtgtactcataacttttctccagctatccataaggctaatatacatttttgacaggaatttttttaagtaagaatttttttttacattgtatttatagatgtaaaagcactgagagcttcattactagaaagcagcccctatggttttcagcattgctagaatcaagagatgatattcttgttgactgttgaccatgcttttccagatcacccactgttgcacattcatgaaattggagtgagcatacaaatttgttgagagaattatcttaactagattcaacctctgtgcccatgaggtactgtcattctcagtgattcaaatagatatttgggtacaggtggtcatgtttggcgagctggtttctgtgcagattcagcacctgtggtttgtttcatcttatcgttcagacacagatgctcttagagcaccacaccatgcattccaatgaaatctttccactgaaaccataacctctgtgatcctaaaaggaaggagtcagtgtacagagggacatgacatattcaaaatcagaagttgggataagccagaaggaaccttgtgggattaattttcttctttaagtgtgggtaatgtttttcgcatgccctcttttcaaacctcagcacttcacttgtccatctgcattttctccaagtattgtaaatgtcaggtttgtgtgaagaggcatctgtaaaactgctggcatgaataatgactctgatgtttatgtacggaagagcgcacctgactttagcactcttattatcttttactaattaaaatcaagaagatgtttcagctagacattgcctgtgcatagcacctgctggattgcttttctccttttggtgtttctggtttggtggaaaggcaagaaaggtgagctgaatgacttggagcaaggaacagtggtgatgtcccatcactctcggacaagcactccttagcctatttaaatttatttttctagttctcaaaataataaaaaaaaaattaagacttagccaccctttttatcagtgaggaaattcaggctcagagaggtgagctcatttacctagttactcagcgtgtgacaggattaggatttggacccagagtcacttctgaagcttgttctacttccaatcttataattaccttaaaaatagggtgtggctgtatagaccagcttttgcatgagaaaagcctcattgttcatgaatttagtttatattggatggttattttaaattatagtcatgtgctgagcattatgtcaccagcaaatcatagccgttttccagagatatttccctggttaaatattcacatgacatttgaacatactgaacagccaagcatgttgcttagttgttatggttgtttttgtgcggggatatcgggtaggggaggggattaaaagtattgggctggtctggctaatttctagtctccatttcttgcagacgacctctgattctctggttttgaagtagggaagtgtgactgtggtgaatcccaagaaacagcttgatagctttacaccatacacctgccattgctgacatactttggaggggactgaagtggagatgcaaagcagtcaggctgtaggccccagggagcttatgaatctgacctcaggggtcctccctgtagagattcctcacaccaaacatctgaactcatgtcaggcagtactgttttaacctcactttttgcccagaatgatgggaataaaatcaaaattgacagacagaggaagctggtctttcctccagaattgataaaccaagatactttaaacttattcccaagaatgtggatttctgcatgtatgtatctcttcaaggttgcataaatggaatttgtgcttcaatttgtcagaatcctgaatttccaaatcctgatgtaaggatttaagtaggagagatacctggatttgaattgttgtgaaatacagtggtaggttgactagctttattccaacagagtgaggttgatagtctttgttgccatgagatgcttcaccttttcccctaccaaccttcaaagacatggtggagcggaatcactgggcaacaccagtgggaatagttcaaccaacagtagttctcacttagcagagacagacctcaggttcaaccttttcttgactgccatttcgattctgcaagtggcaaaaataaactggaaagtggatgatcactctcatatgctctattgacaaataagaaaaacagggaccaaaaacaactttctctgggcagtctggggaataaaagctgctgggaggatctagtgtacacatgcgtgtagcactttttacattcgctaaacccttttatagttactctgtcattggccattctgactatgttgtgtgcagggcaaatgagttttgttcttcccattggagaaaggctatctaaggaagacccatgggaaattagcaagtaagccagggctggagttcccagagaggccctgcatgaggtcccataggaagccgctaggatctcgaggtctagtcgttatttttcctctttggcagattacaccgtaactctgaaagagccagggaagcctaggttgtttgttctttagagtttttaacatggaaggaggtttagaatttattttgcccgtcttttcattttagagatgaggaaaatgagacccagggagatgtgatttcacaggtcaaatagtcctatgacactgggtagacaataggatacctgatgtgaatgttgaaaaatgtgccgtaggagaaaacagccctttaggcacttgacttggcaagctgaggttacttggtgcaaaggaagagatgcccttctttcaggtggatgtagatccatgctgagacacgtggctcagagtgctgagcatgggctggatttcagctcctgatccctctattttcagtccacaaactgcatactctgtgaagtggctctgcatggttttgctggttcacttaaaacatatttggataaaaaacatgactgaatgagggagtcagcttttcattaggtagaggaggtgtccatatgtctagtaattgccctcatttggcacaaatcaacgagacctgagggatgagggatgaatctgtgtcttcttttttatggttatgggcatgaacagttaggatgaaaccagacctgcgtgttctggtttggctgatgatggatactttcaaaattgtatcaaagaaaatagacaatggaagtctggcagactttacaatgagtatctagtaaatcggatatgaaaaggaaaggggggggggaacctcatcttctctgtgaatttctaaaaaagtgttcacataagacagggctagatagtttgaaggatattttccaagcccaaaactgtacaagaggaagttttctctgggagctggaatttgaatggacaaagtcaggttggtctcagtggttaatgcttaaagtttataaacacatctttttgtttttagcacatcctacaaatgcagtttattaatatggcattttatattgaaaggtaaatatcaccataccattgtgaataattctttggtagtgaaaatagccctatcttacagtgactagatccttcttataaatgctcttcaggtagcccaaagttctcctttgtataacccattataattagattatacatataattgtgtagaggtatgtatttaatatgtgtctctcctagtagcttggagtcagtatagcacagcagctaagggtccagccctcgagatctgctttcaaattctacttttgtcacttagtatctacattacaccgattaacttaatcagtgtcatgtggtcctgctaactgcattaatttgtctgtatttcattccgcatctacaaaatggtaataaacataggacatattttatagggctatatattgaatgtattaaatgagaaaatccttgagtattgcttagcactgtgcctagaacatgaaaactcttaataaagcttggctattagtcttgctaaacggtaaagactgtttctgtcttatcccttgtgttatccccagttctttgcacagaacttgtggcacgcagattaatcatagaaattattgaataaattaatggtcccatttttttcctagctccactgtggtgaagtctcagattcccaaggatgtggttgtgtgcagataggttccatgtggccagggctcttgttcagtttagtgtatttattctgccacactttgcttaattccagattgatttgcttttatatgaagatagtaatatatgggaggcattgattcttagcttcttaaaaactgacagctaatgtttagaggcatttcaaaatacagtatctaaataatatgtagggaaacaggagatgtaatttgggttgataggaaatgccttgggctcaagtaagaggttctgggttccattccgaagtctatcagagatgagctttcatgtcacctgcttaaacttaactttttttttttttaataaaacgaagggactaaagtccattatcatcaaggtttttgcttgtgtttgtattttatgacagtaagatgttagttacttttattaattccttaaatgcatggaacagatttgcctttatattatgaatagaatgcagattcaatttctgcaaataatgtttctttgtattccagggaaacttgctgttgaaagttctccttccatgagtatttcttgtaaatcaagaatcttttctaatacaaatagttatctcatgtttctgctttgaaaatttgtatgtattttttttttttttttttttttggtgaaatgaggcatatttgaatgctttgaagtaaaactaataccatttagtgagtatgcacagacccagcatagggaactaagtatttcaatgtttatgattttaaaacactgtcatatttcgtgctgtccaatcacgtttagctttaatagttttccgtccaatttttcggaacccaccagacttgatttttaagagttagttcaaagattgcccaaactttgattcaatctggcttataagagataacaaagattattatttaaagccacagtcattagtgatatgagggtagatatgaaaaagaaaaactgaatagactgcttatctcttactgtgatctgtatgacctctgattaatttaatcatggttctgtatctaatgttgagggcctgcaacaaggtcttgattgacaaaatctattttctcttcatactcattcaggcttcttggaagctaggggtttctgattaaattatgctatttttgtaacccacagaagatcccatatggtcaatttcaagttcccgttactttcagtatttttcctagatgttatttcacttaggacaaacaggatgcaatttgtggggtggttgtttgaccttctcgtattaaaaggttgtaagtgttgtctctttcagctgcccattttagaagttaaatttattgattgctgagcactttagtgcattctctcatttattcttcacagcaacgtgaagaggtaaggtctgctattaatcccattttgcctttgcaaaataagccatagaggagctaaataatttgcccactgtcacacggtaagaggttgagccatgtctgaaattcaggtttatttggctccagaacccctacattagccttacaataagatgcctcgtgcaacctagcttgatggagattgcatgctaaatatattttaatactggaaatggtttactgatgtttccagcattcataatgatcaggttgcaaaatctgtttggacatttattaagagattggaaccaaattaatgacatcttctctgaaatttctcttggcttatcttaggagaaattagaatgaactgaagcagggaaggataggaaagagctatgtgaaaaattaaacactgtgtttaccaatgttgagtggctttctacacaacatgtgtgatctgtgtgtggggccctgtgtccagtgctcaggttatggtcctactgtcattttcagccactgttcattgatgtacactcactgttcagggtagtagagtccacaaaagcatgcaatgtcactgacatagcggacggtagctagcacaggcgtttagtgtggccatgagcctcagctcttgctcctataatttcatttctcaggaattgttgttcttccctgttgctgggtcttggtagggtctgctctggtctatcctaatcggtgtgcttaactttacatttggagtactaagagttgaggttttgcttcctttcttcccagaattgctttggaatccttatgcagtttgctctgctttctttgtagtgaccaagtttatatactggcacttctgaatcccaagaaaatgacttgctattcaattgacatttcaaaatctaagatggtacccttgcaaccaagaaaatataatttattttataaaagaaaaaacccgtctacctcatcatatgcatcagatatacaactaaactgtggtaaatgcttgtacaccagtatcttcagggtcctggggagcacaaaaagggctacttggccaaatatgacagatgattcctgatttgactcttgggggataagtaaaatctaaccagatagagaaaggtggaaagagtattcaagcaaaagcacaggatgaacaaaagaaggaagcaatgaattgatgattagtaaagcaaaagcaaaatagattagcgttgctaaaacaaaagtatgaggcagagggtagcaaaagataagtttgaacatataggtagaagccctaaaatgcaatgccaaggagactggaatttattttaggttacagggcacccctaaagggtgttaaatgggacagacgtgtttttcacacagatgagtctaatttcagcataaaagatggatttcagggccagtagctagagtggaaacagggaaatcagtgaagagatgttaacatggtaccaatgtgaaatgagaaaggagccacccagggtaatggtaatagggatgcagaagatttttcaattatatagaagggcaaattgacaagccatcatgatcagcggtgatgtgtaaaggagagggagtagttgacaaatatttattgatcacgcactctgtgccaggcactttaaaggtcatgagtcacagaagtctggatttctaaaaatctacagaatgactgcaaggtctctcattgtgaattcattctctgttgctgcattggaaattgccctaaagcttagtggctagaaataatatttattatctcacagatttgtgggtcaggaatataggagtagctgagctcggggtctctggctcaaggtttctcttgaggtagcagtcaatttgttggctgggctgccatcatctcaaaacttacctgggtttgaagaatctgcttcgaaggtggatataggtccctagtcacaggggcctctctgcagagccacttaacaagaaggcagctggttctccccagtggaagcactctaaaagatatgacgaagagcacacacgtcagaaactgaagtcttttaaaatcttcatcttggaaatgacgtcaccagccactcctagattcctgacccgcaaatctgtgagataataaatgttatttttagtcactaagctttggggcaatttctaatgcagcaattgagaaagaattcacaaggagagatcttgcagtcattctgtagatttttagatttttatcatctcttccctgatctccctgctcccactctagctactggcccccaaatccatcttttatgctaaaattagactccccaatacttctgttgtattctgtttattagaagggagtcccaaagtccagctcacagttagaggagggaattacacaatggcataaatgccaggagacagggatctgcaggggccctttgagagactgcctaccacacctgtatgactgagtagatggcagtgcattaatgaagattaggaatgcagttgaaagagattttagggggttaatgaagagacttgtttcagatagaaactgttgcctattcaaatggatctgtgcagcagcattagtaatggagaagtagattggagggtggtcatcgttttataggtagcatgtgaaaccatacaagtgaccactaccttacctccttacaaatcattgctcagaggccaccctttcgatgaggtctgtcttcaccaatctcttaaaattttaactcttttttcactctaatatcccatctccaccttttgagttatgcatagcacttaccatcttctgtcacgcccatgatttacttattgttcattgtctgtttcttccaccagaatgtgagctcgattaaagcagagttctttgttttatacactgatgtacacttagtgcttagtagagtacctgatgtatagctgatacgcaatagttatgcaaagaaggataaaactttgtaaaagtagtacatctaagccaaaggtggaaataatccaagtattcattgatggatggatagataaaccagatgtggtacatacatacaatggaatactatttggccttaaaaagtaagaggattctgccacatgttacaacatgagtgagccttgaggacattatgctaagtgaaatgagccactcacaaaaggacaaatacagtatgatttcacttaaataaggtacttaacagtcatcaaatacatagagacagaaagtagaatggtggttaccaggtgctgaatggaggaaggaatgaggagttattgtttagtgactgcagagtttcatttggggaagatgaaaagttctggagatggttggtggtagatggttccacaacaatgtgaatgtagttaatgccacagaacagagcaattaaaatggtttaaatgatacattttatgttatatgtattttaccaaaaaaaaaaaatttcaaaggttgtggacgtagtaattaagataaggactgaagaatgcctattggatttgctaaaacagagacctcagtgagagctggttcagtgggacactgggagctgagatgatactgatgagtgattgagaagtgagggggatacgagctagaggaggcttctttataaagaatgggggggatctcagaatgtttcaggctgggagaagtggtagtggggtgcatgtgtgtgtatgtatgtgtgttgtggagactatgtggggcggggaggccacttggagatacagctattaaataagtgaacaacaatacaaaaggcgggctgggggaagggaggaaggaaaccgaaggaacctttcctgtctacttgtatggaggagtaatgtctgaaattttccaaatagccaaagttgtggcacatgaggaggtttggagcaaacattataatagcttgggttaattatcacagtctgcaccattcagacagtgtctatcagaacccaggaacagcctataagactaagctgtgccaaactgtggaaaggggtcgatggtttagggcagttagggctgcaggttctagggcagttatcatcatgaaaggctgtgataagacattaactgttgaacattcttacagcatattgtattgtaatagactctgaatttgaatattttattatagcaagtatgttgtatgcaaagtactcaggcattgcaaatcaggcaaagttgaaaacaccccagtattattagagctctaccacacagattctgcaacatggggaaactcaatttaatacattttcattgaatacctacctataagcctccgtggtatgaaaggcatacaaaatgtgtatttactatatatattgtaaagtgattatatatactattgtgaaactagatcactatttggtctactagctaatatttatatagatggtattagcatagctattgccacataggcaaagagatccatgttacagatgacagaattgcaggttttctcaagaacttctagtggattttaaagtattattggaaggtggaaacttttgttcagacacaaaagtgttgtactgaagtaaagattgctgcataaacatgcagtaatttatttaaaggtacatggtcctactagagcatgggcagttagtctagaggtcctgatcaagcatggtgtaggacagagagcttgtgtgggatttctatgtgggggcttggcaattctgggattaatttcagcaggttcctgaaggtcaagtgggccaagcttcaaacagaagacctgtggttatgtctattcagtggcgaggccagatttaggaagccgagaaatcaaacattatgaggaacaactagttccagaaatcaaggtcaggcaagggcaagaatgcaaggagaaatgtgagtcaagatagtgtcattgctgtcagaatacacatatgggcctgatttgaagaggaaagggtttgttctagggtttctttcagagtgagaggtttactacgtatggtggtgctaaggcacataatgatgatgaagaagaagatgacgatgatgccgtaatgataaaagctgccatttgttagatctgtgctatgtggcaagcactgttagttcaacaaatatttttagtacctagtatgtgcctacatactggggaaagaacaataagcaaaacagataaaattcttgttctcatgaagcttatgtttacgtggaaggagacaaataataaatctgtaggcaaaaatacaataatctagagaattataagccctttggaaaacacagaagaagcagagtgaatgaagacggtttggaagagggtaaatgtttcatgtacgatgcttaggaaaggtctggaaatttgaacagagatataatactagtatggagacaagccaagcaagtttggggaagactttgaacagagtgagatcaggtgtgaaggccccgtggtagggaattgcttgacaagtaaaaggaatagcaggagggccattgtggctgaggcggaatagtaggattctttagagcttttgcttgtggccatcttaccagctttgcctttgaacctagtgaaatgagaagcccttggaagcttctctgagcatcctgaaacttaggctgtattatcctccagatacttgtgtgagataggtaaaattattattgtaccttttacattaatgaaaaagctgagacatggagagagtttaagtgatttgcccaaaaccagctctaaagctttggaatgaggatttttaacgtggggagtgattttaggttgcacagaaaggatggcaaagggacacaaggacattttgcggggtgatggatgtgttcattatcttgtctggctggtttcatgcatgcatatgtatgtaaaacagtgtgctttaaatatgtgtcatttattgtatgtcactgatacctgagtaaactcataaaatacgtttcaaaaatgagggagaggccttgatggagtttaaagcagagaaatggcattcatattttgggaaggatggattagagatcaattagaaagccattacaaagatccaggaataaaccagtaaggaactgaaccaaggtagtgtagagaggaacaagagaggactttgactgtaaagatgacaagacttgaaaggtgatgagaatgaggcatgagagaaagaaggaattgagcatagttaccaagtcggctgtgttcagaggtgaaccacggtaccattaaccaaaacgtaaaatcccagaaaggcatcaggtcctgggaaaggtgatgacaggtgtagacagactgtgatctggttgttgtgggatatccaggacaggaggtagtttaacttagggagacttctggttgagaactagagatgtggagttggtgtgtaggcggcctattagagctataggcatgaatgccatgccagagataagaaggggtggaggagaaagctcgaaagctctggggagcaccagtatttaaaatgagacatagagaaaaacttggtctgcattgtgccctgtatctcatttcaaactcacaggaaacactgattgtcagtcacaacactctttccttcaggcgtctgtcaacacagtgttggtagaaaccactgcgtttgatcagtgtcaacgagcaagatgaatcctcttttccacccctgattttagtagtgaacatggaaccattaaggagatgaaggagtgtttgaaaaagttagtagaggcccaggagataatcatgtcttgaaggccaagaaaatttcaagaaaaagacagagtaagatacagacctcactcttataagaactgaaacatatccattgtttttggccattagaaggttaataatgactttgtggagtgtggtttctatggcatgagagggtaaaggtcaaattatagtggatccagggatgaaagtgaggactgtgctccccggaagcacaacttggaagtgaagaagtaggaattttattgaaaaagtctgtgttctttttataaatttctttacaaatcaaagagttatttagtttttatagattgtcacatttatttcttaaatataggaatatccttggagtctctttgctaggagacttttgggcacaaagcagatgcccttatttctgggtagtttcctgacctgaagtgtgggacaagactacctgagccttagagccatctgggatggtttcccagctgctggtctaccagcctttgccatctcagagtaagagaagttgcacatggtgcaaagaaaagtgagaaaactgagttttctataaagagcactgctttatcctgagattatctttttttcttatatttgggttgaaatgtctttgtattagtaggcagtatttttttcttttaaataccccacctagcaaaataaaaatttggcacctctctgagttactctgttttttctcaatgattctaattccttaattccttatgaacagccatcttttttgtgtgttttaagtttttatcttctctaggccagaattaatttggagaacgagaactaactagaacaatgatattgttagtcctcaggagctacaggcagatggcctatcacccaagaactccaaaatatagtacatgagattatcctgataaggagattattcttcctaaaattagagctcaaaatcaatcatagtagataagtgtgtaaagtcaccttgaagatatagaatagctcccctgccagccagatttaactttcatgtgattaaaaatattactatgtctaaggaaagaatgtgttaatgaacaaagaggttgattggctatgagaacatgggaaaccatggggggaaaagctggtgatatctgtctgagcactggttagacaagaggaaatgatggcagatggaggcctgaggatagttaggtttcactggcagagaccagatggacccactggattggagaggcccggctatgtgagcctgatgtcaccccttaccctcaatgcatccagctttccttcatcttttcccatgcctactctttgcatttgacttcccaagtaggaggagaatgcagtagtgctggggctaaactattgcttctcatacagactgaaagtttaagtccctgtgtggatcatttctcgatagaattttttaaaccagcattctggatttatccctcagtctcagctctggtagaaaaattctttaatgtgctgacaaagtctggtttctgagcttgtggtgctgaggtctgattgagcctcttgtgccttcagccaggaggaccctggctttccttagatgggagcagactttgacgttaccactgtgttggaccacattgtgacttgctgtaatttttcttttaaagtttcctccaaaattaccattttaaaagaaacaccaaattaaaaacatatttattgaccagacattctgcagaaaaccatgttcaagaataacttttgccatttttcactagacaatttttagaattttgtcatttcaacatttttttctttgtttctcactccaaacttctgtaaattttttattcactaaattttgttcacacaattataggtagtcttgtgatgattgtctccaagctggttccactttctttgtttttaattctgctccgatggattatttgtcttgaagatcttgaaagaagttgataaagaagagcttaatcatagcaaaatttcttagattcttaattcggaccacaagcaaaatggtctgttttaagcttctgctatgaaaaattacatggagtttttctcatggtttcaaattattttattcctaaggctcaaggctcttgatgtgatggtgaacatctgggagaaaaacttaagaaaaaatgtagtcatttgaatgtttgatgaacagtttgagaagttcacaaatttgtaaacattctgattttagtcattcgggttcttcccctacttctttcatctgctcttgtcattatgtaaatagagccctacagaggggatggagaaaaattagtttttgtccaaatattcctctcttttgcatttgatcagaatgttctctgttcttgacgatgggtgataaaattatgggcaaggagaagctttgcagaagggcaaaaggagtaagctggggctctgtgagtattgcctaattgagtggctttgctcaaaaatctttttctttttgatgataactttcttgtgttgttgtcatattacatatttagaaatgaaaataagatgaaatatttacttattgaacatctgcttttctcctagatggggtcacagtctccaagttccctgtttatttaggaaagattggctggtaattcctgtcccctttcctcccttttgtattactttagatatctgattattcataccatctctgttaaggaaaaaaatacttatttccatggaaataacattaggaagtggctttgggagctaaaaatcttcttttcatgagaaaacatttttttttcttttgcagatcttgaaaacaacggcatccttaacatacaatatacacaaatagatgttttgataaagaaaatagatccatataagaactattttatctgagtttacattagacctgcaataacatagtagtgagttgatactaggaagccataaagtcataaaagttttaccagtatgcttaagagaagattctcttgaggaaattaaaacagaagaagtgatatatcataatctttcacaaatctgtataatcaatagcagagatcaatagtaatatagctaaaaatctttgaaccctaaagatattttttgaagggacaacgttttaggaattcttagctcattcttggctgacgtctccatgaaaccagggttgtttgtgattttgcttcataggagaatccttgatcactccgtggaagaacttgtagttccagaagaagaaagctcatgatcatagaatgtgtgatttattaaattagaatctgcattttgctcaaattttgaaattctcagatctttttaacaacaaacatcatgatccagtaccattatattttggttaataatttcggtctaacagagttgtttttggtaactacggaattatcttacctgattttctcagaatagtgaccatgagaaaaatattttggaattggacttggattggaagggaaaagtggaggacaggagaaatcgatcagaagcatttgcagcaatctatgtggacatggctcagattggcctgtggggcagaggggatgcagtgaatggagagcttcaagacatatgggagagagagaattgactgcattcattcatcattgattgtggaggttgagagtgatgaagtctgaaaggaagatccctagcaactgaagtgagaaaaggaccattgcctgagaggggagaaggaccaaaagttcagtttggtgcatggtagttataaaggatcttcagggtgagatatagagcaggcagtgggagataggagttggggtttaaaagagtctcttggtccccagacaaggcatgttaaaatagctgacatttgatgagctttgagtattctatttaataactaattttagatactgtactatatgacagctataaaaataggagctgatgtatctgaaaatatccaaaaagaaaacgaaagaaatcacgttgggtctaataaaaatcagtcagtagatttaaagagaagaagagagttaggctaggagagaaatgtaaaactcccaatttggtctctttcggtttcatttacatggaaatctatgcttgaaagggaaatacagacgactattagaagtcagaaaacaaaggtacaggaaaagaatggaaagtcacctgggtttcccaccacttgtagttttctaaggttaattaaatctatttgcattttataatgagaaaaatatcacaaccttttttttttttaaagaaaacaagctacctttttttaaagtgatttgaaatagaaatgcctctgctagcttctctttttcatgctgagaggacatttcccagcaagccccaaggctttatcgtcttgtgatgtctccaggtcacctcagggacatagtggtataataaggaaaaccaaagggagaatggtagaggcataaaaatgtaatgaattgggggaaggttgattggaccaggcaaaatctggttattttgaccctttgtcaaggcggtcccaggtgtatctctgcccagaagaatatatttcaaatgtcttcagctgtagacttctgaagctacagatgattccactgatttatcacttctcccgtaggttgacaacattttgatactcaaaatgcagggaggaaagaagcataagaagtaggtatgaaagagaaatcacaggctttgggagggagtggtattaaagagcagaagggggataatacccacagaatacctgggatgagttcctcagggaatccttttcaaaccttctcgccctccccacctcatccccttctcacctctgtataaagagctttgcccttttctcctctgcttttcctcctccatcactggctgcttctttttagtctttttgctagaaacgatcttaccttctcaacttctaattgttggagagcccctgggtgcagtatgagtatagcatttcttttcttctttattcccagctactccctacttggctttcatctgttcctgtaactttatataccatttatatgctgcagatgttcaaatgtacatctctagtgcttgcctcccctgcactccacacctcctacttgacatctctgcttagaagtcttgtaggcatcttaaactcaatttgttcaaaaccacatctgcctaattccaatcacatcccaaacacttggtcctctgtcaatgtccccatctcagtaaatgtaccaccatttgtcctgggaccttgagtcatccttggcttttcttttttaccaacaattcatcattagttcattaatagtaatccattagcaagtggctctgctttcaagatatacctcgaatcttaccacttcttaccaccagcacagttaccactccaatccaagccatcactttctggactgttgtagtagcttgttaaatgatttctctagttatacccctcccctttcaaactaattcagatatgttctccacataccagcgaatgtgacccttgaaaacataaagatgttcatatcatttcctggctcaaaaacttatgttggtttctttttgcccttagaaaatccaaggtcctcaccatggcctataaatgcctctggccccagatgcctctccagccttatctcctgtcacctcctccctcgcttgctgaggtccaacctcacccactttctggctgttacctgaacaagctaaaaatctaagggactttgcatttcaagttacctttgtctggaatgttcttctaccaaatattcaattgactgtctctctctctctctctcttacctaatgtaggggtctgctcagaggatgtcatgataccttatcaaaaggaaatcatgggccaggtgcagtggctcacccctataatcccagcactttgggaggccgaggtgggcggatcacaaggtcaggagatcgagactatcctggccaacatggtgaaaccccgtctctactaaaacacaaaaaattagctggatatggtgatatgtgcctgtaatcccagctactcaggaggctgaggcaggggaatcacttgagcccaggaggcggagtttgcagtgagccaagattgcaccattgtactccagcctgggtgacagagaaagactctgtctcaaaaaaaaaaaaaaaaaaaaaaaaaaaagggatatcatgataccttatcaaaatcagcatcccttgccctactcttgatcttgttcttcatcactgctgtcatgatttcactgtatactaagagtgtatttgtttgttgtttgactcgtctcccaggcagtaagctatctcaagcgggggcattgttgggcttttttgttttatgcccaccatccagaagacttcctgcacatgaggcgtaactattagctccataaatactagctgactgaatagcaacgtcagtaaccaagggaattggtttttgatttgcgtggctttttattttgacagccttggaaacaacagtgagtctgcccagttctcacaagtgtctagcatggcgcctggagcagagtttgcacatataaatgtgttgggtaaattagtgaatgaccaaatgaatgaataaagtcactttagtgctttaatcaccagtacatcttcagctaccctttagacccattcattacacagagttactatggcaaaggaacctaaccttgtctaagggttccatgaaggcctccctgaggagggtacttcatcatcatcatcatacctaacaggttctgagcacttactatgagccatctactgctttatgaactctaactgatttaatcctcacaacaaatctatgaggttgataatataattagtcccattttacagatggggaaaataaggcacagagaagtagattcatttatctcaggataggtaactaataaatggtagtctgtttccagagcctgtgcacttcaccactcactatgctatactttttttttttttttaacgtagtcaactatttaattaagttcttaagacatttagaacaccaatttgtgaggataaattccattcgtcagggcaaccacagatcacaggtagccctggagctgaggaatagctttgatttttggtaaaatttgtgagtccacagctttctgctcaatcttgcactgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaataagccactagccagctgcttcaggaaaaccaccctcttgcccctgtggcgtccagtgaggatgatcagaatggtcccgggggtaatgctggctcgcagttttctcacgtgctgactgaagggtttttttttgctgtggctcaacagctttcgaggcacatcttcagtaggataatatctaggcattttgcgaagtttaaccacccgggtactgccgttcttgtcaccaccaactggttttgtaacagttgcaagaaccttctccttctttttcttttcaaccttggatttagcggctgagtacttcctcttgtacatggcctttctggaatacatagcagatcgggaatacctgccaattcctctgacaatgacagggttgcggctgcaatggggcttccccttcttgggctttttagccttgaggttaccctttttcaccttgccaccagcatcagccttcttggcttcaggtttcttctctttagtatctggcttctcaactttttcacccgccatcttgcaagatgggaaagagctcactatgctatacttctaagctgaggactgaggatggagtattagctggcttgatggaggattggaattaggcagaagttagcattctgggcaaatggaaccatgtgtgccaagggccagatcattgccagttccatgaaagacatgacaggtttagtgtaaccagggcacagactgggcatataagagggtaagagctgaacctggttattaagcaatggccagattgtataggcctggtaggctgtgctgagtttggacttaccttaggcaaagggaaacattaaatggttttaagcaaaaatgttaggtgtacagatttacttttttaagcagtcacattggtgaccctgtagaggatgagaggatgggctggaaagcaagcaggtggagggcagggagaccgttaggaaggtctcacaatagtccaagaaaggggtaatgatgacctggtctagggtattggtagaggcagtggagagatagtataggtttgaggtaaaatcaacaggccttgtgacttggggtgaagaagtgggaggtgtacagaaattgaggatgactcccagatctctggcttaggatggcaggtagaagatgttatttatagggaccaattagttgatcaattctcttctaggattttattctacagatagactagttactagtacagacacacaagcctttatacagaaagacattcattgtaggattgtttgtagtaggattagaaacaatgtggtgtagggccttgcacaactccaggatctgccattcacacagaatacaatgtggaggcctccctgaatttgcacaactgataaattaattcccgaattacaggatgtccaaaccatgggatataatacagcagttaaaaagtaggatgtgagtctttatggactggtaatggttgccaagataggttgttatgcaaaaaggtatcctatgatttgttttatgtaagtctattcatacacacacatatttacacttgtaaacacgtaacatagttctggaaagatacataaaattttgtaacagggctgcctctagggtagaggattaggagacgatagtaaaaaagcttttttgtcttgtctcatttttaaatttgtatgcattacctgttaaaataataatatgttaaaaatacatcatggagacttgataatgcagtgacaattaagtgattaaccaaataggaataaaggaagcgtgatactaatttataattacctttccattgaaacacttctgaaacaataaaaatttaagccataataataaatcccagggcaaaattaaatatgaaggtaataaatatggggctttgaaatagtgtatgggggatattaccaaaaatcccacctggcaaattattataaggactcaagactttttcggccgggcgcggtggctcacacctgtaatcccagcactttgggaggccgaggcgggcagatcacaaggtcaggagatcgagaccatcctggctaacacggtgaaacccggtctctactaaaaatacaaaaaaattagccaggcgcgatggcaggcgcctgtggtcccagccactcggggggctgaggcaggagaatggtgtgaacccgggaggtggagcttgcagtgagccgagatcgcaccactgcagtccagcctgggcgaaagagcgagactctgtctcaaaaaaaaaaaaaaaaaaaaaaaaagattttttcaagtgtgaaaaaccttaaagttgatgaattttagattgcacttctagttataatattagttgctcatgaagtatggggacctcagtgtctggcaggcaagtattacagctctagtgtaacttaaaggatctgctgtgttcaccagggcatgtgagaatcgtctgcaaaatgaatgcacactataagcaagaagaatacagtgaggcgggaccagaatattagatcaagtttgccattctagccttctttagattcttatcctgcacgtaatcatgctgttttgagaggggtcaggcttcaccagccctcacttatctgtgcagccatgaaaatgtttcaggaccaggttactgtctttttttattcagaacttccttggattttaggtgaatttagaattggaattagtttatagttgcagtggtaaaatttactattggcattacgtggatggcagaaaaccttaaaaaaaaaggcctgagtaacagaaatgacaaagtaaaggtaaattccagctagagagtacttatttctccttactcctgtcccatctgtagtaaaccagtaactcaaactattgaaagtataatacgtatatatctttgtgatttgcaagcacccaggtgattctgatagcaataaagtttgggcagcgtggtgctgaagagtgacactgccttcccaaccagcctcagatgaatcccgtcgagtacttcatttgtgaatcccttcttcaatatcattctgcttgggggcctatggaggagcaaaactctgctggaaaactctgatgattctgcctagaaaatgataggtttgtgttccagggggacgtggagatatattacttctaaattctctgatctgttgaccaaatgcggcaaggctaaccgagaaaatcatctggttttaaaagatattcctaaaaaagttgagacagttgcaactaattcttggctgctgcaaagattcctgctgtggaggggacttgaagcagaacatgcccctcactgccctttgtggctgtaattccatcaagggattctggcagcatacacctcagacacagagaatgtttgacttcagagactcctaggtagactgtgaaacattttaggacacgttcgacatgaactccagctttataccctgtttacatttcagagtcatctattaaaggtgggtatgagataatcagtggatacagaaaatctagttctccaagacattaaaatattatgtgccaagacctagatccttctgctgaccaaaatatcgatggcgtgaaagaccgtgccccttgtatattttacacagaagtccatcatactgaaaagtttgttccttttttgcagtgatcacattggccacaagtcccccaacaggaagagttttgctaatggcaggcagcctttaatcttacatcacatagtctgattctgcccttaaggagtcacctgggccttggagaggaggccgtcttctcctttgttgcccaggactgagagacctgctagtgtatcctggcaactgttgtgctcacctcaaggatgacaagtccctcagaactgtgacttttcttatgttgtccacatttcagaggcttctttttcacatgtgccagcaaatgactgcccacagcaagtctcttgttcttttgaggcagtgccactgagcctggagctgtgtgtctggagccttgcgtatccaaggagaaagcgcttgagtggccctgagtcagaaaaagcctttggcgttgcctctcccttttttgtaatagtgcctctttctccctggctgcggttcccttctcagcctcccctgtttggcatgcccattacacccctggcagggtgggcatctctcctctaaggggccacctttgggttcaaatcccagccccattgttatttacttacaatttgggacaagttacataacctccctgggtgtcattctcctcatccgtaaagctggtccaataacaataacaaccacaacaataatattactgcctagggtttgcttttaagaaacctcccacatgctgtccgacaaagtggatgccccgttgctcactgctgttgttctcaggaggctcacaagccatccagcccacccggctggtttttgttttaatcctcttgagatgctgtgagtgggcagcaccatttgggtgagtcatcactcctcattctaggtgggacggcactctaagcacattctgagaaagcaacctccgagcagtactcctcttgtcctggtagaagagaataggtctcatgatagctccttccgctgggtgggttgtgtaatttgcaacaaggattctaaaaggaagtttaaatcaatcagaggctgtgtatgtggaaacagtgcgattcatgtgctgagatgtttttctacccaggaatagccattaggcactggctttttacgtaagaagcctttgtgagaaggtaaagcatgctcttgttccaaccccttgttagaacttaatctttttcttctccatgcctcacttccccgcccccacataatattcctcttttcattaatttttatggcaattcaacttaatatttccaaatatgcaaatattagaaataaaaatcaacataaaaatatttctatatgagtatgtacacacacacataaaaatatatagtgtaggcattactgagtgctacctgctttcagttgtaaacggacagacagacatatgtttatgccctgcaagaagctccatagcatcttctaaaatgttaatatcacttacaatgtgcttacttactcttagattttatttcttttttcattttcctgagaactgttccttgtagccaaaatgccaattactcactttaaatagagttctaatttcttgtaagtcacaaagaaaaaaaatatgcaatttttcctcttccttttccttcttgagagccaaaaaaggcgtgtctgtgccatttcttctcacgactaaataatgggccctcccacatcccaccagctctgaaccagtacactgaagaaagccactcttttgacattttcctgtgtacagggcaacatttctttatgcagttttattcacattaaccagtactattggccaccttctatgtgctggtcacttcgtggcccaaagtaagacagagtctctgtcttctgtaatccaatcagaagggtcagaaaagcaagtttaccatatagtacaagtagaataggatgagttccataagaaaagataaaagcccatctggaaggagagagtaaggttactggtgagtaaaaggatgttgatatcaagttctgtaagagtcaggtaggaatggagtaaaaaacatgggtggaaaaattttcttaggccagaaggtagagctggttgttatttgtttttcacagaaggagaggcaaaggaataggctagctatcgtactgtgaaatgtttaaataggagcagagagaggtaaaggaggtgcctaccttgatcttggggaattcggacagaaggtattttgcacagaaggtgggagtggagatgaaatttgggacttgaggagagaacctttcttggtcagtgatgacatgtttgctcttggtttatctttcagtctttcaacacaccctgcatgtgttcagcagtctacattattgtttacttttaaagatcgttgagagaatagtgatttcatttttcattacctccctgctgagttttccttcactggcatctctggctttatgtttgagttaacctattctggatccggctgtcttctggtcactggtataaagtagaagtgagtggcaggttgttacagcaatagaatttgatagcagttggagatacctgtgggaattggtcatgagctcgaatagttagcaagctctttcttaggaaatttttacagtcatttaaaggcctttcttgcagtttttattctgacaatgagtcttttcatgaacgttcagattgtctgaagatgtcgcaaaattacaataagacagttgtaagaatgttccgtgattcccagagaactataacattgaatttcctattaaagtcgtgaataagaaagattttgcagagaccagattgtgaatgcaatctcttacacaaaagcattgggtgattcccttttgtctgtgacctccttcctaggtcattcagagcttcaaactcttgctctcagccatccaccttcatgccttgtttctttccttcctactccttacattctggccctagtgggtgactttttgtaaccagcacaaggcattcaccgtcacagccctggggcttcgctctgctttcccctcttgacagcacactttgaacctgattgtttatctggtaaagttcttctcaggctgagctcctcctctgtgaagacttccctacttctctcttccaagcagaattcactccctttctgagacaataccactaatataataggtttgggcttctatcaaggttgtctggttagtcatcagggagcacagagtatttctgagttatacatgcttttccctgttgctttgcacaccctttgttcatttgcatgctacagggcactgctgtgtgtgctcatacttgcttattcttttaggcatatgccatagtattgccctaagtgaagctgggactttaatagtgattctacaagactccatttaatacccaattggtggtctggatgaggctaaaaggaacaacgtttctggactttaagagactttcaaaataggaggggagagggcagtgggtctcataactttccaccctgctccaccatcagactgacacattgttttggccagcatttctcaatctgggtttgccaggaacctagattttcacaatacaaatgtctaggcttcagagcttctaattttgtaggtctggggatgataattaaggtatttcccaagcttggctggtgacttatacagtggactgagaagagttgatctcactgtggctttagccctggctgcacatttgaatcaccgagggaggttttccaaatattgaagcctagtttctacccgtaccatttagatcagattctcaaaaaccagaccactggtcttaggcttctctctgcttttcaccaaaaagcaagatgtagaaaagagcagtaaacagagaggggtgattatattatgggaaaccacagagaagattcagtgtagtcctttttatggcggttatttttgtttctgttttctgattaggaaggagggatggaggataacaatatgaatgcctagaagctaaggacaaagccatttcaggtggaaggattcatacttacgaaggcatagaaatgagcgattacttttcctggtggaaagaccacatatgtggattcatgagggacacccttgcatgaaggacgacagggaggtggtgagtagggaaacccaacatctaggttgaagataatggatttcatgttggagagaataggtagttactttgtttctaagcaaggagtaattttagagataatattgagtttcagtaagatgtcttattgctatggttagggtgaactgaaataaatggtaacacagcagggttttgttcagggccaacttgtgtgataggtgtgacaaggtggctgctttctgttctgcatgtccaatttgataaaccaagatctaccatgggatttgggcaatccatagcttcctgccctctctctactcctgcttctcttgcccttctccacttccatatctctttctctgctaaatatgccattgtcctctatttagggtaaacatctaaaaataggtataaagaaatagaagaaaaataaaaaagtagcaatgatgggcactcacattataaaagatgtaaattgttttagggaagacagaattgtttaaagtatgtatttaaaagcagatatgtgttagatgtttttaaacattttttttaaccttgaaaggaaaagaaaataatgttaaaattttagatctataaaggatatgaatttatgcccaatattgttttaattcaattaggataattattttaaaactggaaaaaggaatcaatattgataatagcaaataatccaaaatcagaaagaatctattaaaaaaactactttctttgaagagtgaagttttctacattcaaataaattataccacagatagtaagagatcctataaatttggtcataggactatgggtcaataatgtctgagaaatagtagaaatgggagagtttctgaaaaattggtggtaagaaaatatccccattcaaaattgggcaagtggccaggcacagtggctcatgccttataatctcagtgctttgggaggctgaggtgggaggataagttgaggccaggagtttgagaccaacctgggcaacatagtgagatcccatatctacaaataaatagataagtcagagatggtgatgtatgcctgtagtcctagctacttgaggcaccgaggtgggagcattgcttgagcctaggaatttgaggctgcagtgagctatgattgcaccactgcactccagcttgagtgacaaaaagagaccctgtctctaaaataaaaattaaaaaaaattgggtaggttaacttacagcttaataagttaatggcaacctctacaaaattatcctaacagtaattaaacagatgttttatgtagaattagaaaagaaaatagtggtcataaagagctagcatgagttccttaaaaataaatgtgtattatgtgtctcatttcatttattggatggggttattatagtgatagctttggaaaattccatagacaacttgtgtctaaatttcagcaatgtatctgataatattttgtgatttccctgtggttaaggtagaaacatatagataggctaaaattaggccaaatcacaaatgttacatcccaccctactccaccctatgtgaatattataaattaattccaagctggagccaggtatctatttgagcaggggtcctgcagttggttctgtgctggttgctatgtttatcaatgacaggtgaatcatacatgaatgcttatcaacttatcaacttgctcttattctcctctgggaaagacagctgagacacatggtgatagaaatcagatttagatatccatagactggaacgatggtcccatatcaactaatataaagattataagtttagaaactgtggcaattagcctttcaccacttgtgctctagggtgttttgtctagatctttgttacttagaaattccaagctgaagctggctgaccatttttcaggattcttcgcagaacaagttgctaagtggcgaggaagcttgaatttgattatttgctaaccctgaaagtctattattctttggaattacttggagaaactgttttatgaaacatatcatcatctcaattgtctatcatacagctaactcacctatctcatccatcaaacttagtttcaaataacttgttgctgttggaataaaatgaaatctatcctcaaaatatgacgactattaacattcagaatcttccaaagagtgcctgcaggttcaggaggcatttccaaaagaggaatcttcaatgctttaaacaagatactggaatctcagttaaataccatttgctattgggagagatgtagtgtgtattttctagggtgacagctttggacagcagcaatttgactgtgtaaaggcttacatatctttctattcctaattttataatgcttaaaatatttttattattgcacattcttgagatcattactagaatttgttgttaatatggcacactttcaattttgattagaacacaaaacatgaaatgttctaaatgtataattagaataaatctgatgcttggttaaaatatttttattgagaagagaatatatagtaggataccacaaaatatttggaaattataaagggtaataacccaacaaatatctgagtattccctacccattttaataacaaagggtaccatcgtaataacctctgaagtctgttgcttattttccttaatctattcctgagcatccccaataagcttaaatttttcacttattgttcccttgctttttattaacatttaaccaaatatttgtatctttactaatgatagcagcataaaactttcatatagtgatttctatgtgccaagcacttaaatgccatacattcatttaactcaaaagcaatcctcagaagcaggtatccccagccaggcatggtggctcacgcctgtaatccccagcactttgggaggcagaggtgggcggatcacgagatcaagagattgagaccatcctggccaacgtggtgaaaccccgtctctactaaaaatacaaaaactagctgggtgtgttggtgggcgcctgtaatcccagctactcgggaggctgaggcaggagaatcgcttaaacccaggaggcgtaggttgcagtgagccgagattgcaccactgcactccagccaggtgacagagcgagactccgtcttaaaaaaaaaaaaaaaaaaaaaaaaaaaggttggtatccccattttacggatgaggaaatcaagatatatagagattaacccgaattccagttcaggcagtctgactgcaaattctgtgctcttcccctctgttccatgccccctgtcaagaatacatagtatagctctatttgcatttaaaatgttatgtaaatgaaatactactgtgtgcaatctgcaattaacacttttagtcaccactgtgttcttgagtttcatatgttttgttctatgcaactgtagttcatttattttcatttgtaaagagtattatttcattgtatgactatattgcaatgtatttatctgttctgctttcatctgacatttgagttgcctttatatttttctgtaataaatagtgctgatatgatattttaactatcatcttgtgtgtatataccagagattatctagggtgcatatcctggagtataattcctgtgtttatgtgcaccttcaatattcctatagaacagcaagctgttttccatagtgatgaaccatgttgtcctccttgtgacagtatgtaagctctatatcttgccaagaggtaatattgtcacactttaaaatttttgtcagtctgtttagtttaaagtggtagaggaatgatgaggaggaaagaagaaaagggggaggaggaggacggggatgaatttccagttatctgatggatctgaacatgtttttctttttttactattaatatttggtttctccttttgtaaactacctgttcaaatctttggttcactttgtgggggaggatgtttatctttttcttattagtatctattagttgtagaaaacatcttttattttgtggctaatctttttaccttcttcatggtgtttttgatgaacagaattatttaattcaattgaatttataaatattttccttctaggatttctagatttttgtgtgtgtgtgttctatttattaaatacttctgttcactttgattttaaaaagatactttcctgtattatcttctaaaacttacatagttttgtatttcacatttccatttttaatctacctgggatcaaatgtatatatgcttcgaggtataaatacaattttatttaatttttctataaggataagcaattattgtgggaacatttgttgtaaagtgtatcttttctcattattctgtaatgccagttctgtcataaatcaagtttctatgtattttttggtctgtttctgactgtctttgtttcattggtcagtttgtttatttctgtcttaataccacactgtattaattgttaatggattataacaggtcttgatatctgctaatgccttccctacttccaaatctttttcgtagggagtcttaactccttttgttctttgttcttccttataaattttagaattagcttgtcaagttccctcaaaagcctgtgggacttttgattgaaattgtatggatccataaatcattcagggagaattgacatcttcaaaatattgagtcttccatggtatgaacacagctttccttttgtttgggttttaatgactttctaatatgtctttaaatattgtctgtacccaattctctcttcaattctctctgttctttttttgaatctctaataaacatgttagatttaccttttttctcttctctatgtctcttaatgctttaataatttatttagatctacattttaatttactattttttctgtttctgtctgctattataacccatttattaattttaatcatgattgtccttattaaaatttatttttgttctttttaaagtatttattcatttgtttatggtctcttctttagtcttagttttaaccccatcttttattttttagcattaatcataattattttatattctatttatgataatttcagttttctggagtttttgctggcttatactcattgattctttttcattctcctgtgtttgtgatttttgatgaggatttcatgtgtcttggtacttttctggaattctttgagacttgggtcttcagagaggatttgatttgcttcttggacatgcagggaaatttatgaagccataagtactttatactaagtatttggattgcagtctgttggataacctagagaacgaaggcatgtaagggctagtgtgtggtcagatatgttggaaagatgtttttccttccatcacttagtgccagtattcaagacgaacatttttcttgtagtctttaagatgagtggaatctttcagatttagtctttcatttttgctgacatcactttagacaatatgccagaagtgtttacatataaatgtatgtatactgttgactgtatgctgactgtatcctctctcctctccctacacacgaaactctgtgactcccagtacccagtggcccataagagcaagaggccctgaaatttaagcttccttagtttcataataaatccatctctgcttaagagtagatgttcattattttatcatatcaagtacactgaagctttaaaaacaaatatttttattatataaagtagtttatagtctcatatttcctgtaaaatgtagtcttctcttttacagttgaggaaaagaagggttggagcagcgaagtgacctgcccagagtcataaagttaatgcgttgaatctggttttctgtccagtccactttccactttacaatgccagtagttctctatttagttataatagatgcctttttcaaaacctttactgtgttttaggaaaaaggtacctttaatatgcttactgaattgcatcttcatggcttctactcgaggtcacttcaaatcctgtttctgtcacctcctcttagtagcctttccctatcaacatcattcccattttctaccacttattcccatcattccattcatagcagatctatatctattagcaataattcatgcatttgcttacttatgtattgtctggtttttcccctgagatcataagctaagcaagaagagggaccatgtgtattttgtttacttccatacaaacagcaattactttgagcctagaacatagtagaagctgaataaaaatattgaatgtctaaaagtctgattctaaaacccatttctttttgctaaatatatttattgaatcggatgtttcctgttatcttagaattacaaccaagttccaaagctgaactaagtatcctacattctaagttttgagagctgccagtggttaaggccagacatctactgggaggactgagatcagaaaattattcctccaaagctgtcacttccactcctgtaaattaatataaagcgagaatgggagagaagatattgcttttttggagtacaatgttaataaagcaagtttaattgcttcctttactctaaatctgccactaagagtagggcgagaggctcaaagagaatattaatccaagttatggttgtctcaaagaagacactacaggtattttaatctccattagaacatatgcttagccaggcttggcgacctggctatctggcagaagagaagaatctgtaaagagacatcttagtggggtactgccaggcaggaataggccacaagttggggtttacttcaagttctggttcgcagaaagtttggaagactgatgccatatctgctgtcaggctcagataattgaaaccttagggataggggtctagtcttgttagtatcctcacaatttggggagatttggaggcaaaaaacaaaacaaaacaaaataattccctgtgtattagaagaatggatcatgacgctaccatcctggtattaactggaagatctaacaagatcttggtcaggatggttgtattagtctgttctcactttgctataaaaaaatacctgagactgggtaatttataaagaaaagaggctcaattgattcatggttctgcaggctgtacaggaagtaaagtggcttctgcttctgaggaggcctcaggaaacttataatcatagcagaaggtgaaggggaaacaggcacatcttatatgaccagagcaggaggaagaaaaagagggtggagaggtgctatgcacttttaaacaaccagttctcacaagaactcactgtcatgatgacagctccaagagggatagtattaacccatgagaaaccacccctgtgatccagtcacctcccaccaggccccacctccaacattgggaattacagttgaacatgagatttggatatgaacacagatccagacatatcaatggtcagtgctgggagagctgtgtgggtcaatggagcgcactaaagctaccatcagtccaagacaataagctcaatgtgccctgatggcttgccaaggccagcgatgctaccaacgttatccaatcagttgaggacactgccttttccttctccttccttcttccaaaatgctagaggaatccgcataggtgaatagaggtacttacgataagcagaccaccccactccctaattcaaagccatttgtaccacaggtctaagggaggagtggtggcatttagaattagaaatgaaaaatgaaatgaacaagatcaaaatgaacaagattgaccagcggaaatcaaatgagactgttaggggagactgttaggaaggatagatttaacatgtcacgactggggaaatagctgttggaaaataaagctctttctcattcataatcagtgaagttgagagtccacattaaactattgaaatagttccctctggaaggtcaataacctaggactggttcttaggagagaattatttaaaataagggtgtttcggcggggtgtggtggctcacgcctgtaatcccagcactatgggaggccgaggtgggtggatcacgaggtcaggagatcgagaccattctggctaacatggtgaaaccccgtctctactaaaaatacaaaaaagtagccaggtatggtggcatgcgcctgtagtcccagctcctcaggaggctgaggcagaagaatcgcttgaacccgggaggcggaggttgcagtgatccaaaattgcaccattgcactccagcctaggctacacagcgagactgtgtctcaaaaaaaaaaataaaaataaaaataaaaaataaaaaatagataaataaaatgaaataaaatgaaataaaataaaatgaaataaaataaaataaaataaaataaaataaaataaggatgttttggtacttcagtataccacccagtctttgatttcctcttcaaggtaaacactgtggtataagacctaacattttgttttaactggaactaaaggccaaacttcatattttcccttggtggtctgcatatttcatctgtgtagctattttaatgtacctagagaacaaggaaaaggaaatacatcaaaagttacagaaaagaggagaccccagtggtttgtatctttgggtaaaaaggccctgtaagggggcattgataaattgtggtataaacaaaccttgatcctggcaatatagtagccaggatctttaaaaaagataaatatttaaatatttatctttaaattatcctttaaattatctttaaaaaagataaatatttctgaatatttgctaatctgggtggtgattccactattaaaattagcatagacctgagttttaatagactagcatgcttggtgcctagtaggaatgcaataaaaattagcttaaaaagatgagtttccaaatgattgttttgtgggctcataaataaagatgcttttaagtgttttattgttttcctcctgaccctctctcagggttatatctttactgcatgttccatatttaatttcatgatcacattgaatatcagagaaataagaaacaagttatgttcatggatactgacctccattgtttaataataatagctatcatttcaataaatatttattatttgtctattaatttacatgcctttttcttttttgtaatttttattaaggtatgtttaaatgcaagttatgagttttgcaaatgtgtacagttgtataatctatatatttattaagatatcaaacatttgcatcactccagagagttaacttgtgtgccttcccaatcagccatctcccctccactcagcaaccactgttctgatttctactgcaataggttagtttttcctgttctataactttatgtataatacatatacaatatgttctttctgtgtcccattttttttcactcagaataacgtttctgagattcattcatgttgttggaagtatctgtagttcattcttttttattcctgagtagtatttcactttataaatataccatagtttctttaatccattctcctattgctggacagttgaattgttttctttttctttactaatatgaataaagctgctatgaatatttatatataattttttatatctaggagtgaaatttctgggtcatattgcatatttatgtttaagtgcattaaaaactgtctaatagttgtcaaagtgatttactattttattcttccagcaacaatatatgagagttcttgttgttccacattcttgccaacatttagtgttctctatctttttattttagtgaaatgaaatcacatttcattttggatttactttacattacccagatagctaaagtattgagcatttttttctgggcttattgggcatatttatctttcttttgtgaagcatccacatagaatttctttcttcatttttgattgatagtcatgctggatataaaattcttggttgacagttactgtttttatttcctttcagcacatataacatatcgtctcactgccttctttctggtctccatattttctgaagaaaccatccattagtatgaaggatgccttgcatgtgatgatttattttcctctagctgctttcaagatactctctttatcttttacttttgacattttgactatgatgtttctagatgtgaaggtctttgagtttatcttagagtttattgagcctgttgaatgtatagattaatatttttcttccccctcaagattgggaattttctgtcatttctttaaatattctttttgcccccttttctcttcctttttcttctggaatatctattatgaatatgctggtatgcttgacggtctgccacaggtctctgaagatctgtttttttcttcatccccttttttttcctgtctctctaattgaacaattacaattcacctatcttcaagctcactgattccttcaactatcagcttcaatctgctgtccagcacctgtagtgaatttttacttcagttttgatatttttaacttcagaatttctatttggctccttttcaatattgtctgtctctttattgatattctctatttgataagacattgctctcatagtatcctttagctccttagacatggtttattttaattatttaaatatttttaatataggtgctgttatttatttatttccccaggctggagtgcagtggcacaatcttggctcactgcaacctccgcctgctgggttcaagtgattctcctgcctcagcctcctgagtagctggaactgcaggtatgtgctgccacactcagctaatttttgtacttttagtagagacggggtttcaacatgttggccaggctggtcacaaactcctgacctcaaatgatctgcctgccttagcctcccaaagtgctggggttacaggtgtgagcgactgtgcctggcctgcaatttttaaaaaatgtctgatcttctccaaaaaaatttttattgacttgctcatttcctgtgtatgcgtgatactttcttgtttctttgcatatctcataaaattttatttaaaacaggaccttttaaataatacaatgtgacaactctggaaatcagatcttctctcacttctctccagtgtttgtttatgttgctgattgtagtattgtcattgctgcttgtttgttgactaattctgtaaagtctattttctatgttgtgtatgactactgaagtctctggttagcttagtggccatctaatgatctaattattggacagatactttcttaaatacctgagtacagtaagtgtccccaattttttcaagtggctctgtatgaattgtggggcatgtcttcaacactcaggaatgtgtaagatggtttacaactttgcattggccatcacttcctgtttgtgtaatgcctcccttttagccagaagtgggacattagggccttctcagatttttcctgagcatgtgtacagtcttatacatggtttggatttgtgtccccacccaaatctcatgtcacattggaggaggggcctggtggaaggtgattggatcacgtgggtggatttcctctttgctgttctcgtgatagtgagtgagttctcatgagatctgatggtttaaaagtgtatggcacttcccccttctccctctctctcctgctgctatgtgaagaaagtgcttgttttcccttccgccgtgatcgtaagtttccggagaccttccagtcatgcttcctgttaaacctgcagaactgtgagtcaattaaacctcttttttttcataaattacccactctcaggtagttctttatagcagtgtgagaacagtcttccacctgtgcatggtcttctaaatttttaggaatacgttgaagctttctgaaacaacatatgtgtacagcttaattccagtttttccttttaagatttttgcttagtttcttatttgccccagttgttatcatcatcttaggccactatggtgttaaaaattcataactgattgttttcaacaaatgccgctggtgaaagtgctgagtggagtctgagccaggttgaagaaaaacaagccatggaatgggggttttcagagaatgtcagacatggcacattacgacagttgtctgagcatagttttttgggaagctccaaatgtattttgccctttccagtggctgctaggctgctggtttttactgggatcaaggagctgttggttttcagtgctactatggagctgagagataaggatggggatagggcaacttaaaatgccacaaaaatcactgttcttattgaggtttagttatttttcgtgaccaaatgcttctcagattgttgcaggatttcttgaaaaataatctcaagagttctgaggaaaatgattttgcccattattgccgttgtttttactgcttttgtggaggagcagctttccaggggtatggctctgctattcctgctagaagcacagaaataggaaggaggtgctgagtaagtagaagtattgcttgacatgtcttttacttcttttgataagtagatgttaattttgatgtagttgaattcatgaatttcttcttttatggttagaagtttctgcatcctatcttgaaaaaaatcattgccaactccaaggtcattcagttttttaaaatgctttcttttagaagctttatagttttaacttttaggtttctatctgtgatccttcttgatgtattatctgtataatgtgagatagggtcaatattattttttcccatgtgaataacctttttttcctagcatcttgtcttgaaaagaccttctctccattggattgtttcaatacctctgttgaagctgtacatgtgggggttatatttgaatctctgttcttttcaattgatcaaatgtcaattctttctttaatagcacatgttctggatttctatagctttataatacgtctagaaattgggtagtgaaagtcttccctccaactttttcttttttatcgaggttatttggctattttatgttttttttattgctatatacattttttaaatcacctggatttggatagagattgtgttgattttaagtatcagtttgggaagttttgatatcttaatgttagtagtactgatctttcaatacacaaatatggtatgtttatttacatctttaatttttatcagtgatgttttatagttttcagtgtaaggtcttacaaatattttattgtatctgtcctttaataatgcatgttttttagtgctattgttaacagtatttttaaatttttattttttaatttgtggttgcatatatacagaaatacagttgacttttgtatatagtgtctgtacactatgactccaaacttactcattctgtagaatgagttgatttttgcagattagttggaatttcaagtaatcatgacatttgcaaatgaagataattttactttttccttcccaatatgtatgcctttattattattattaactttattttccctctctttttacactggctagaacttccattacaatgttgaataaaagtggtgagggcagactcccagatttgtttgaatgttagggagatgatactcagttctgtaccattatgtatgatgttacttatagatttttcatatgtattctttatcagactgaggactttttttttcctcatcaattttttttttctgcaagtaggcctgcaggatacatgtgaagtattagagtctagttaatgatgagttagttgctagtgaggtaggggaaattaaaagaacaagtatatctgcaggccgaactggataggatgaacaaaggccatatgataggaatatagacaagctgggctggatgaagaaacctgacttctctttgtggctctgccaccaacttcctattaaaccttaaagaaggcactttattttatttatttatttatttatttatttatttgagacggagcttcgctcttgtcgcccaggctggagtgcagtggcgccatctcagctcactccaacttctgcctcccaggttcaagcaattctcctgcctcagcctcccaagtagctgggattataggctcccgccaccatgcctggctagtttttgtatttttagtagagaagaggtttcaccatgttggccaggctggtctcaaactcctgaactcaggtgatccacctgccttggcctcccaaagtgctgggattacaggcataagccactgcgctctgccatggcactttattttttacctagcactaaaagatatagctgagagccaggttggtatcagaaagaatttggtagagttgcaaaagtgattttaaaatttgaaaaataagaaatgtgagaagagattgataaggctagacttcctttatctgctatgaaaaaggctgagatttaaattttttgatactactttcagttcactgcaccaagacaaccattcatctgtctctgggtaccttcacatcccttttctccaaaaccacacgcccttggtttctttagctatattgcaggtcttgagatcaggtaatgctgtgttccccagctctacttttaagtaattattttgctaaagtatcttcacctgaatcatctgggatgacttctgtttccttccaggaccttcacctcactgatacaactggcactgatacaccctggcagtgtgtctcctcaacacataggtgtgctctggggtctttgtaggcttaaccattgtgcctaggcctgacatcgaagtaggtagttaggtctttgcctgtcaccacagacatcccattatatctatggcactctgaattacagcttaggaaaataattttaactactttgaatgtcatttgactccattccttagggtcatgcaggattttttcatttttatgagtcccttctgagaacacagatagccttatgagggacagttgccttcagttgacagccttgtgtgggggttgtctagtcagcgataccatcagttttgcaagactgtggttgtgacagtataggcgtccaggtgaaattgaagggggaagggaccaagtgtgctagcatcgaaatggggagtgggatgctaatgatacacttttcttgttgtcagttttactgggaacagccctgtggaaatttaaatcctttcccctaaaatttctttgaagtcccaaaaggcttatgttcttaaggttatttctgttcccaggctaatgcttttcctaaatttgttcaattctggattatctttttatctcagtaggcaaaatctattctgtattcattgacctggatataaaattcagccccttctccaatttccatattcattagacctcactgcctttaaggcaaaaagtagacttccctgaaggtacaagtccaggtgggaaatatggaggagacaaaggaggcatttccatgacagtgtgcaacaacttccaattgagcattagactgtgttcttaacatgctctttatttaccccataccagggcatttgcctgtatgtttatgccccctctcaatcctaaaatcctaacccccaaggtgatggtatcaggaagtggggccttttgagaggtgaataggtcatgagggtggagtctgcatgagtgggattagtgtccctttaaaagagacctaagcaagcacatttgcctcttcctccatgtgaagatccagtgaaatgacaccttctatgaccaggaagtagaccctcaccggacattgaatctgctggcaccttgatcttgggttctccaacctccagaactgtgagaaataaatgtctgttgttcataagcctcccagtttatggtgctttgttagagcagcccaaacagactaagatagcatttcatggacagcatttagtccattgcatgccctggtattataccatcttgtggatccttcccttcctttctattgtgtggcccttctctctcccttcctttcagagcgaatacagagtgagagagcctttggagccagacatctgggctccagtcttggttttatcactgattcactgtatggcttacctaaattacttaaactttctaatatcaatcgtcccattcataaaatgggcatagcaaaacgatccatttcataaacttgctatgcatatttgaggtgtgctgtggtttgctgcccacagggcttctcagaaccaaggtactcatttcaccgctgctgggagtgttggctgctgctggtccacatctgagccccttccgaggtattgtctctgacacaagaagatctctgccatggttatactctccccaggggctgcctgtactcaaagactggttgatgtaaagtttgagagtcttgttcttttaccttaaattggggcaatccagctccagaacttcttgtgaggccaactgaggcttccgttacaactatctcatagtccagcttctcactctgctaatcctgcctcctttaatccctgacaagcattcttcagtaaacctcttgaaaacttctgtctgagagtctgtttccaatcagaaagaaagtgggtaaaagaatttccaatgcatactgggtacccaagaaattattattattgctttgaaggtaagataatttatttcaaggtattttccaggatatggatctatctatatatctatctatctggagatatatatatatatatatttggagttatatctatatctatatctatatatatctggagttatatatatctctctatatagatatctgtctggagatatatatagatatctatatatatctgtatctatctatctgtctgtttatctatctatagctatctatctggagatctggagagatatctatatatatatagctatctccagatagatagatagatagctatatatacatatagatatagatatataaagctacataaggaattctaattaatagtttgaaccatgagtagtgagaataaaattattctaaattttgacaagggaaattgttattgttttattttttaagatgttattttactggagcatattctaattagtctcctccaataaaagcagaatctttttatttagtaattgactctcatctgatactcttgggtactataattttgttgtttctgtatatttgagtattatcaataatccaaaactgatagaggtgctgatagtttatatttctggaaggctagaagataacctgtgaaaagctgatgttttatgattttatagaccgaaagagaagttaatgccacagaggttaagatcttattcactgatagagtgtaaactactcttatatctaatttagcagtctttttaggcatttctttcccgacttttatcaatctcaatttcttatttatactttgactttgcatttgtcttctctacttgttactttactagtgagttaaataaaacttggtcagatgctcactactatgtataagagaatgatgtttttcatgggaatgtgtttctgtttaagtattattagtttataaagggtagcattattatgggaaggcatccaaggtttcatgggggcaactggaaaagagaagtcagcattttgaagttagccaaaccctatcatgctaaattcaaactttgggtgtggttttgaagtatgtgtatttgctagggttgccataacaaagtaccacacattgagtggtttaaacaaccaaaatgtattgtctcacagttctggaggctgaaagtctatgatcaaaatgtcggcagggttggttctctctgagggctgtgagggagaatctctcccctagctgctggtggttgctggcaatcttcagtgttccttggctcatagaaccatcacccagatctctgccttcatcttcacatggctttctccctatgtgtgtgtctgggtccaaatctcccctttttataaagacacagtcatattaggttaggggcctgtcctaatgacctcagcttaacttgatgacctctgtaaagaccctatcttaaaatacggttaccttctgaggtactaggaattgggacttcaacatgggaactttggggtgacacagttcagcccataacagcatgattattttttctccattctcaaggattactttttccctcaagtgataccataaggagaagaatgtcattaactctggagagaatctcagtgaagtcatcttaccatgttttaaaatgaggtttgttgccacatcccacgccaagcccgtaccagtgttgccttatggatgtggttaggaaagttacacttgggaattaaatcctgtctgagaaatgagttcacaagttctcaggggcatttagctgccaggccatttttacacattaagcaaaaaaaaaaaaaaaaaaaaaaaaaaaaaaaagtcttttgggcattgcatttatttacatgaatataataaatacttccaatggcatttggattgcacatttgcatgtgtttaatatgatggtaaatctgtctgaggaaagtgtgcggtgctttctgattttgtattaggaagatgggttaggcagggaagaagaatgattcctttggcaaccgtggaattatttactgactagaagaggaaatcttctgtttgaataacccctttgaactgcctgacacgtggtggaagtttgtcaaatgtttgttgaatgaacagaagtgtccagggaacttagactgttttgagagcaatcaaaaagcacatatttattcagagatttaccatgtacctagctttggctggtgctgtgggggcccgctgatgtgtgtacgaacaataatagcagcaactatcgattgtgcttactctgtgccaagcatcctgcccaatttttttccactattctctgagttaggcgctatttttattttacgtataaggaaactgaggctaaaagacatcaagctatctgactacataaccattaattggtaaggtaaggtgtgtgcttaacttctgcactccagtgcctagtaaacatgtcctcttgctggtagaagtttgcattcttgttctagagacaggaaatttataattaaggcaattagagaagtagtatagaaaaggtgaattttatagtacgtctggtttgctatgtatatgtgtactgtcagcattttataaaagtgtcaggttgtgaaatggttaagtatataccttctggagttagatgcctccattcaaatcttactcggacctcttcttacctgtgtgttgttagacatggagcttacgtgttctccataagctccatggagaacatctattataaaaaaatgggaaatttattatgaaatagggatcataccttattattgtgagggatacgtaaaatatgtaaaaagattcagtgcctggcaaaatgtattttctgttcaaatgtaagcttctcaaaggcagcagtgattggggtctgttttatttgttcttgtaacctacacatttagaacagtgcttggcataaaatagacattcggtaaatacattgttgaatggatatatttcaatatgtaaaggcctgggcttagtcacattacagacaatgaagtagtcagatgtttgcacatctgtgtggaacagtggttcctagccaggatacacattagaaatacctggagggctttgaatggactcattcttaaaccccatggtaggcaaaggttgagtaccaatgttggagaatcactgtgaaggtaacaaacgtagaataatagttgtatattatgttgaagattcaataccaaaagtgattttttgagtgactcaatgggatgagtttcttaggaaacaaaacacaacctttggttcaatagtaattacatctttcaacatttcaatgtacattaaaataatcaaaaagtactttgagttcatatataatatgaagtaggatttaggctcaaataattacgcacagtttgttccctgacataaatcagaggtgaagtttgtgcggggcttgggacaatttttttattgcgtggactatcctttacattgtaggcagcttgtctaagtcagccaaaaagcactgtgagctgctttgaagacaagcaaagttagtgcccatatggtataagaaaaaagacaacaacacactaggtgattaagaactctcttggggaatcaaaccaagacactgagtaacttcttagacagctggttccttttctagaacaacaggatgagttcaccagtctctaatgtgtcaatctttaggaggtgttctgggtaagagacttcctgattctctggtgcttttctgctctgcaagaagaatcctgattctgttctcacgtgcagcatcacccagagagggagctggcaagatgaggatagatagaaaacgggagccacataaacctacaatcagactgaaactggaaccagaggaaattgagagaaatttgcaaagtgggtaattagaaaagggtatctctggcttatttgcatgttttccataaattttttttttttttttttgagacggagtctcgctgtcgcccaggctggagtgcagtggcacgatctccgctcactgcaggctccgccccctggggttcatgccattctctttcctcagcctcctaagtagctgggactacaggcgcccgccacctcgcccggctaattttttgtatttttagtagagatggggtttcaccgtgttagccaggatggtctcaatctcctgaccttgtgatctgcccgcctcggcctcccaaagtgctgggattacaggcgtgagccaccgtgcccggccttccataaatttttaaatttctatttatgaagagtatatgccacatgtttcattaaacacattgtaaaaatattaacactatcatatgccctttacgaatgtggcaaagggattccattttaatgttgaccacacaaagccgttttgatgtttcttaggcttcttaacactggattctaccttatttgcatttatttttaaagagctgctatgaaggatttctgactctctcaggcaagaatatcactgaaatgtaaggcatgggatataattcaaatcatcctaatcagatttctcaacccttgatctaatcagcaagctgtttttcttagcttcttggtcaagttcattcattaactcagaaagcatttcttgaatatagactgtgtctaccccagggctggaatgtaattaagattagtagatggattgagccctgtcctttaggagtttatagtcttattgaatgaagtgaagaaaataatatgatgctacttaaaatgtataatggcttttatattttaaatatattagaggtctttcaggtaattgatattaactgtgatgttgtattattgaaactgcattataggatattttcttttcatatctatttcacagttaatatcacagttcttttcaaagaagcatttgtgattatagccatctcctatgaagcgttgttgtgaaattaatagaaagaatcattggcatttcatggttttgctgaccgtgggcttgagaggattctgagcagaaggaaagaacaagttgaaaccccattgatttttttttaataggagcaaattgcagcataaaactactgccccctcatcccactcccaaccacacaccaagttctactagactcttaaattcgtcatctaccagcaagataaattcaaatagaaaaataactttcgctaacttatatttgaggtctgagatataataaaactattttcttattttggaagaaaatgtgtatgcatgtatgaattattggagaaaaggattttctcccatggttatttaaaagaatggaaagttctaatcagaagttatttcgtacaccctgttgtacctaaatatattttttctatttgtatgtccttttgtgagggcaattagagttacaaactggcagccactttcatgttttttacttatttttttctcctaattaatgtttatgtgtgtagacataaaaccaaccttaaatttgtatccacaaagagaaataagtgatcaacaaaaaggccttacttgtttctattcccaggctagaaaagagtgtgatttgactgtaatttctttcagggttaaatgtttgtatgtctctttatcatatagccacattatctttcatagacacacgtggcttgcatccttgaatcctaatttgattatttcagcaattggctcctcctggcagtcctaattaggaagagtaaccgggttttggcggtcagagtctacaagttctgatgagttaaactcatttgccctgtggtttctactggtgcctgacagtagcgttttgtttcctctcttaaaaaaatttttttgtatcaaaactgtctgggacagttaatgaaaaaatgaaagatctgtgtttttctcattaaaccaagatttagaaattcttcagccattctaagagtttgcacttgggtgtggtttggtattttttgtaaggacacttaatttaggttgtggtgactgttaaggaatcaaatgtagaacctgtgtattctgactcttcagagatctgattttcttatgaggaaaactgtagctcagagtccccatacagagcccttcaaagccagagaaaatcctaataaaaatgctaaagaagttccttcaacataggtggaggaaaactgttttgagatgaaagatcactgtataagattcttccactgttactttcttattgctcgatgatatggaatatgctttggggtgaggggccaaaattgatgttgctaattatttgccttggtgaaagtgaggaacgagaatattgtgtcatcattaaaggcctccatcttcataatgaccctttcggggattatataaagcaagtaaattgtctgttacccagtgggagcttttgaaagtaggctaccagcaagctcgatgtgatcgcttctaactactgaagacctaccccctatatctgggacttcctgtataggaatacaagagacttaaaaaaaaaaaaaaaaaaaaaaaaaaaaaaaaaaacccaaaggtctagacacttgctgagctctctgacatacttggtaattgattaatggttgcacaatcctggattcttactggcttctactcagtgtttcctcaggcttgggggctactgttcatcttgctcaactttacaaattattttttggagggagtttgcagaggtcgctgagcaggatgaaaagattacctgcccttcagggttcaagaaagcttttaaattctgttcctattccttcccgtttatatggggcaagtttcttttcctttggggactcatttgtgatgggagtcaccacagatctggccatcactgctttccttttctccattccactgtctggagctttgttcctctgtgtagtccaaggggttgagaagtctgaggatctgggcctttctggggatccagggtatctgcaggcctcatctcagagatggcagattcttactgcagtgttcaggtcatatgagattagctgaagacagccaaatgaagataaagtaaataatgcaattgctgatgttttctttagagctccccttgatgggctttggaaagttgtggtcccagctgcttaaatgtacatgctcccacagagcaaagtctaagaactttagtgcacagaagagaaccttaggagtgtgtgtaaatgcagcttcctgtgcctcaccctccaactgattcaggactcagagttgcagcatcacaagaccctcctgattctatttcaggtacttctcagaccacacttagatattattataggggaaaagcccctctcccttctagggagtgacttagttcaatcacaaatcagcgctcatgtttaagctctagacccttgtgagacattttttgggaggccattcagaaattgaacttccacggttcctgatgatcccacagatctccctaggtgatctctgctttttttttcttcttcttgctgttcttattctcaccactatgctctaaccgttcttcccttccctttgctcagcaatgatcatatttgctttgctaaagtagcccctcttgtttcatttctttgcagaccaagatcagggctgactatctcaacctctcccaattcataccctcctttctgacgtgaattctgttatgttccactcaacaaatctaaaatctaattagtgtttttaggctttatcttactgtgggtcttggtaagttattgaatgtgcaatttcttggcagatgcaaagcagtcttttcccatttagaacctcaaactcatgtagtcctctgcaggggtaaggaggatagggaaaggatgatattctcgagaggaaagcaaaataacagtgaactttcagctgtaaccagcttggagaatgctttgctggaaaatggaggaatttcagtaggagacctcatgagcccatttttcttgcttttagtcgctggcaatcttaaagttgttcaagtatggtggctgcccaaaccctaggtctttttccataaatgaagagtcaagacctttgctctttccctctactctgaatagaggattatattttaatttttggttctgaagcactatttccccacagtggtccccttgacctccctgtcttttgggacctgccaccctctttggacaccatgcactttagagaggtatattccaatactttggtaaagattttcagatgtggaagaggctaactcaggcattgtttctaccccatgggaaattttgagctctgtatgagattctgatgttggtttttctttgtttttgtttttgtttttcttcttgctgcaggaaagcaatctcccgggcaggcctccagcatctggctcctgcacatcccctcagccttcctgtggcaaatggtccagccaaggagcccagagcgactttggactggagtgtaggtgttggccttttcatttaaacatcacttcagtgcatgttttgtgtctctcattctcaggattcctctagttacaaggaagacttgcttaataattttcaacattgcctgctgacctgtcctcagataccttagctgtagctccattttcaaactcctatgaacatcactcctttatatgaagtcagatgtgttcaagactaagataaaagcttcctgaatcatttgaagtattactgcagctgtaagattaaaaagtacctcgtgcgcagtctttattggtttctgccaagttgacgatgaattgagcttacccttagtgcaacatctcgcaatctaagttttgatttcctcagcttgagctgagtttttctgggtgctttttttcccagaggattacaggcacttcatgtcattctattgcttttccttcctcccttaaccaaaggcagatgggtctggcatcagtaggttgggtatatgagctgatgttaacattttaaccataacacactcacaaaaactattaacttgacttgaagattatagtctgaaactctttagttgattaaacacatttattgagagtcttcagtgagtcgagttcttggccgagtaactgtttctaactgtagacccaaaggctttgtcccttcctgaagcaatatgaggaaaaggtatcaagggagagaagggcttccctgaagttctgccagccttccctgatgatgaaccttgtttagcacttttagttgagtctgaatagaagggataatccatgttctttttctccatatgaaagagaaaggtggggtgggggaaaggtaacccatgccatgatttgatatcctctgtattatagcatttcttcctctcctctcagcacacacttattaatatccttattttacatcttggatgcataccaatgtaaatgctgcccacatttatgaagtgcctggcaaaagactggatgtgcttgaactacagcttctcccttggtggagatattgttaccctgagagtgttcagatgctgcctgagcctgttgaattggtgtatagaaagaatattcctttcctggagtttacttctttattccaggacagctatttaataaactcttaacccacaatagagtatatttgcaccagtgtttgcataattaaaaacaattaaatgcataaacataaataaaacctaagagaggtatgcatggagcaatgatgagagtgtattatgtatcaaggaaccgaaagagttggtttgatattcacgatgttccaaacaaccctgtagtctgcagcagcagggccttctttgaggtgagacattccaggggtagtttaatcatttagaggcgaacattcattaaatcccttctctgcccttttgtgtgacattaggtaagtcactgatttctttcagcttcaacgtcctcatctgtagatggggataatcatggccctatttcatggacattgttaggatcgaatgtgacaataagtgaaaaagttttttttgtaaactgtgcagccagcagatttatttgttaaagtaattgatgaattcattaattcatcaaacatttgttgagttcctgctttgtactagaatctatattggttacttgggattctgaggtgaagaagatacggtttctgccttcaagggtcttagaatcctgtgggcagaaaggaaatcaacacgaaaatacagggaaatgaggacgtcactggaatgcaacaaaaggacattccattcccatttgatgttggaaatagttatcagaaaatgctttttaaaagaagtgtcctgcctgagccagagcttggcacaaggtattattttctgattcctatagagaggtatgtactctaatatttcatcaaaatggtatttttggccagtggtgggaggctgcagtacagaatgagggaaaaacaaataggaatgaaggctgggtttgtgcctagtgatcttttatccctccctcttctccccttttctttgattttaggtaccccatcttggaggtctgttgaaagtatggcatgacacgaaacacttagctgacatctaacaatggtgggaaaaccgaaagcccttccttgagacagtccatctgagggcttagagatctgatgtgtaaggagttatgagatgttactctggaaaaaaaccaacatctttgtgggctgattttggtgtcagcaaacagaaagcaaaccgtgaccaacacactacactcatttattacaatcgtgtaaagcatttgtttcagaaaagaggaaaaagccgattgttaaaaatatttcagtgactttttctttggctaaaactagattacttgtattactttagtatgctcttctgttcaaggagccagccagggatttctttgttctgtttaaggtgcaaaaacagtcacctctctgtgccattccctctcctccactctcttgtttgattccctcatcttctaccattagtctactcttctggactcaatgtatggaaatgagcaatctttatttaattcagtattactatttattgagcaatgaaaagggttggagcctctttgattctttcaaataaaaaggaaggtggcaggagcttataaaaaaggtagggggaactccagtctcttgcctttgataaggtagagggccccaatagtgctaagttgtgcttctgaaggtcttgaccacagtggcagatggggtccagcagggacgacgagggtcctgttgttccctttccccacttgactcttgggtggaaattctctctgctctgtaacactttggctcaggggaatcaatgggggtcatctcaaaggcgtctactactatgattctctggcttctgttactctattcttcttccttcatctgtaaggaaaaagattaaaaaaaacgttcatggtgtgtctgaagttgcaaagtcagagtgaacctggagttaggatcttagtccccaagtttctacttattgtggaatcccaaaagggccgtgttctgacactagcctatgtgccaaagtcatctgaagggacacaagtatttcctaaatatactttggcaaaaggctttgaggagaagtctgtttgtggggtgcctgagatacaggtgagcactgatttagtgcgcatagactataggcacctgcacttcttggccaggagggtgctgttatagcagacagtttttatgctttgggtacattaacttaatacttctctttaagcattccatttttatgttctcatttccttgtttgtgatatatacagtctctctctcttagttttaggttgtttctcaaaatcccaaacattctctcctgctgtgttttactcaaatggcttattatgacttttaggattctctgtcccacatgggctcattctttgaagatttttcggcaatagatatttactgaggctgcctgtgcacagtcattttcctccgtgcatgtcagggatagaacctgcagtggtgtgtggagagtatctggatcagtcttcagtatgatgcctgagtcttctattgacagcagtggacactgggctctacccagtatgaaaattatttcctctagagattttctcttttgctgtctgccaagccatgctcatcttttcaatcaaactgattctatgtatctgatgtagtctttgctttgtatcctcacaacacctctctgttggtagtgcattgtcttacaaaccttagaaccaaattagtgctttttgtttgactttcttatttgtggctgtcagatttcaggctgcttaaaaggaggggcaatgttttctgcttgttttctcttcacagtggagagtgcagcatcatagacctagtagctgcttggttactgatgtcaggggatgaattgattacagtttttctgctcaatcagtgagaaggggatatttcgctgggagttgacaggcactcagataatctctagttcctgaaaggcttggtaggcatgactccaaagtctgcttgaaaaataaatggatttatgccgttttaatcccaagtaactgtctttaaatttccttcctaattcaatgcattgtgttagattttaaggcgcacacagtactttggccttcctactcttcacaaggacatcatcttttcacttccacagtgacagcctgcagcagctgccccctctgacactggatgatgcctgtcagccaagccagttggggtaaaacaagttaaattactagaaaggaaggaagtaatgcctaagaaggaaaaaatattctcatctcctgggatggattccaagttcccagtttagagtgaattagtccatttagaagcatgtctgttccacagataatgtgtatcttcttttaaatgtcacatgtctcccttccaatggagacttcatttggacttccagcactcttccctgtttgtagtactgcagcagagagcccaggaagtgtgtctcccatctgtccccaccatttcataatttgtttttgcccattacactgcctaaaacaaccccctgaacagtggtggaaaagccaccaagatctttcttaaagggcacattggttttaaacccagcacccttgattttattttgttttccttcctcattggcaaactttcttcggtcccaagagctgtggaaaacagagcctcaacacaaacaaagccagatcttcagtccgaaccacctttcctttcctttcctttagttgacgatgctaagaaacactttctctgaggcagatagaaacatcacacagttggtgcactgcctcacagtttggttcagggacaagattaaggaaccagagtcttcatgtgggattggtttaaactgggttatgaaactaggtcatcttatctttagaaaccttgaatgaaaagccagaaggaggcagggctgtgtgtgtgcatgcgtgtttgtgcgtgcgtgctcgtccgtgtgcatgttctcatttcagtcctgtttcctgtgagtcctaggagacctggaccttaattttgggcgtcaggcccccctcttcatcaggtctgagtgtcatcacccacagccccacatctttccccactcccagccccatttcgaaaaactgaagtcagattaatcgataaatgagactgtttgttgagcagcgcataaggaactactcactataaatcagtgaagatcccagtcctggtcagccacgtaaatgaagggacaaatcgaccttaatttcagggactctcaccattcctttattttctgagaacgggggagtttttaaatcaaatcaccctggctgccgagggaaatcatggaattctgtaacttcacagacctgtgagaagtgtctcggtctaatcttctgccccgaggcaagtgattatctaaacaaacgctgtccagtagaaatagatatgagctgtaatgatacattttctagtagccacactttaaaaagtgagaagaaataggtaagattatttttaattccatattttgtttaagcaaatatattcaaaatattatttcaacatgtaatcaacataaaaattattagggagatgttttacattcttttctcacactaaatcttcaaaatctgctgtgaattgttcaaagagaagcacatctcagttagtgctaaccacattttaagtcctcagtagccatctgcgtattgtacagcacaaatctaaaacatccaacatggtgtgttatcaattcttgtcctgaagattttcaaggggaggcaatccactctttttcctttttgattttgtaaggacatttacataggatacatatttataattctcattgtttcaaaacatttttataagcaagcgtcttcattttgtgtggagtatttgcttcttgtgtgagcatactctttatctgtgttattcagtctcaaacactcacctcacctttgtctttttgcctgtaaccattactagaatttcggtagcacttgagcaagaaaacatgcctatatctagaaatctgtatttatgtctatttaggtgaatctccacttagatgaatagatctatcgatgtaaatctatcaatgtaaatatatatatagctatacagacttgtgagtctcagcactcacaagtacagaagaagtgctatctttgtttagaaataggagagttatttttctgtctggcacagatggatactctttgagttgtatactatttgagatggtatttcgagatgcatgtgtagagaagagagaaagatgtttccaggtagggacagtagaatgaacaaaaacgtggcaccaaaaagggaaatgcgaggtatgtttcaagaagagtgacagggagcccagtgtgttggcatatgcctgtaatgcagctactcaggaggctgaggtgggaggattgcttgaatccagcagtttgaggctgcagtgagctgtggtgatgccattgcagtccagcctgggcaacagagcaaggccctgtctcaaaaacaaacaaacaaacaaacaaacacaaacaaaaagagtgacaaggataaaagagtgacaaggataaaagagtgattgatgctgttattggagtctagtatgccaggttgaatttggattttattttataaatagggaaacatctaagcattctgaacaagggagaggcacaatcatggctctcttttggcggaaactaaatttatactaacgttaaataaatcggagagggtgtcagagttcagagcagaagaaaacaagactccgaaattagatgcactgtccagcgtatagtaagtaattgggggtatattcagataatgaaaagaaacctagacaaaaataaaagcaaagggaagaggcctgcatttgctggggtaaatgaggctctgcagcaaatgaaagactcaaatgtataatggcttaatacaagagagtgtctcacctatgtcatagaccaagactattccaggtggttggctgggtagtcaggccctttctcacatagctattcagtgacccatgctgaggatcactctgacatctcaccaagaggattccaaaagcctgacttcccaattgaccagtaagacaaaaaatcatggaggaatgtatgtgggaggatttaatggaacaagtctggaatttctgctctgtttcactgttcagaatttggccacacctaattgcaagagagactggggaaataaagtctaactatgtgtccaggaaaaggagaaataattattttgaggactggctagcagtcttggccacaaagaccaaggagagaaacgtagttaatgctaacatctgtggattgggaggaagaagggaaactagagagtaatagcaacaataataaatataatgaacatctattaacttcttgttttatgcggaacattgggctttatgcatttttatgtttaaacatcattgtagtcctgtaagggaggtacagtgatttttatgtgactgatgagtaaaatagggtctaggaaagtgagaagggccctgagtcatacaactattgggcaataagtctgactccaaagctcacattgattaatatggagctggagacgggttcctgagaattgtaggaagaaaacaaaaatagttcatttgtctactgcattcttgtgctaatgccacccaggctagacaactttatgcaggattcaagagtccccaagactaccctgtcttctgacatcagttgcaagttcgggacccccaagaccacactcagcttcagtaactcactagaaacactcatagaactccctgaaagctgttaatactcacatttgtggtttattacagtcctttccacgtagaatcatggttcactagctaacttctcccagcaaccatgtgctataatatacatggcatagagccaagcagggaagctcattcgaaccttgatgtccagagttttaagtgggggttggtcctgtagacagcgttgactgcccatttggttgacaatagcctctagcccctctgggggtcaagctgataccttatggcccaaggccgccagacaaacaaaaacacttttatcaggcaggactttccatgggcttagagattactttcttggagctgaaagctcattgctttatcagtaggttttgacattttacccactgctacattttggacttcactttctaaagtagttagtgggattttgctgtggtttccctcatattggctgctgttattatgcatctagttccatcttctctggtagatttttctccattgattaacacagaatctcagtgcctggcaccagtgttatcgaataaagaattgttgaataaattaaagaataacaaaatgaaaaggcattattctgtataaatggttataacttagagttggagaaaagttcccagtagtagaatattttaggttgtgtggattgatgtcttcaggataccttgcgaagaagtgcctttctactttttttaaagtgttgtcatcatccatcactatctgaaaacttttagggtctgaacccatagctatgcttctcttgcatctgctgttgtcccacaaggttgactgtgaggtgaagcctattttcccattgacttccttgaaaaaattgaacttgcaacagggaaaaattaccagtagagaagaaaaagttttggtgaacaggtgtccaccctttgatgtagagggcaatgatcctggtcagtgttgctctccctttaggaatggttttgaggcactgggagatgtggatggtgcactcctaccaccagggtctccctgtgcgttgtcctgaagcccttgacatctatatccctagtgactttcacattctcttgtcccttcctgcctcacttctgtggtccaggacttggacccacctttcttggatcctgaagcacctacatcacatgtcacaatacaaattttggttgttcttaccccagaattatttgagtcactaggccctgaaaggaaaatgtgttctatctgaatctgaagaaatacgtttattttaaaagatgggtgacacttggtattttttcccagcaaatgtcatttagtgtatattccttttttttttctcttttcttttgagtcagaatattgatccattgcccagactggagtgcaatggcacaatctcagctcactgcaacctctgcctcctgggtttcaagcaattctcttgcctcaggctcctgagtagctgggattacaggtgcctgccaccatgcctggcaaatttttgtatgtttagtagagatggggtttcaccatgttgtccaggctggtctcaagctcctggcctcaagtgatttgcctgcctcagcctcctgaagcgctgggattacaggcatgagccactgctcctggccatttggtatatatttctgctttgctgtactaagctttgagattcaaagggctatcgtgtggacactgctggagtaggttataataaaagtggctcatgtataagatgggttttcattacatgattattctatagaatttcttattgaagtcatctgctcaggctgctataacaaaatggcagacttgttagcttaaacaacagacttcatttcccacagttctggtggctgggaagtccaaggtcaaggtgctggcagattccagtcctgggtagaatcctcttcctcacttgcagacagctgctttcttgccgtgtgctcacatggctttttccttggtgtgtgcatgaggggaatctcccatgtgtctcttctataaggacactaatcccattatgagggctccacccccatgaactcattacttcccaaagtctcatctccacattctgtcacattgagggtgagggattcaacattggaatttttttttttttttttttttttgagatggagtctcactctgtcgcccaggctggagtgcagtggcatgatcttggctcactgcagcctccacctcccaggttcaagtgattctcctgcctcagcctcctgaatagctgggattaacaggcgcccaccaccacacccagctaatttttgtatttttttagttgagatgaggtttcaccatgttggccaggctggtctcaaactcctgacttcaagtgttctgcccacctcggcctcccaaagtgctgggattacaggtgtgagccaccgtgtctggccaacatatgatttttgaggagacacagtttagtccatagtatcccccataaaaaataattacatgcccatgtacatctgatgaataaaataaaaacaagagtaattttcctgtaagccatggagacttagtcttgtttctttatggttaatctaatacaatactttccctaacagctcagagctccttttaagcaaatgagcaaaatatacaattaatatataaatctataatttccaagatagagtcccataagaaggaatatggaattctattcatcgtacgattaaaaaaaaaaaaaaacagtttgcttccccctttccccaataccgcactacacatttctggaaaatagggttgttgctcatcaggtcatacattctagcagctctgttccccatccaaagtatatgaatatttttagaagcaataacatttagtttgaaaaattgagaagtaattgggtgaagaccttactgaattagtaagatgtgaattagcagaaacgtattatgctttgagtacacagggacttagttttaagaagcctctgcccttagaaatataatttacctattactggtataactgtgttttcaaactgtctttacttaaaatactttaatgctaccatcctcctttttagctaatttgttaagcttattcactaagcaaagtcaaattttaatataattttagtctcagttgtcatgacatttgcagtggtgggcctggtgaataaggtttgacatcgaactatttagaggtgttttttcctcatttgttgaatatgtttcaaaaatgtccacctccatggataaagcagctataaacctaatgtttattttagttatagctcaaagtttttccaaacacctttctccctttttagaatttcgggagaatcaactctagcagtacttttagtggtcaaatgagaaatgtttagactccttggtttcactaactttcttgtatcccaaatctaaatttgaaatagttttccttatccctggaaaaaaaaaattgatgtcaggtgggtcttttccttgcaggagaatgccgtgaatggagaacacctgtggctggagaccaacgtctcgggagacctctgctaccttggagaggagaactgccaagtcagatttgcagtgagtgtgcgctccgtcttgctgggggaaggcctgtggatctgaatgaatagaggggtcaccttgcctaaatttccaaggggaggtttgaacgagcctgtccttgtgagatggaaaactttccggatgttttcaaggtttgcagagagtttctcaagttaacatggctttcaggttgtcgctcgtaatggttttagggttcacttatgcaggccaggccttggtgtcatgtgttactttataatgatgcccagggtaggttgttgtgtgttggtggggggcagagggtaaatgtgtacgaggtagtgtctccttatggaggagttgttggtgtggggccaaggcctgtgtgtggaggaaggggctctgtctgtagggaagtggccacagtgggggctttactggtgggtgaaggtggaaagagagggaaacacctgtgctgggaatgggtgtaggctaacaaataatccagactaagttctggaggatacgattctagaaataatataaacaatcaacagtcaggtcaattggagttaacttttgttgtttaaaatttgctttgtgtccctatttagaacaatctatttagagggttaaaattctctttatgttgtgaggtaagtgtggttgccaagtagtgcattgtggagatatcaaaaccatagtgttgagaaattgaacttaaagtttgtgtgtagttttaaatgattggtccaaacagacagtaatgggaagcttaggatagtaaagaagagataaaagatgtattccttcttatttggggaaattagcaccagaatttatagaatgcttttttcttttttaaaaaaatatttgtttattatgtgaaagaaatatttgcagcaagatgtagggccttgaaattgcagatgaatatgtgtttgttaataaccaatatggaataaatcgagtttccatcaaagcttatagaaggatatgtatagcccccaacgattttaaccaggctgcctaaaagcacaaagtcccagaaccaagaccttttttgttgctttagctgttttaactccttgtttataaatttcatttggagagttttgagagttctggggagaacagggcctgtttaagtgaagttgggaatcaatgtcagggaaagacccagatgaacaggctctggattggaagtcgggaaacctggagctgaatctcagtgttactgctcagtgtgtgacattgagaactcgtgacctttgggccttggctaccttctaaaacagagagtaggattaaattcttttttattaatttatttttgtttctagacctgtaattaatcatttgcttctcttctaattttgttgtaaatttaattgacttaaatatcaggatttcaactttatgcatatgtatttttaattaaagtataattgcatggaattggattgaattaacgaaatccatgagaagctcagctgtttggactaaaatgctgtaaataatgaattaacattagtgtcttggttaattgcgtaaacactggtcctgggatgtaagataataaaaaatggaaaaaatgaaagccagtattacttacatatatacttttgaacaatttctactgatggactatgattttatacagagtcatcccttatttccaaattgctccctttaatccctttctgttactttttaggggatggctacctctcttgacaaatatatgaacagatacgtatatcctctttaaaccttgtatcagtaaatagcattgctatccactgaatgattattacttgttcactaatacctttaggccaggaaaagcaacaaggagaataaaggaaattttaggtagaagtaggaagaaacagagttgagaacgttcccagtttccttctgaagcttcctcataatttcataccaggtacttggccctattaactcatattacaaaacgtctgaaagatgaagaactctcctccaaaaaaatgttggttaaatgaaggaataaatcagtgaggaagctgaagacctaactgctgtaagtttcttgaagctcagtttctttacctataaagtgggggaaacactgttttgagggtttggtgagatgatacatagaaagggcttacttggctcagcaactgacctaatgaattaaaggcaaaaaaagaaaaaaaagaaaaaacccaggaaggacaaggacaggaaatttacaaaagaactaccaattgccaatagatatctgaagaatacaaaggcatcccaattaaaacaactcaggagtcaacttcatgtgcctattaaattagcaaagatttataaaatggtaatagttgctgctggttggtttaggctgaaatgggcaggctcatcatcagctgccaggagtgtaagtagatacactgtccttcacaaaattggcagtgtgtactgaaagcactgaaaatcctctcagtctctctccccacctcgcactgtgaggcgcatgtcatctctgggcatcccattttgagagagacattggcaagcagcagaggacccagagtggggtgcccaagttggtttaggggatggaagcttgttgtaaagaaatgttaggttacatgggctacagctgagtattaggagcgaaggcagagagatgtcttccagtatttgaagagttaatttgaagaaaagagaagtgacttgctatctgttgttagaaatggaaaagtcatagaggtagaatccaccgactctaactttataacaataaacaaacattacctgggaaacctaacaatgcacactcctgtttccctctttgctccaaatgctgattcagtatgcttggagttggacttgagagtctccgatttttttttttttttttttggatgtagtcttgctcggctgcccaggctggagtgcagtggtgtgatctcggctcactgcaacctccgcctcccgggttcaagaaattctcctgcctcagcctcctgagtagctggggttacaggtgcaagtcaccacacccagctgatttttgtatttttagtagagacggggtttcaccaggttgaccaggctggtctcaaactcctgacctcaggggatccacccgcctcggcctcccaaattgctgggattacaggcgcgagctaccacacctggctgggagtctgtgattttaacgagcacctcaaataattctgatgcagatgggtcgcaaacctaactttgagaaataccgtatgataagaaagaactttgtcagcctgagcttcccagcaagcgaacaaggtgcctggagagattgactggtgggatgtgtgtttgtggataacgtgggtggccatgtttaaaggatgctgtagttggggactctcagctgctttgggcaagaggtcacagagatctccaggcgagtctttagtttaaatgctctgtttgcagttttcttagaacaacagtcttttttgggaaaaaagtatgcataagcagatcatgtatttatattctaatttcttttaatgaaccacctttgaagaaagcctacctgttggggctgggactaaattaccataaccaggtactacctgcaggctcctaaacaaagtacaggcagagtgctcaggggaggagtgaatccatcatctacgatgtgcctttcactccttccctattttagcaaagcaaatgtcacaagtagaagttaagagaaggaagaagtcagtgtgggttgaagcagacagaggcagcttcatggaaatggggttcgagctcagttttgaaagatgggtaagatttacataagtgattttgaagaaggagaacatttcgggcagggaagaggaacatgagcagactcagaggtggggcaagctctgtacaaacgaggtggcaatcatgagccgtgcatgagcatgtgtcagagaaaaatggaagtaagaatggagttaggttttttgaaacaaaacttggagtgcatattgtaaatactggtgggcttaggaagcatgactatagaatacattgtctaaaccaagacacttttgagggtgaaagtggctgctgttaataatgatgccgtaacattagggataaaccagaactgcatcaccctagcttatgggacattagggcatctatgtaaaactaaaactgtcctgcaaagccgggacctcctgctgccatgtggattgatatttggggactgatattggagggtactgaaagccaggcaatgacttccaaaaccctagaacagctgtaggagagtttgttcccaagcttcagggctaaaactaaaccacgtgaccttttcctgttctacagctctctggtggcaacatttaatactgtagaatacctgtgagcagatacgtaatggaattaaatttgttcccaaattggcaacagttcccaaattagcaactgtttctttttctggtctagataaaatataaaaggatgcaaaagtaatgaaattgaagtagaaagatcactgtttcccaacctgattatgggcactggaaacctgaaataaaattccagccagaatcactgtcgtttggtgacatttatttttatgtacatttattcatttattcattcatttattctgtcagtgtttgtgagctgggttgagtacccagtgcctcaccgtttagcgggcacagccagatagaaactgttctcatgctctggggctaggctatacaaacatgtttagccaaatatttgtacctaaaggagctcacccctccagtagtaatccctggagtccataccatcgtgcacctactcagacttgaaagaaacttgcctacattgatatgcaaattatacacccaccgtggtcacacagacctgaataggcacagatgggtagcatgggtggtcagaaggaaatagactttgtgtggactgacctgggtttgaaaacctgctgttccatttatgtactgagtaaagttgggacatatcactttgcctttttttgcctcagtttcctgatttaaagtattgctactgagatagaccacagcgattcttatttctggatgagcattatagtcaattatgccattttaccttttaatcttacctttgaagtgttggttcccattctggatgtaccacatcaggatctctagggagtgggactcagcctgatgtcaaaaacaaacaaccagatctacagatgattctcttcactgtcagggtagagagacagtgatccacttcagaaacagagtgtcaggaccaaaaaccgtggcctggttctcacacctggtgtgtagtggctgtgatgggctaaatagtgtactccaaaagatatgtcgaagtcctgacgcctcaggacttcagtacctcagaatgtaacttgatttggacatagggttgttgcagatgtaattaattaggatgagttcatctggagtagagtgggccctaatccagcatgacatgtgccgttataagagaagacacacgctgggcgcggtggctcatgcctgtaatcccagcactttgggaggccgaggcaggtggatcacctgaggtcgggagttcaagaccagcctgactaacatggagaaaccccatctctactaaaaatagaaaattagccggggtagtgatgcatgcctgcaatcccggcggcattacaggaggctgaggcaggagaatcgcttgaacccaggaggcggaggttgcggtaagccgagatcgtgccattgcactccagcctgggcaaaaagagcgaaactccctctcaaaaaaaaaaaaaaaaaaaaaaaaaaaaaagacacacagagacacacacacagagaagaaggccatgtggtgatgggggcaggaattagagtgaggcagctgcaagccaaggccctccgaggatcgtggctctcctcagaagctaagagacaggcatgaaattcattctccctccaagccttcaaaagggtgttcaaccttgttgaaaccttgatttcagacttctagcctctaggagtgtgagagaatacatttctgttgttttaagctacccagtttgggttccccacagaacacccattgccattgagtgggatcttagtattcagtggaaaagtgtttgagaaatgctcacacaatgtttgcagttttcctaggactcatactcatcatctctgatccataacaacaaccttttggggtggtcatatcgggctgttcacttctacctaaagataaagaagagtcagagaggcttactcactatccagagctttatggcttctttgctttcttagggcagtgctaggaacctaatatagtagccattctataagtcgagttaccttatctagccatgcagataccgcagttacataggctcactgacacgtatgcacacaggtgcgtctacagcaggcttgagtgtttaggttgagtggtatgtggttgaggtgtaagtgagcagacaggcaggttggtgtcagaagctgggagctgcagggaacagagtaggtagatggtgaggtgagtgagcgtgtatgttgtgtaagaggaaaaatggaactgtcagacttcaggatgctgttaccagatatatcttctctatttttaaatgtgagcatgccaccctctttttgtggaccagctaataggtactgctttgcttttattattgttttgttcttgtattttgctttagtcttttcctcgtagataatgtttggtgaaaatggcttaaccctacctgtgacaccctgccttaattctaagttttcttctaatgttgcttgcaatttgccaaatacagttttactgagaaagtgaatgaattgagttagagaggccatgtgatatgagagttggaggattggagggcaagagcttcacagatccagagacaaaaagatctagataaaaatgcaagttctgctctgcctttctgagcctcagtttcctctgtaaaatagtggtgattaaatctacctctcagaatcagtagagggataaaatcagttaacaaatgtttgtattcattttcctcctcttctgtacctactatggttcaatgtcatggagctgaacaagctaattagcagatttggttggactttggcttaacaaggccttatatttgggatgattccaacactaagactcttatggcttcacctgtcattttgctgctgtgtgtagcatccatattcttaccaagtcatgactgcggacaactgagtgggacaaatcaaagtaacccattctgtgatctcatctcacaagctgtgtcttcttattggtgaatcagaagcctcatcattgtctgtaacggggtatcacaatatttgctcacaggaatgctggtcatgtccttagattcttggaagaaactttcaagaagagtacaagggtcatagctttctgccctatttgaaggaaactttcagctttctgctgtttaaaaatgaaaatgattttgagcccagttacaccttgtctgtttcatctcaggaagaatgagcaccaggcagcagcttgtgaaaatgctggttcccatgcatctgtgtgtgtgggtgagaagatgaggcaatcagagcccgacatgcattactggggactttctggccatctgcgtattcaggtctagctggtgtgtaacatggagcaccagcattggacttagaatgcaccaagatctgcctgcatgttgctcctgctctgtcagcctcaaatgccagttgtctggcacagcagactcatgatctgcaccccagatggcagtttggctgagctgggtgcaggctgtcagagggaaccacgtgtgtggcaataaagcccaggaggcaaagcccgctctctgagttgtttgggtgccagccattctctgccaggggcctttttcaccattaggatattgaggatctaatgaatcaagatgactcatggaaagtgtggccatcaacaaaaataagaaaagaattttcacagacacactgtctgctactgagttcctagtcagtggatatgagagagggagagagtggggtgctctcagtggcagaagtaatgtcaccctttaggtgtctggcctgatagctcagcatttccatgagatcgttcacgtgcacacttagtgtctggcacatggtagaccctcaggacatgttagccattgttactatgacaactgtcatggggatcgttataatttggtaccaagtgctgtctgtatattaaaggagaatctagtgctgatactgctcacttcatgtaatggggatagtgatagtatatgtaggctatgaagccaagggatctttaggattctgtcacttctaggtgaccctggatcaatagtaccattgtctatttgcacagcccattttcttttgacccaaaattgtgttctggagaacactaaactcaaaagaaaacaatatacggcattatacattaaaaggagctcatgaccataaattttgaaaacactgaatgactttaatatgcaaataggtcctgtgaagctcaacgaagcatataaggtatgcaggatttcctactttttttttgagtggatgggaggattgtggaacccataatttccccacagaacacccattgccattttgtaggatcttaggagtcagtggaaaagtatttgagaaatgctcacacaatgctttgcagttttcctaggactcatactcgtctctgatccataacaacaacattttgaagtagtcacattgggttgggttgttcacttctacctaaagataaaggaaaaaaagagtcacagaggcttactcactctctagagctttatgacttttttctatctttgtgcagttcttttgcctttatactaaactttcattaagccaaaatgcatgtgtcttattttattcttagagtttgaacctctgagaataattgtcatcttttctgtcatgacaattttagattgaggctgcatttgcgtgtttgtgtaagggtgtgtgtttctgtgaagcagttctgttgttattggatattgtatggtcctgttacctagtaataaaaataatttgcatctgatttagcataaggcttacatgttacctaggcaatgcccaggtgtacagaaatggtttctcttcttgcaatgttttccaggggcagggacccacagtactggggtttaaccagtattcctgttgcttagaggcactcaatcttgatggaagcattatttgcattatcggttactccaaaaccactactggcccccaaagttggtattgtctctgtttgttaggagcttgttgttgttgttccctgccacattgatgaggtggatacatattcagaaggtgatgctttaaaaacacgaggaaatggaaaatcctgcattgatgccttcatttaagggggtgcaggtaatgtgttgatgaagcgtgtgagctttggaatcagatgacctggttttgaatcctgatttccaggctttgagttgtgtgacactggtccttgttttaacctcgttaagcctaagttttacatctggaaaatgggattatactgcttcttgtggttgttgtgaaaattaaaagagttaatgcatatataacagcaggctggcaaatcacaggcactcaataaatattgaccactataatcattcctccttgaatgaaagtggttccaagaaacagagccaaaagagacaactcagagtactaggtttggagagtcttagcatcacctactacctctgtttcctcgaggaaagttaaggactgagcttgtgaggtgaaacaactagcctagctgacagtcaggctctccctcccctcttgctccttcaccattctgtcaaccttttacagcacacaccacttactagctatcatacttttaaaaattgctcgcttatttatctgtctccaacactacagcataagctccatttagctcaggaactctgcccttgttgtcctctcctgtattccccacactgaggataagtgattgaactgaatagttaccctgtgttacttaacattgaatgaatgaatgagttcaatgaggtgcttgttgagagagagacacatacacacacagacacctgtcaccagatcaaccctgccatttaagtattgttatatttataatccaggacgtctgaattcctgcctcctttttaagactctttagagggagatttaacacatgcaggtagctgacttgtgtaaggttttatgccctgtttagccagtgccatgccttttgcagtgcattttatttcattctcgtggagaacagagactgctttttgccatcttggcacagggggtcatgtgtggttgtcattagtcagttcccctagggatctcatgagaacagatcatatgaagcaatcacgttaaatatcatatttcttatctatcctcatcagtcttggtcccccaggttaccactagcaaagaaaagaggaaaacagtaagctgtaacacatagagatggctttgggttagaaagacttccactcttagctagtctttcttgggcaagttgcacagtctcatagggtctcagttcccttagctgggtaagtcgtacctacttggcatggcagaagtgagctctgtttacagtgtgggtaatgtgtatattacacagctagcctcctggcaaatctctgtgggtatgatgtcctcattaaaaaatgaaatgggcgggtgtgtatgtgtcagtgaaaacattaccaactggaggtacagtgttgagtaaacaatgactgagatgtctgtgggtcttcctggactagattggctggaagactgccttaattatgtcaccaaatagcttggaatgtgaaaaatggcagtgaaaggataactaacttaccacagcttgatatcgcttcttaactagaaatacagtattccatatcaaagcaaatatctctaaatttttggttagaaatattaagctgtgaactttaagaaaataattctatttccacaaagtaaactgataatggaaacatgtcaggattcataatacaagtaagatggtgtttatggtactgtcacaccagcaaggactgaaaaaggcaaagtgtttgggatttcctagtttatactaaggctcaaatctctgctgtacccgtgatatgctacctcagaactagagaaagccaccaagacatagaaacaccattttctattaacttgttttgttatgacttctgtaatatgtctagcccatcttcactcaagtctgtctgcttgaaatttgtgaatgcacatgggtgtgtatgtgtgtagggctctaatggtatgaatttctacttattagtgtctgtgtacctgtaattatatttatatccatatttgcgtgcatatcaatccttcaattactctactataagacacctggcaactttgacctgctggcacaaataataaccttgaagagcgtgtaaaaatatgacaaggaacagccacaaaaccacctgtaaagagccaaaatcaggaagattgcatctgatgagttgaaactagtgaccggctgtggttgtatactgacttctaagctgagaagcatagaaaaacaaatggggaaaaagaaataagagaaaagagaagcaggcaaattttaaagaagcagaaacaagaaacaagggcaacaaagtacagagaacttcaataataagaatgatgaaatatgaagtgtccttgggtaaaatgagagccagggtgggaaacagaattatggatttttaaggatttcttcaagttcattaggctggaaccctttttaatgtatcatgagcatgagggaagaggcagaaggaatacctgagctgcccagtaatctagatggaggggcacagtgagtatcattccccatgactctccgcctggcaactctgagggcatcagtttgttagtatcatttgattagacttgtgcaaacccattcaaacttatcaggcccttcgccatgcttgttataaagactggctgcaatatttgttttatatctcaataactgtgcctgaattgtaagaagatttccaaaagatggtggcagtacgcgatagtcacccaaatgaattccaaggtgtagacttctcctaagattcacgtcgtagctttctgtttttttgtttgtttgtgtgtttgttttagagacagaattctgccatgtcacccaggttggaatgtggcgatgtgatcctggctcactgcagcctcaaactcctgggcttaagtgatcctactgcctcagcctcctgagtatcagggaccacaggcttgctgtagatttctgttgaagcctatcagagaaactttgtgcctatcactttcttctcattaaaaagaagtattaaatccactaacataagtcacatttaaccatttaagagtgtgatttggtacaaattttagtttaagggtaaactgttgagatacagacatgtacctttttcctcccttaaaaagaatcctgtactgttctgactgtagtttttaccaaacttaatccagtgctcaaaacacgatggatgtatcattctttgtaaccagtcatgaacgttagctttgaattaacgcaatcctagcaatttggttcttaccaaattgtttctcctatgagccccgattggctgcttctcaggaagaggaaaggttttttgtgtgtctttctagttcttatattcagctcacagtcttttttttcccttggctttctgctgtaagattttggttttctttcccttcagatgaaaaatataaaatacactggctatctgggaaatagacaactttttctttctggttcaaacaacaacacacaggcactgctcttctttctccctgtaggtctctcgggaggtcatggaattgagcctgcctaggtggggttcagcctagtatctagaatctacctgcacatctgaggttactcaggggaggtgctaggaacatcaacataaacacttcatatgcagaatgcttctgataatgtgtttctcagaacagaacaaaacacgctgttcgaagagcatcaagtgagttttcctgcggtactcgagaggcaattccaaccataatagagcatgagactgtcaggtatgctgtcagcccagcatacacatgaacagcaaagctgcccaaggggtaggattgaagccctcctgagctgctgatgattctactgaaatacttaaggacaaaatataaggaattcacactgaccttagtggaggctggtgtggggctgggaagagggctgtgtgctctcagtcactcttgtgcctctgcctttcctttttgttccattcttgtcactccagttcaggcccccatcacctcatacgggaaattatcactgtgacccttgaatttcttattctctttcaggaaaaaaagccagtgtcttaaccacgacctgcaacacagcatgatctggcctgctgttatcatctgacctcatctctactccccaacactggcccccagccactccttagcatcctgacatcctcatgcctctgagctttgcatggctgtgccctttgcctagaatgtttttccgccagatatccacgtggtgaactctctcacttcctttgggtgtttgtcaaaatattcagtgaaaccttccctggtccacctgtctacaacttcaattttctgctactcttgatgtttcttatctccctttctctctttaattttctttttagtacttatttctgtcaatatattatatactaatctctcttgtttgttgtctgtctctcacaggagagtataatttctatgagatcaaaacaatttttcagggctgggcacggtgtctgatgcctgtaatccctggttctgtctgttttctctccactcctgcaactgttcccaaataaatattccaaggtttaactaacctgtagacacaggtggcatcacatgagccgcagtaatacagatgcaactgtttttaactctacgcagtctatgtaagacctcagtcttctgcaaaatagcccttctatcagatagtcctgtgggtccccagaagatatctgatttgtgctcacaaaaatattatagttgttcagctataattgtcatgcagcctctatgctttctttttctttttcctttccttttttttctttctttctttctttttttttttttttttttttgagatggagtcttgctctgtcacccagcctggagtgcagtggcacagtctcagttcactgcaacctccacctcccaggttcaagtgattctcatgcctcagcctcccgggtagctgggattacaggcgcccgccaccatgcccagctaattttttgtatttttagtagagacaggcttttgacacgttggccaggctggtcttgaactcccagcctcatgtaatcttcctgcctcggtctcccaaagttctgggattacaggcgtgaatcactgcacccagccgcactattttttccctattgtgggcagagggcttccattcctcaaacagtctgagggcacctcattactgttgcttttgggattgcttattacgagaatgtctatgtcccggtgggggttttgtctcctaatgtttcctaagccaccaattctccagaccggggctgattgagggttaagtggggagggagccctatgtcagaagccctttctcctttcttccctccccctttcctttcagaataactgtgtcaggcagtgttcttggttctcagtgctggaatatagcggcatggaaacacacagagaaatctccacctctctgtaactctgtaattttgaaccccatggcttctggggcgtagttctgtttccccttctcatgaagctcctcatagacagctcctctggcttcttaacacagccagtgtacctacttcccaggtttgagggctgccagcaacccccagacacaccgttcaaacctccacactcaaccaccagccctgagcccagtgactcctgtacatagacacccaggagcccaggaattgtcccgcagtggacatgccaaagcaggtctccatgccttttcagaggcgtcggtgcctactacgtaaagagacttcagatctttttcctgctggaatgcctttgatttttttgaatatacatattttaagcccaaattaaagaatttgctttctctgctagaccctttttactggttcagcctcagattttgccctcctctaggtgacagcttttcttgtctgggctgttgttgagcatgtcgccatgtgtggctctctcctgtgaatggccttttctaccaagttcctcttgtctcctcaagtagcttgccagctcttgcaaggacagaagcttcctcctgtttatatcctgtacagcactcacatagtcttatacacatagtgatggttaaaataattggtggactgaatttccataaatatattctggaaaagtcagcagtaacagattgtttcagccatatggaatcttctcttatgtaggataactcaaaccatcatgattccagatacccagcatctacagattcaggagtattggtgtatatctgagcattgcatgagtattttggtgtatcctttgtaagagtctccaacccaacttctagttgttcctactgcttttcttccagatattctgagatacttttggcaccatcccttatcaagggtgttggttgttgggggctatctcagaaggtttcagcctttaccaagtccttgtctgtccacagatcacattgcacaaacacatggagtctttacaaatgaaggcctgccctccaacatgggccaacactactcagggtctgggctgggaccttttaacatggagtgaggtctctctgcaattgaacctctaaggagaggtctgagtttccactcgggtcacagactcctccggacatgtggcatctttgctccttggtctggaatcatgagatcctgttgtcatagacagaatgagtgatatactgaggataaaagaagtgtgctgggccgggcgcggtggctcacgcctgtaatcccagcactttgggaggccaaggcaggtggatcacgagatcaggagatcgagaccatcccggctaacacagtgaaaccccgtctctactaaaaatacaaaaaattagccgggcgtggtggcgggcacctgtagtcccagctacttgggaggctgaggcaggagaatggcgtgaacccgggaggcagagcttgcagtgagccgagatcccgccactgcactccaaccccgggcaacaaagtgagactctgtctcgaaaaaaaaaaaaaaaaaaaggagtgtgctggaacttcagccggccaccctcctggcttgtccaaaatgttctatattcctttgaagaaaaagggaagcctgcatgagtgatggtggaggtcgggctttggccctgaaatcatattaatggaactttcagataatgtcattcttcatttttcctaatgccaatttatagattgcatcccagactccccagagaagtagaatttgccaaatatgcttgtcatttcttctaattaggtttttaaataaatcaaagaactcttgttttcatttaccttggattatacagcaacaatcttgttgtgtatgttgccagagagacaatgcctactgagaggacaccagattcctgacattctaagagcttaggaaggttcctcccctccactttcctaagcattccattagccccgccattgaagaggaggagaggacagtcctgcctgggctgcatggcgcctccttcctacccatctccaagatgctgctgtggaccgggctttgtggtctaaaagggaaggagaagggggaggaggagagcactctcctggcctctcttgcagtttcccctttgcttgattttcagccttccctcggtttctagtcctcggggtgaatcttcccatctaggaggctaaggggtagagaaaccatgggggagaaagctgggaggcagctgggggtaggcctggcccagcaacctcctctgtccttctccttggcttctcaccatgtggcccccctctggccctttccccagcatgccccatctgcccccttatgcactcacagtattgttggtttctgcctgaagcccctttcctggctgtcatccctttgctcactgtggcctcatagctggtgattccttgcattacgtctgggaattctggagtgaggtgccatgagctcagactttgccctggtgtttttggtcctgcagcagcctctggcctctgagctcctctgagatggggagactaagaaccggttgccatgctggctcttttcctactgccttccccatgtcccatctctggtgattccacctgtcgaggtgggcaagctcagtgggagctcttaggaccgcagtagaagctatgtagtcagcaggcagtgcagttggccccactgcaagaagaaataaagcttgccgtgtgcctcattcagaaggggacagccagccttgttgtacctgcttcctgggtgtcaaacttctgacaattgggaatgacagatatttaattttacttaccttgggcagcaaaaaggccccaatccttttatagatcatgggcctgtgaaagtagctaaccccaggccctgaaggacccacccctcttctcctttcctcccctctcctctcccttctctcctaccctttcccgtcttttccccttccctctttttcatctttatttttcatcatctttcccatccttcctttcctgtttttctccatcaaactctctcaactcccaccagatattcattgttacttagcagaaatcacatatcttgctcaaaggaagaaaaaaaatagctttcttggtacatatagatcagggacttaggcaagggaggtagttgggtgggataggattcaatattaatctctttattagggacaattgtatactctctaccactgcctgccactgatgcctctgtcctcctcaatccccattccctgctccagtggtctaaagctgtgacagtttttctcccttgcctgctatgagctgaagattggtggagagctgtcactactttcaatgccagcagggcctgcagcatgggaaatatgtaggatgtgttttctcttataaccactgtatggctgctggtgagatcatgcccaccatcctaaaacctagcatatatattattgtgttgttatttaagtaaatgttggtcatgtttttattagaacagtgtaatataatggactgtgatctatactgtattccatattgtcttagtttaaacggatatgttcccccctctgcccaccccgtaccacacacctacaaataagtttcttttgaataccaacaccagcaaaatcaggaaacccttagtaagggtgcttaggtgctgtttgatatttaaggcagtaagctcaactggcctttaaattcattgatgagagcaaattattgttttttaaataattttaatttttaaacatgtttcatgttctaggcaatatttgtttaaattatgtttttgtgctaggttctataacaactgtgtcccaatgtaaggaataagaggtaacctactgaatgcttcttttttgagatggagtctcgctctgtcgcccaggctggagtgcagtggcgcgatctcggctcactgcaagctctgcctcccgggttcacgccgttctcctgcctcagcctcctgagtagctgggactacaggtgcccaccaccatgcctggctaatttttttgtatttttagtagagacgagctttcactgtgttagccaggatggtctcgatctcctgaccttgtgatccgcccgcctcagcctcccagagtgctgggattacaggcatgagccactgctcccggcccctactgaatgcttttaagtgacttttcttggtttaatttatcacctttcgtagagaagtaagcactggctcatataagttatttgggaaaaagtgaatatttgtagtatttagaatgtccagattcctgcatcttacctttgtgtatagctgggaacttaaaaatgaaaaattgcaacctaactaagcacaaaattctaggtgttttgggcaatttctgtccggaagcttattatccaactacttcaaataactttaaccagttgaaatgtagtcatacaccgtgaagtcagtgattaaaatttccgatttgctaaaacagtttccctcaattaaggaactaaaaatctatttacttttctactatggcaaaagacctgggacctttattcagaatttatttacttaattttacatatgattgtaaactgtaattatctgatttctcagattaaaagctgttgagaagctgccatttaggaaattgagagcaacaaaagacagcaacactgactcaaaaggagctctacccaaacagaaggacaggaaagagaaaaatgactgttctttgtacagtgcatcatgttgtagtctttatgaagaaaaatttagaatatggtttatatattctgcctcaaaaggcacataagttcataatatattttaagaggatcttttaaaaatcaatatagttcagttaaaatcagttttagaacttacagcactcgactccatatattatcatctgcggaacgttgcacttcagtttttccatatgaatgatgttagtgcatttacatgacgttccagaaggctgagagatagcatatcttaatgcaccagttctcaaattcttctagcccagatcccttgtgcaaaagatgttttgactcagaatcctgatttgtaaaacaaaggaggaggcattgcatttcattgaatgcatgaggcttcctgagttttctccgcatcttccttccatcttcagtgactttcgtaacagactaagaaatccctggaactccatagaacttaatgcagagcgtagtgtcaagcacgaagctagactaggacaggagttattggcaaggagggaggcttttcaggcatccttaaatcacagcctgtaagtggttgcctacctgtggtaatattgcattgcttatccacaatgtaatttactaggagtttcatgggaaatgaatagactaaaatcaactccagtttcctttgtgtcgctataactctgattagcaatgtgactcaaatgccccatgcattttccacaggtggtgccaaagcagtgattcgcaccaggatatccataggaaacagaagggaaaccatgatttgcttatgggtgctctaccctgtagagcaaaatagaattttttgattgtccttttgattgctactgctgtgttactacgattactactgtatgttttcttgttcctccccctccttctttttctcttcttcttttcttttttagtagtagaacaagacactgttcagtagtgtagctagatgctttggtttcttttatcattgttatgtgcaaaagcaattgtcaaatgtatttcatgtgctacaccatgttcttccctcaggaagaggaaatccgagagtgataaaagcatctgcaagcagaataaaggaatctcagtcagtggatttcttctacaagtttcatggcagcggtactgcagtgttttaggttctttgttggtggctgataatgtgtaaataccccatgttgaatgaatgcagctgtccaagacctatgaggctgcattttctttcctaatcctacccctccaaagtggtggtttgcagctcttcaaatctctggccgcagcaatgctttatttcttctcacctacctgacacagttgactcaaaaattatacctcagcaggggaaaccactcctcggaaggggaaggttgccagcaatctctaagaggacaggaactcaggacctttcacacttggatgctttgatagcccatctgacagacaggcttagttatagtacatttctttcaggctcaaacacagaaattattcatacaaatcctccttccagtctgtcctttatagagagggctgaactttcctatcttagatcctgcatgacactggcagtcatgaaatgtagattctgctcattcatctctctccatgcagtccattttttatcattagagaaaaagataaactttaaaaagttttatttcattataattttaaactaatactgactgtcagagaggccgaattgtgtaatgcttataagcatgagctctgaagccagaccacttggccctgctgtgccttaattcactgaccttgggcagttttctcatcagtgaaatggaattaagaatagggcctgtttcatagggttgtgagggttaagtgaactaccatttgtgaagtgcttataagaacagatagcaaatactatattcctattagcagcgtttcctgcttttgttgctattcttattattgtttcctgggcgtaaaagctgaacttgccttcctttacttctggaagatttgggcagaaaccgaagtaacttagtctagactcatgcctgggatagaagcctaaaatgactggcccctggaaatctagactctttggcaatagggaaagaatgcctgttttcaacttagatctgagtttggatgttggtcttgccccttagctacttgagtgataatgtagaaaatattttaaaatggaagagaataatgcctatattgtaaggttctgaaacttagaaatgacagaacaaagagccagttcttgttatatgctcaaaatattggagctattattattattatttgaagagacaatctagcccaccctaaatcatgcagatgtggagctacttggtgagtgcagagactgttgataaagtttgtcagtttattcaatatttaagatgaagttttaaatttgctttgtaatagaaataattacaatgtttgctgtatttatgtatttattatatatgcccactttaatactagggaactcttcagaacagactgttaacatttcttttttgtcttttgaattgaatattgtagaaatcagctctcaggaggaagtgtgcagtctgtaaaatcgtcgtccacaccgcctgcattgagcagctagaaaaggtaagagcgcgccccctgctgcagttttgttacattgcaagtatttggtcttcagaggcccggtgtaaatttccagttccaactttttgaaaacaatgcccttaaaaaaaagctggaagtccaacattattaccagattactaatggaaagacaatgtttaagggtcgttcactctcttgtttgctgaagtgtaatttgatatcattttacgttgactcttgggaaaaggaagaacacagttagatggaaaagcctggtgtgcactgattctcttattatatcatctcagttcaagcattactatccacccataggctgttccacaagctgtttaagaaggaagaagttctataagctgtttataattgttgttcacatatatctgacttgtgtggtttacgtcttcctaaagtgcctgcaagggagcgagccacgctggaagccggctctcactctgctggggcagtgctcctcctgttgctgctcaaatgtgtgggtggggctggaagtgacatcccggtggtggtgtgcctccagaatcagtggattcggcaaagtccatttatttgtcatttaggggatgggaaaggctccaatagtgagttgcctgccatcctctttcctttcacacttcccactacattttaatgtgtgtgtttctctgtgtattatctatgttcttgagctgtcatgggtaaatgcattgaaatattttagtcccccatgacattcatgtagtttcactgacatgaccagttgatcctagctgatatcttgtggcaatgactaccaacatgttatcttaatattttcttttctgccccaacttcacttactcatctctgccttcattcttttgctcctttcactttatcgagtagctaaccgaaatgtcaatgtgcctactaggagacctccacatctaaaagaaaagcagtgctgaatccttttataaagaataactctgggctgggtgtggtggctcatgcctgtaatcccagcactttgggaggccaagatgggtggatcacgaggtcaggagatggagaccatcctggctaacacggtgaaaccccgtctctactaaaaatacaaaaaattagccagatgtggtggcacgcacctgtagtcccagctactcgggaggctgaggcaggagaattgcttgaatccaggaggcggaggttgcagtgagctgagatcacaccactgcactccagactgggtgacagaatgagactccatctcaaaaaaaaaaaaaaagaataactctgttgtctttgaataattgtcataatactaaaaaaactcaagtttatattttctacttttacaatcagaaacccagctgggtagtttaagctgccagtatctttcctctggctctttcttatctcagtttctcaaatttatggtgtaagagcattatcgtttaaagatacttagatttgatttgtgagaatgaaggaaaggggttggagatatagaatcacctgggatctctgttgattatctaatgtgatgatttcaaaagactaagaagagtattattccttgttctttggaggttttgcttttcagtctcaatatctgtcactgtttttttttttttcaggtaattcagtctagtctgatgcttatctctaatataatatacttttctttttgaatgacagattaatttcagatgtaaaccaacatttcgagaaggaggctcaaggtcaccaagagaagtgagtatttcagagcttgatttcaagtatcacctttgatttctcattgattcagtggattcatagatattcaccagggaataaaaaataaattctatctctttctgttgcatgccaattttttgttaacacatcaataagcacaatcaataaaatcttcaagtcttttcaacatgtgcacactggactttattctcataaaatgtactggggagtttaaggtcttaccaaatgaaccagagactagaggaaggtggtagtgatagaattgaaggggtaagaaagaaatagacttttattacttatttatttggagacagagtgtcgctctgttgccatgtgttctggttgattttaagtgcatttttcaattttgagtgggtataagccattcatggggcagcacagtaactggttattcctatgagccctggagtcagacggtctgctttcaaaaccagccttgatgtgtgtgatcttgggcgtctcacctaagctctctaaatctcagtgttttcatttgttaagtaaaaaataaatacatcataagctagaactatattcagttctcagtccctgaccctccagtctggtcgtgaagataaacaggtaaagaggaagttagaatgaagagttgttactgatgtgttagtgggaagcagaggtatgacaagaggagacagcacttatttgttcacattttatttagcagagacagcaagcacagttcaggcaagaaccctcctgtgttattctggacagttaagctccaggcccaaaattgcactccctaatcagtgaaacaaaagcctgcaatgaacagaacctgtcctcctagaatgtagttcagcctgcccagcagtcactcactgcctcccaaacattagcatcttatacggtatcctccttaagacaaagtctggtaaaaatgatttctgataagcatactttctcagggagacgaggttcagttccacttacagatttaccccttggaaacctccccagctggtctactcctcagatcagctctgtgtagtaacaaataggaaagagaggagaggggtcagagaaggggcttcctggaagaggcggcaattaagctgagaccttaaggagctaactaagttaagtgagaggagggtggttaggaggtgagtggcaagagccttccggatagaaagaagagcacacaagtccaagtgagagagggtgtactgagtaagacatgagatctgagatagcaagagctggaccctgaaggtccttgtaagccatgctgcaagttgagtgttttatcatcaggatagttgggaggtgagcattaaactactttaagccaaatattgttcaggctgcagcgtggaggaaataccatgcagttcaagagttggaggcatagagacaactttcagaagccatgctagtaatctaggcaagaaataatggtgacgtgaactaagaataacgttggtagatatgagtttgaaggaaacaaaattgacaggatgtagtaattgattggattttggacacaagaggagcccagactaaaccaagctactgctaagtgcgcgcacgcgcgcgcacacacacacacacaaacacacatacacacacacacacacctgaaaaactgattagatgttggaaaatgagttgatttgaggatgggctggggaggtaatgagtttagttgtagaactgtgaagtgtgaggtatccctgttgtcctcaactggagatgcccaatagaaggttgagtgggtatatgagtttggagcttatgaggaagactgggctggaggtcaggcattgtgagtcatcagcctatttacacagtaatgaaagctgtgggaatagatgaacgtggagagtggaaataggagatatctgagaatcacaaacatttaaagagagttgatgaaaaaagacaacatgaatatgaatgctataattgctagtgacaatgcaaaaggattgggagaacatgtggaaagagagtaggttgggatggaggttgtagaaagagaaaacatagttgtccccatcagttgtcttctcccattgtgtttgtgcagcatggcagcaataggaaggttgtgggccatgcgcagggtgaggaaagcaggagaagaatgatagggctgtggtgcctcagtgccacccagagtgcagacagtgtgggccagaaggtaattcagtggtgactcaattgaaggaggtgctttatttaggaaactagaaggggttgtttcaagttaagatggagtttatgactttccaaccaggggattcatatacccacctttagcttcctgccctccaatatgtatctctctcaattgataggtcaatgtggaggcaggggaagagagaaagagagacaattttaatcgtgcaatttttctaatacaagatgcttttggttttcattagtctgtaccacttctctgaagctagaccttccataagggttttggatattctcccttgtcttcttatcaaggacttgaaattcctttcttttatatattttcatcccctcatttctagataatttctatcagcataaacacactctaataatttctatctttaaaaaaacccaaaaacattccttagccacaaactgtgtcttacctactgctctaattctcagttttgtggtcactgccaagcttccagaaagtgttaactatataaattattttcggtatgtcactttctagtcattgtaacctgttctgatctgatatctactctacccatttactgaaattgcttcttttttcagtgttgcctatgatctcctatatgctaaatgtattaggtattatttatttttctgttctttccttatccagtctctcaaaaatattcaagatactacatattccatcctttttggaatgctctcctctcttggcttctcacatcaccctttcctaattttcttcttgtttcatcagatggcccttcctattctttttcattgcttcctcccccaacctctgcaaatccctccgagcttagttcttttctatgttctcttccgtctgcccactcctgttagaggagcttatccagtctcatggcttcaaataccatgtgggctgacaactcctaactttacatttccagtctgcccttcttggagttccacttggcatgtcttttgaatgtatcacagtcatctcaaatataatacatcaaacactagactatttccatcaccataaaaatgattttaagaaaatcgtatgcacctcaggaaatgagatggctgttaatctggcttctcaactgagaaaactggggagtcatgtttattccttctctcatagactccccacatctaattcatttgcctgtcctgtcaattttatttataaaatatatttcaaatccatccaactgtctccaattctgttatcagcaccttaaactaagacactgtgacctctcccctttgaccaatgtaatagcttcatgattcttcagttgtcactttcaatccacccatgacttaaaggagtgatctttcaaaatgaaaatcagattattaggttggtgcaaaagtaattgaaagtaatgacaaaaaccacagttacttttgagccagcctaatataattttccctggcttaaaactctccagtggtttccataactcttagagcaaaagcaaaccctctgtcttggcatgaaaaggtccacattgtctggcccctgcctgcccttccagccacctccagctcccacatgaactttctttccatttatgaggcatataccaagatattccccacctttggatatttgtgtatttcactgctgtactgaaaatctctttgcgtgactgtttcttacagttaggcctcagttcaaatatcatccccctcagccattgtcttagtctgtttaggctgttgtaatgaaataccatggactgggtggcttataagcaacaaaaattatttctcacagttctgcaagctggaagtccaagatcaatgtaccagcgtggtccaattctagtgagggccatctttggggttgcagactgccaccttctcattgtattctcatgtggaggaaagagggtgagagagctttctgtggtctcttttataaggagcctgattgcatccatgaagagtctactctcattacttgatcacctttcaaacaccttacctcctattaccattgcgttggggtttaggatttcaacataaaaattttgaggggacacaaaccccagtcctttgcagaggtcttcctttacaaccacctttaaatacatagcatattgttctttatcaaagtgtcttgttctttcttttcagggcactttgtataccataataatttatgcatattactgtttgcttgtctaaagaatatctcccttctttagtgtaaattttgggagatcactcctagattttgtcctaaattaattgcaccaaaacacagagtatgtcactgatggatatctgctgactgaatgcatttacaaaggtattcatttctctcaaaatgtttatgaactcttagtctaaaaggacattttgaagatgaaacttatgactcactgactatgacccatttgatattcttaattaaaaattaagaattcttactactactaattcagatgtttatttagtaaatgaaagaacatttgctttagaattagtttgaccctagttcacattatacctctgcttcgtttccactaagtggtaagagtctctggagcacagattgttggtcactatgccctggcatttgcatagtgcctgacatgtgacaagttttaaataaatatttgttggagtcatctaagttgaatctttctggatctcctttttcttagtcataagccataacggactgggttatgatttctaaggtcctttcaaactctatgaaatatatatatatatatatacatatatatataaaattttttatttctataggtttttgaggaacaggtggtatttgcttacgtgactaaattctttagtggtgatttgtgagattttggtgcacgcatcacctgagcagtatttaccgaacccaatttgtagtcttttatcccagttcaactggctgtttgaaaatagccaagcaattgtattgtgtatttttgctaacaatactgaatataagccctgaaataatgcattaccaatattttaacacctgtaagtaatagccctttccttgcccagtacttgaagttgtttatgaataattcagaagttattgacgagcaataaaaaggttttatggtgttagaagccttgctttgctatcttaacaacaatatatcaacagtcacatttgcagtgttaaggatcctgaatccaatgtcagttcagcaacttaggagctcttaataatggtcaaaagaaaagagtgtgagaaattaaagcacttgggatatgaggattagaataaatgattctatagtaactttttttccttatcgatgaaggcaattgatgatcctcccctcctccatggtaactatgtgatttaatcgtcaaagaaattaggtggataattccattcaattcaacacacatatattggatgtttgctttgttcaaactataattaagcagcagtagaataaatttatattgggcctaaaaagaactctgaacagaaggatgctggacatctcaaatcgcagagctgtagtttggagacaattactcattttcttctacgatagtgattttgtataagttagtttatcaatccatgccttagttttcggcttattttctaggaaggatgatattaaaaatatttaataaatggtagagccatagagagtaatatttaaataataatttttaaatgttcttttttattccctgactaaactatatgatattctacatctgcttaccaaattatatacagtagtcccctcttatccatgattttgctttccaaggtttcaattacccaaggtcaaccacagtccaaaaatattaaatggaaaatcccagaaataaacaattcgtaagttttaaattgcatgctgttctgagtagcacgacgaaatcttgtgccatcctgctctgtcctgggatatgaatcacccctctgtccagcatatccactacctgcccattcatcacttagtagttttctcagttatgagactgaagaatcgttgtatatgtaaagtttggtactatccctagtttcagtcacccactgggaatcttagaacatacctcctgggaagaagggataactgtgtgttgcagtgcaaatgatgaagtcagtgttaagatttctaaataattgttgatttatggacagtgttggctgactcttttgagtagagctgttacttgctaaatgatcccatgagtcagccatgatttcacacaggtaattgcatcaaatgtttccaacatgtttcttcttaaattgatagtcattaggtgatttataatctcaataattacagatttttttctgaacatcaatgatattgttccttttccctcggcttctgctacactaacagcaattatattacatttttctattctgtatgatactgtctgacatttttatatattcaatatttctactactgactgtcattgaaatcatttgttggtgtgtcatgttgaatagcgtgagccctgttttgcagaacagaggaaaggcacagtgacacaatggtaagggcacagattctgctgccaccctgtctgggtttggaccctcactttgacctttacattttgagtaaccacttctatgcattagtttccttatctgtaaaatgagaatgatgttgaccattcaagtcaagccctctgataatgtgccctactgtaatgcgaattgggatatgctgcagttggcagctggctctggttctccctaacccttattcctaagcaggcagtggactaaggttctcatcttatcggttgagtaggcagatgctaaaggtgtcagcagtagcctcagctgcaaagtaaagaggtagagggtccagtgccttcatcctcagtagaatttttgcactgaactgatgggatagatactgataactgggcaggttattctagaattgccgtcactttcttgaaagccacagccagccacaggacccagaattgtccatccaggtggatatttacgattgtacatacaaccaccaccagctgggcccagcccagcattctgagattctttgggggaaccagtaatattgctcagacagcatgatttgttttcagaagagagagatcattggaataggatcctggagacctattatgtcagaaattaacattataattgcttaataatgaggaggtagaagtggtctctaatgttgaggtgatgcaagggaggagtcagagagatggtaggggcactaaactgcaatttcccaatcaacatatatttcaatatttcaacaactcataggattttactgatatattccaactaagtggcatctctactcatgaaaattctcatgaagattagaagaattattacttataaaatattttttaaagcgcatggctcacagtactcaacaagtgttagctattataattagcttctttcttaggacaatctaagcttgtgtctttgttttattaaactgtggtagtaggaaaagtgagacaaacattagactaaattgtgggaccattgtgcttatttatatctgattatagttaaaagaccattgttcctccagggtctttgtttagttttagtttaagtggatttgacattattaagagaaatagaggtggcatttcagtattgataatgctaatgcttctcagtggtttcttgtcactctgaatttcatgccttgatatataaccttttttccctctacactgatctattttctgtccatctgtacgtactaatagaacagtgccttgcatgtaggaaaattttgaataattgaatatatattcaagtggtttttaaagagaaaataagggttatggctagaccctacaatagacatgttagaattagataaagtgtgttttcccagaaaagggcaaaagaaaacaatgagtactttaggggtattggtgtcagagggatgaattgtttgtaagttattagggcttgcctgcattcctagtcctgaggatgactttcttgtaatgtatcctgagaaccagtggtgaatggcgctgcttgactctgccccaggagtgcttgtctacttgggaggaagaggactttctgtgtttcctacagtctgagacaaagatagaccttgaaagctaatctgtaatagttcaaggtgcccaaggatggtttaaacacaataccattgcaaaaacatcattgatatgcttgtatctcttgtccttgacatctcttgccttcagcttttctctttcttcactctatctagtgaataattctcacgtctatgtcttgtattaggagatctctttctgagagtttgatctacattatctctagctagaatgtttggtatagtgtctgcctgccacagataaagcactacatacctatttgttaaattgaacctggatattgttgtttcagcttctccccttcacctttccacttttgtttgggtatttcttttacctgcctcagttacctcccagctcaaggtcctctactgtgttcacaaatctgcagagtgtttgactattaagacagtagagtaactgcaatctcgtgtggccacttgccactaggaagacgtggagggagggcatgagaagtggaatctacagatatgaaagatctttggggatggagaagtaacttaatttgtccacgtagattcatgtttattgttaaacaagtcatacccataaatatttgtttctgggctcatctgggcttagatgatggtttatataaatcaatagtattaccacattaaaaaatgaatcttgagatttgcaaattaaaacatactcaatcaagtgcagtagctcatgcctgtagttcccactattcaggaggctgagatgggtgaattgcttgagcagaggagttcgaggctgcagtgaactatgattataccactgcactccagtgtgggtgacagagcaagaccctgtctatagaaataaatttttaaaaatattcatttaattttgttttcccacagaattttgtacgtcatcactgggtgcacaggcgtcggcaggaggggaaatgtaagcagtgtggtaaggtaagagcccagccacctcatggcctcgcaggaggctccccaggcctctgcaagcaactgaggtagatgagtcctgtccccaaatccagtgttcactgcatcagttcctttctgaaagaccttacttgtccaggtctccttaagaggcattgtagttgttctagaactcactgcatgaggcaatggtgttaataaaaagaattagcacatttttaagatacctggatgcattcttacagtgaatttcattgatgatttttgaaaacatgactgttttgtgaaaatgccttcatgaagacaactggctcatcgtactttggccaatcgcagcaaatcaatgggtttgagcaacactacgtttgctaatataaaattgtgtttgggcggaactgtttaggacaacatggtcagaagctagaaatgtgttgctcccttgggacattatccagttcatggaagagatgccctttttatttgtggttatttatatctacctcctctgtcatcatggctggttataggtccctcaggatgcagtgccacttggaaaagtgagctggagcaaggggtgggggtgttgtgattgtatactattaaatgccatagattccatgtgtcattgaccccaacagatttgggttacagctttttccaatgtacaaagatctactttaaggatgacagggtcctctgggagggttaaactggtggcgaatatcactataagtatgtatagtgtggttcaccaccaatttaaatgacattaatagtaagctgatggtcatcagtaaagggaagttttgatttggcagacagcaagataatttggggggaatatcttcctaaataattaattattcctctgtttgtttattcatgtgactcctttgggtcaagcattggtgtgagctgcccagtgcagcatttttgacagtagagcaatgcaaggaaatattggctgcctgagatatggttgtggagggtgagggagggagacttggaaaaaattgcattaattttgctgttttgcccaatgcctgggaagaaaatatgctgtaaccattggttatgaaggtcttctctggaaggctacacaccttagcctccagggcataggcctccattgtaaccagtattttgttctccagttcaaccctgtggctctcagttggttctcttttatcctgtaaagaggatgaacaaaacagggtgaaagcagggtgaaataaaacaaagtaaacaaggccgaagggggaagtggaaagatttgtactgattcttattggccatcctacatgtcctggggaaaaggaggtcacacctctactctcacatgacctttctctcttgggtccatcaacctcttccaaggtgttgccttggggcttatggattttcttttacttcaagaatcatcgactgtaactttcccataagtgtgcatgtgtgtgtgtgtgcatgcatgtgagggtaacagtatgctgcagccgggcaggcatagccattttttgggtcagagatgtaaagagtagtaagaatctggatgaataggtccttcactttggaaaaatatcttcactggagcccagtagctggcaccacctcaataatgtaagccataatggagtgggagggattttattaaaagaaaatcaataaacattttatactttgagacaagtgttccctagtgccatattgcactctcttctggcctcttgttggcatggtcaactgaacaggaagaactgggcttcctccaccctgagttgctgtgtgtcctttcctgccagtgttctcagccagccatcatgccatgagcacagctcgctgcacgtccgtcgtcagtggggaagtcagtgatccagcttgtcacatcatgtttcaaaaatattgcactattatagtcatctcttgtgtttataatgcagcttctccatgaattcttcaagactcaaacaattatgggatgggtgggattgtctccttgccacataataaattacccttccttggattccagcttccaccctggacaggaaagctatggctctatttccatttacagattaagtaatgaaaattcactccaaacattggtgctatacataattttcatcagtagtgttgtaccttcttattcatattcatagacttttttttttttttttttttttttttgagacggagtctcgctgtgtctcccaggttggagtgcagtggcgcgatctccactcactgcaagctccgcctcccaggttcatgccattctcctgcctcagcctcccaagtagctgggactacaggcgcccgccaacacgcccggctaattttttgtatttttagtagaaacagggtttcaccgtgttagccaagatggtctcgatctcctgacctcgtgatccgcccgtctcggcctcccaaagtgctaggattataggcatgagccaccgcgcccggcccatattcatagacttttaaacctcactccatcccccatacacacacacacacacacacacacacacacacacacacacacacacactattccataatttactcattgggatggagtgaagaataattgcttcacttagcaaaacttttttttttttttccaactgatggcttgcaaactttacagattttttaggaagtgtttatggttaaagagtgtttgtggtttccatttctgcttttaaaataaacaataaaatgatgtttggactgattttctcttgccttaaatatgtgtttggctgagtgtgtgtggcatttaacagagatcagatgagataactcatgatttaattgctcagttcctttaacgttagccgaatgcctcaggctactaggtttataacccttctgtggtttttcattgtcattcatagtccttgattacataagagtcagggtcaaggcagaaaagagccaaaatgctcaagttcaaattatgtaatttgatgagagtttaatgaggagaatatttaaaatgtgtgaaaagcatgggggatggtgggtggaaccacaagaaaaaatggagaacactgtgactaatgtcagagagctgtggtcaagctaagcctgaagaggtgaggagatggagaggaccccttcccaggagctgcaactttcagtcacaagactcagccagcctgtggtgacctagagcctggagaaatagatacccagtagatacccagctccacatatcttcatgttctagtggccaaacccaacagaaaccatagcacaagggattgtttgatgcaatccataaaagccaactctttacaatgagtcattgagtagagaaggatggagagtaaaacttgagaggcagatggaattgatctagcacatattgtttaatgcaaacctgtagtcaatcaatggttggaggcagaatgcatacttttgctgtaaacatgtctctgatcttcactagatctacacattgccttcattcagtcaaaatttatgaaacactgagttgtctatagtgcttcaaaaaatctatattcaaaaaatatagtaatgattatggctattttgactcttcattttttgagggaagcaaacatccaaacctagcattatggtaattgtgaaaatatgtttgtaaatcacaacttaaaagcttatcttttatttcttcatatgtaaaagttataaaaataaacaagctaactttttgaaaatcaaaatttaaaaatttccaacatcaattcttgaagccagttttaaatgcagtatacacattgaatatcccttatctgaaatgccgggaaccagaagttttttggatttagatttttttcagattttggaacatttgcgtatacataagatatcttggggatgggacccaagtctaaatatgaaattcatttatgtttcatgctacacttaaacacaaagcctgaaggtaattttatacaatattttaaataatcttgtgcatgaaacaacgtttttactacgagctatcacatgaggtcaggtgtgaaattttccacttgtggcatcatgttggcactcaaaaggttttgggttttgaagcattttggatttttgattttcagattagggatgttcaacctgtaatacatagttaaactttgtctacattttttatactgttcagttcctgtattaggctgttttcgtgctgtttataaacacatacccgagactgggcaatttacaaaagaaaggggtttattggatttacagttccacgtggctggggaggcttcacaatcatggtggaaggcaaggaggagcaagtcacatcttatgtggatggtgacaggcaaagagagagcttgtgcagggaaactcccatttttaaaaccatcatagctcatgagactcattcactatcacaagaacagtgcaggaaagacccgcccccataattcaatcacctgccaccgggttcctcccatgacatgtaggaattgtgggagttacaattcaagatgagatttgggtggggacacagccaaaccatatcagttccctaaccaaacatgctacattaatatgaattatttgtccataaatagtatgtattttcatatattgtttaaatagcatgctgtgtttattaaatgggaaaacatcaaaactactctttatttttagtaaatattgttaaaaactaacttgagagtgaacttagggtacaatatgtaaattatacacaaaaatgccaaagtgtttaaaactagttcatgggagtgcagttgggatattacatgggtagtgaaagggattacagagtataaaaataatggaaaatactgacttgggcctttcaggaatgtccccttatcaacttaaagcaatgtactctactaatctgaaaatgtgtaccctgggagttaaggttaaggacaaggaagggacgtttaagggtgaggatccatgcactcattgggcaggtttggttatttgcctgtctgtgtgtttgtgcagctatagcaaaggaatcctctcccagtagcctcaggaggattacgagtaggtagagagagggcagtacaagggcaaggaatccaggatgctccataaagcccctgcccacatgactgctggaagcctggcccttctctccttggctgagtatcaagaagggggacaaggacaaccactgttctactctctgctcctatgagttttgactattttagatttctcatactagtggcatcatgtagtgtttgtccttctgtgtcttatttcacttcagtgtaatatcctatagattcgtcctgggagggggaaatggggaattattaggcaaagggcacaaagtttcagttatgcaagccgagtaaggcctagagatctactgtacaccatagtgcctgtaattaacaatactgtgttgaatacttcaaaatttcctgagagggttgtgctgttaagtcttcttaccaccaccaaaaaaaaaaaaacctaataataaataaacagggcaggaaaacatttttggagtaatggatatgcttttgtcatggattgtggtgattcatgggtgaatacttatctccaaactcatcaagttgtgtacatgaagtatgtacagttttttaatgtaaattatacccccaaagaattttttttaaaagaaaagaggatgggggctaaagggtccttgctgcagtccccagttttcatctgtagaaccattttactgctgtcactgctccctgggtctttggtgtggtcactatcctggtcatcgcagcaaatacagtgccctggtcaccctggggccctttgttctttcttcagtagttcccgcccacttgtctaccttcttctggctgctgctgttgggcctgctggtacttgtgaacccagatgacctgcacggggagcagaggcccaaacctcaggccagggtggcaatgaggacacttcctgtcatggtgttcaggtcccaggtacacaagcaaatgacccctttgctccctgatcatgatgggggacatggtcccaaaaagttccaggtacacaaggtcccaatcccaaaaggttccaggtacgcaagcaaatggcctctttgttccctgatcagatggtcctcagagacaaatggcttctgtccttcttcctcacttcctcagcagggctgattctgcttctacatatttaccctcctttttggagaatctggcccaagtcatgtgtctcatgataaatctccggttttgattccagtctttttaagggactgatctcattgcatatttcatatgtttttgctctctctgttgctgaatttgattgaagtataaactagatattagcaagtaaaaacattttatcaaaatgactatttcaaatatagtaatttaggtgtagatgaacaatcagaaaagcaaatctaaacatttttgaaatctttgtgttcttctcctatttagaattactgtcagatagatgagatcatatatgtaaagcagtgtatggtaaatgtgcacctcatatttggatgccaggtgaggagagctagtttcctcatgaaaagcaaatcaattatagactatgtacaaataataaaaaatttagtattttttaagagagaaattagaaatatacagcttctctgccttttaaattaataaggcatataaaactgagaaattataaaaatatatacatacaacataataaatatctctgtataaaatatataattaacatgttatagttatttacatatgtaatgtgtatatatgtatatctatgtgcgtacatatgtatctgtgtgtacatacgtgtgtatatatacatatgtgtgtatatacatacacatatatacacacatatatatgtgtgtgtgtatatatatacatatatgtatatatgtgtatatatacatatatgtgtgtatatatatacacacatatatatacatatatgtgtgtgtatatatatacacacatatatatacatatatatgtgtgtatatatatacacacatatatacacacatatatatgtgtgtgtgtatatatatatatatagttgttcttgccagataagagactgaaaattcataaaagggcaaaaatagaaaaaaaaagaagcattggggaaatgaagaaaataatgacatttaagataaaaattggaggaggaacatgaacaaaatgtatatggagaggaaagaagagacgaagaggtgaaaggtgagaagcaaagggacagaaaggtccagagagccaccagcaaatgagtaagagtatctggagaatgaaaaggaggagttgtgaagccaccaagctgatatttacaagctgagctgtgctcattcctgggacacactgggattccctagggcaggcaggcttggaaaggggtaagggaagcagttcccaaatcctcatttaccgtttgtctctttattaaaacctgaatctgacctgcctgagaacacttttgtgattctttgcgctgacctccctttccaaattgcctttcttcaatccgcttatgacggaaatcattcttttcagtctttgccccaggtgtaaaaccctagggatgtcaaacagacatgaaatattgatgtcagaaaaaaatctcctttaattaaaaaaacaatgaaatgaaatatgatttcaaggaagaaaaagaaatgatataaaattctctcttgttaaagaaaaagcatgttatgtattctttaaattgaccaccacagtgatgagcaaagccagtgcttagtttatttataatccaggcagagaaatatgagctgaatagttagctgagaagcaaaaatcaaggttctgctgattaataattggagctttcactccctatagggcaggattaatccaaaagtacatccacagttgattaaacaagtcaggtaagtctaaaagtaccttcaagttggtttagcagttggttaggaaagttttttattttgatgaaagtctagtaaacaggtgtaattcttctttattagtttcagctggttaaaagcaattttggtttaaacacagcattccattttgatatctactaggcaagtggtattgttgagaggacagttttccttttacatggaaaatgtttcctttttcatggtcttctccaataaaaagataggcatattattaccttttcagatccaaaccattattttagctcagggttcccaagaaacggactcggagttgagatttatgtgtatgaagtttattgagtgatctcagaagtgacaccggtaaggaagtaaaagcaccaggactgggtagagggaggtgttgaactgtggggcagtcacaacagaggccttagccaactccatggggaactggaagagcccttcagagttacccggacttgaccttggccttgacccacaactgggcgagggctgtccttggccgatgtcttcgttcattgcattgctataaagcaatacctgaggctgggtagtttataaagaagagaggattatttggctcacagttctgcaggctgtacaagaagcatggcaccagcatctggtgagggcttcaggaaacttctgctcgtggtgcagggggaaggaggagccctgagtgtagagatcacatggcaagagagaaagaaaaggggtgccagtgtcacccaacaatcagatgtcactggaactaatagagaattcactcattgctgtgaatgcagcaccaagccactcataggggatctgcctccatcacccaaacacctcctaacggttcccacttccaacactggggatcaaatttcagcaggagattctagaggggacagatatccaagctgcatcagctcaagtgactcttttaggctcagggcaattcctgaagatgggagggtgactcatttgaagaccttcagcttccaagactcttctcaactgagggaatgagatgagtggctcaggcctgaagcagagttatctgggtggaaagccacagtattcaatactgtccattcctggtgctactcagagtaccttgttttgtatcgtacatttttagagcagctctttcagggttctgattggtcacatttcctgggaaacatagaagaggaaggatatgggataaactatagcccccatggttgcagctggtcttacatctgctactgatattcatcatctctctcctcaaccacttatcctggattcacctcactctcaactagtgcctctggtctaggtgacctacctggtaggcggaccaagaccgttatctctctgcagtctgattccctggtcttggctgctgcagttgtctatttattattaaaattgttcatagcattacaaagcctgtcccagcggatttcctggttaccagatgtattcttccagcttctgttgtcaggtaacagctagatctgtgcctaatgatcaggatcaattactcctgtcaggatgctggctcctttctgtgcctgctagtctcttaacacaaaaattccaaagtaactgggtgcagcagtagcttaaagtttaagagcttcctgttaagtcccatgacgaagaaattcaccgtcatgggatttagaccctcaaagcccggagctctggggaccagaagcacaaactcccaaagtgggccacagtaggcatagccactgttactttctctcactggtttctgtatttctgtattttgtcatggagacacagcaccatgaaatgatcatagatttagtgagtaaacatactgagtctggtggatggtgctcataggatattttctcaaagctgaagccagtgttatattttcaaaagattattccatctctctgtcaggccttcatcttctggatggtgtaggccgtgatagtccagtggatctcatggtcacatggccgcttctgcacctctatgccataaaataatttccctggtctgacacaatgttgtgcaggatcctatgttcgtgggtcacacatttcgtaagcccttgcatagtggtgctgactgaggccctgaagaagggagaggtaagcccatatcctgaatatgcattgattccagtcaagatgagttgctgccccttctaaagcggaggggcttcagtgtaatcagtttgcctcaaagtagctggttgttctctctgagggatgatgcaatattggattctcagctttggtgtcttttgctggcaggttagaaattcagcagtggcaggagccagctcagttttggtgactggccacccatgctattggacccacatatagcatccatcactccaccaagggtactgcacttacaagcccattgcaccatccatcaatgggatggctcatgacacagtatggtacctgcgttgtgtctaagattttagttcttacaaagggaaagctctctggtaggaattaatgtgcaataatcttcactctttgtacttactttcatatgtccttccttatacctcttccctagacctcctgtttccctccagggccctggccaaccagccttgccatttatcactgcctgtgcatcattatatattctatgtcaagccacctatcttttcacataaatgggatgacaatttgcttcacctgaagttatgcccatgaggaggatttcttattattcctgtctctaggacccactcctgagtaggcttcagtgcagcagtagtttacttttggcctggacgtatataccaagttgatccatgcatgaaccaatctcagcattttcctcctctttgagctcgtcattcagtactcccatttttccagaggtgagttgaatgagagacctggtactgtaataatagtggataatgtgggtgatctgagccacctactcatgcatccctggtactgcttgttccagatctcagatggtcccacttactataacaatggattaaggctgggctcactcaaccttatgatgtagtgatctgacagaactcagctcatgacacctgatgattcatggacaggtatttctccaccagagtacagtaacctgccagaaaatatttttgaaaggtgtatagttccctcttgcagatagcacaaccttgtttcagaatcctagagtctgtgttgattttcctattggtgcttgttataagcatcacagggcatcttttctccttctctaaatttctaatcacatggagtgacagggattctttcattgcaggctggacctgctgcagcactgtttcatgctctgggccccattctaagctggcagcatttaatgtcatccaataaatggatcacattcctaaatgtagaatgtgctgcctccagaacccagaaaggccaaataaagtgctgtgtttcattcttagtggtttaaattatgaaatgcaataattttttctttagattggagaggatattctagcataccttggactactgacccctagaagcttcattgacatgggggacccctgactcttcatagggcttatgtcccacctttcttctcaccaggacctctgatgtaccttccacttcttgctcatctgctttaatgtgatgctgctgatatggtggaccaaatgatgttctacagaatgttcacacagttcgggttcctttgcattagatctggataacattcagaagagttgaaagccctggtacatgcctgtaaaaatgtactgttaaccctgaaagcacttgcaaatagttttgaattctcctttcagagagggatggaaaaaattcatttgccaaatgtcatgtacttaaggctgaaatattctaaatttggcacagtggctgcaaatagagtgtactgggttaaatttgtgatattcaggcaccattctccagtctttggttttatgggatctcagctggtgaattaaatggggatatgttggagtacaccacctctgcctcctgcttcctttagtctttaagggtggcacttagataattttggaaatgtaaacacaataccatcgtcagagctttcaaaattaagataaatttaatgcctattacttcttaagaatgtgacattgattttgatttagttatggctagaaggatggtttgaagctttcacttgggcttcctcttacacaacagaccaagaaaccagtcttggggttgtgccagtttccaagtctgttcactccacttacacaattgaggacaaaggaaattaatactgatggatttgtggaaccagtagactctctgaaaaccagccctggtctaggactcctgctttttttttttttttttttttgagaacgagtttcgctcttgttgcccaggctggagtgcaatggcgcaatctcagctcaccacaacctccgcctcctgggttcaagcaattctcctgcctcagtggcccaagtagctgggattatgggcatgcgtcaccacgcccgagtaattttgtatttttagtagcgacagggtttctccatgttggtcagtctggtcttgaacacccggcctcaggtgatctgcccacctcggcctcccaaagtgctgggattacaggcatgagccactgcccctggttagactcctgctttttttttgtttaactgggcctcacgtttgtttgtttgtttgtttgtttgtttatttatttgagacagagtcttgttttgtcacccaggctggagttcagtggcatgatctcggctcactacagcctctgctccctgggttcaagcaattctcctgcctcagcctcctgagtagctgggactacaggcgtgtgccaccacgcccagctaatttttttgtatttttagtggagacggggtttcaccatgttggccaggatggtcttgatctcctgacctcgtgatctgcccgccttggcctcccaaaatgctgggattacaggtgtgagccaccatgcccggcctgtatctttattttaataggggaccattagatacctggtgctgcttcatacccagggtatacatgtcaacttgtacagttgtccattagtctttagaatatttggacatttctctctctcctcagcatacaactacccaagttaatggatgtaggtccttttagttaaagaccagaaaagtgttaccatagactcttgctgtgttattgtaagattcttctcctggggacttaccctctccttcaatcaatggattctgtctttgaaaactagcttaggtcgagaaacagagcaaaagattatgactttttattgcaacatctgccctcatctctcttgatcatccattcttgatgtcttctgattctattaattgaggaatgtctcttttatccgataatccatctttcttgtagggatgtcatgctatgttaaccatttccatagctctctaggtcaagtccccttgcaacttcaatcttacagtaagtgcacccactttgttttgatggtttagtgctattattttagaattctatattccagttactgtcagagtgcccaatctgtaaggtgtttcctagcatcaggtctaacctacgagggagagccacctctgaacttcccaacaatgttggtgctcttctcaccagcacatttcttattgctttggtaaatggagtgtcctttgggcctctggcagatcatagtcagctgatgggcttttcagctgtacctaatatagcagctttagcctgcctagttctgagatttggtttgcttcttcctctgtcacagcaattcaggcatttttactttacttaacatggttcattttttttttgttcaaattttcaagaggcaccctggtgttatcatcttctagggttcttgataatgtgttaaatcctctagtatagattagtgctcccacaatgggaaattctcctttatccaactctaagttctgccctttttcatccttcaccctcaggatccagtcccccactctctcccattcctgctagtacatagtgattaggtcctgcagctagttcttttgagatgtagtttttttcactcttagcagcctcttcaccttccctgatcaggcacattgctctgcaaagattattagatcatttgagatactactgggaagagtagatgtagtaaaaccccaaagtgaagtcaaaactatttctagagagcagactcttttctccctctaaggcatatattacatgctaatgtcaccttgacataaattcatgaagcaaggaggggcacaatctgagtaattctgggaaattttaaagtctccttctcagttgtctgggaactagtatagcaaaatagtctatgtttacacaaaaaggaagtgtagataattctaccagcagaagagcattttctgcaatcaacgagctaaggctaaagagtaaagacaattatttcctgtaatgtcacaccatcggcaagattatatgttaggtggcttaactgatttgtcattggtaactctgttaacatcaatcctatctttcaaaaatatttaaactattttaactagtctttttttcaaaaaaaaccctgctttgtgaatattattagcattaaaatgataatttttattggtaagtttattatgagttaatcagaggtggaaattaattttcatggatcagcattgtcataatgatagctagttgccttactaaggtaatactttcataaaagaaaccttcctggtgttctaggacaaagatataaacccaacaggtaaaggttcatatatgattttggccttattgaatatagcactaactatctgaaaaaaatatttttgtcctaatatcaggatagtcatagcaatatgaaatataaatattatagctaaaaatagttaatgtaaattaaaatgtacatcagttgccattgttataggtgtctatctcaattccaaggtcttgggttaagttgtctgtttccacgaaggcatctgcttctgaaatgaagatatcgtggaagctatgccttagttgtttcatacagcatgacacatttgtggtaagagttgttaagttgtactgagaatcttgtgccttaaatttttgatgtttttccccagaagactgaatgatctatagcttgcagcaggagccttcagataaatgaatggaaaaagcaaaacctttctcaggatgatgggggtgattggctttgattaataatatattgtgattaccaacaatattagaatggaggaatttagaatacagaggggtaaaaaaatgtcaatctatggacataaatccttgattcctctggaacgggaaaatattatagacagtaagggcactgaaaaactttcagagtcttttattaatgccataaaagatattgtaattaaatccaagagacatgcatttagatttttcaaagatgattctaataaagtaactatctagattcagctaatttgcaacactgtcagaaattataaagatcttgtttactataatccaatatagatgaatatatatgtttacattttgaagatcttgaatatttataacaattttaagactagtaaaatttgtatagaaaatttaggaaatttagaaaacttaggttttctatgggtaaataaaccctagttttgcaaagtctagaatattatgctaccatttttacactgtgagaaaactatggaaaaggcatattatcaaaccagcctaattttcaaggtttcacattagtcacattaccaggcaagggtacacatatcagcagaaaactaggctgaataatttgttgaaggaaaaagccaataatttgtgtatgtattagggagttgggttatggtgggttttgctggttaaaaactgaaggctacactctggataagacagatatagtccgtaagtcagtagatagttggttaaaacaaatgccactttttatcactgaaaaaagttttcagttaggttggtgtgggtctgtacctgggtcacgtgaaggtctcagttgcttatctgcttccactggtggaatgcccaaacatcacagttgtttgtcaacttcggagggttggaagcaattatgttgaaacaccacaaccagtttgaggtcttcaagcaaagtgaaaatggaaaaattgtcttgacactagtgtgtaccaaatcactatgttattgctatcccatagaatacctttatatgtggtccaacagtttgattttaaaattttcatcttattttgctagaaacttaactttgccattaattaaatgtatgataaacattttagagatgaaatataaaatacataaaagtactttttttttttcaaaaatcataggaagtatttgtgtagaaatgtttggagttctgtgttttaagataaatattaacgaaagcaaattgagtcagtcttattttataattccatgggtttgtcctttgtaatactttgtgagccttggacacgctagtggatatggagaggtttattttgttgtttaaagttttggaggtaggaggaatatcaactcttgtgttggatcaaatcagatcaaatagggaatcagcctatggtcagaatattctctcaccccaaacaaagttaaatacagaaataatgaaataaattcagcttatcttaagtcaagccctttttttttctggtttcagccaaggctgtaaaactgagtgccctctggtacctgccctagatgacagaagaagtcagaaggcaacaaaactttagtactcagaataaatctggtttaaactttattccaaaggctcaatttgattgaaaaatcccaaagaacaaaaaaagaccttattcctcaatgttcttggtatttttaatcctgaagtcagttggatccaaagcatctggcctcccatccctattttcctctttgacggtactgaactaaacagctcttaaaaatcacagagtcggttgaacttcagtcagggcatctgtcagtaccatattagcagatttgggccaacatttaaaaatgagtaattgggaatctggttcattttggcatgctgagagcctggccagagtcttcctatagcaggtggtttaatgggaacttggtccatgaaggctctgatgtgctctatttatgtctctgtgttagatgataagcccgaagctatggttgctgtgagtctgccagacaagaatctaaaacaaagcacagagttgattaccaccaggctcattgccaagggccctgccacaatactgcataagtgtagtgcccagtgccccaattgtgattggccttattgtttgtttctagtatcggtctggctgttagtaccacagtgtattgtatctattctctcccaaaaaccagagggctaatacttagtagcgaggtggggctagatacactcaccctatatcattgagtagagcatcacttagtcacatattagacaccagaaagctttctcggcgagatggtggaagagattcttgttcatagatcttggcaataaaagcactccttagctttatataaacacacattaaatacataagtaggtaaagtgttataaagagttttaaatgcatggcctcatttgatgcttataaccacttagtgttataggagaggtttgtattattattcccattttctcatgaaagaggaagttagaagagttaagtgatttgcctaagatcactcagccaacaagaagatccaagaatggttctgagctttgccgtctctcctcagcttttgtttcatgcacagccatctgatatctaagtggagagaatggtggcctggtgattgcatttaagacttaataatgatacatttaaaactgtaacatttagcagacctctagttgtggctactactgctgtcttgccacaaattctactgtattgatttttatccatgccgcattttaatattgtggacttaaaaatgaacatcggaatcctaccatctttgcagtggctgtaggggttagtttttttgcctggaaggatgctgtgaggaaacattttcaggtggcttgggtaaggcttataatgtctggatagcgtgaagtttgtaattagatcatgacagaatagcagcaactttttgttcaattaatcagaaaatatcatggcatgcctatgatgttcaaagaactatgccagtttgctaagaactagacaaggactgactgccttcaaagaacttacagttccattgagagataatacatgtgcacacaaaataaccagccacatagggcagctatttataatggcaagggtaggtacgaggcaaggcaagcctgtacaaggagaggtcacagtgagttgaggttattttggaagactcttgtagattttttagtggaagcaaaatttagatactgtatatgaaatgggggtaggtttctagatggtatgttgggagtgaagaaacagccaaaaataaataaataaatagaactataaaagaataaaacatattgtggatatgagtagacctgtctcactgcggacaggaatttataatgcaaaggagtggaagatagatgtcagaaaattggtgggaagattatggatggccctgaatacctgcatgaagagcttgttctgttaatctgtaaggaaagaagtgtcattcaagtattttgaatgggaggcagaaacttagaaagcatcatttcaccgggtggcagtgcccaggatagagtgaggaataaagggagaaacagactatcagtggagggacaagttagaaaatggagcaaaaatccggatgggaggtgaccctcagcagagcgtgataccggactggacagaggcactcgggtctcaccccggcttctgctgctcttttccttcccacacagtagccacaaggtgtcgctgtagcctttttttgctccctgaaaaatggcttgggggatgatgaggagcttttcaaatggctgcaatgtgaagtcatttctgcagttttggtgccatcttatttcatattgaacagtttagcatcatcttggaaaatacctgcatacctcaccctttggcccactagactctgtgtcctcttgtaagctgttctgtttaggcggttgcaactctcaggtgttggggactgtgggggttgttgctggccctgtagtagtaaacacatggacatcaaaattcagcacttaagtccgtgtgtgtgtgtgtgtgtgtgtgtgtgtgtgtgtgtgtgtgtcagaagcactttttttcttcttgggaaaagatactgtcattgacagaggaagaaatagcaggagtccttatctgggaggagaggaacatatcaggggtcctcaagaccaccccaggttcagtgattcactaggaggacacacaggactcagtgtatagtgctaatatctatagtttattacaacacaaggatgcaaagtaaaatcaacaaagggaagggctcatggcacaaagtctggaggaggccaggcacaagcttccaagagtcctctcccaggagagtcacacaggatgtgcctaattcctccagcaaagtactgtgaaacacatgtggaaggaatactggactcagtgtccagggtttttattgaggccttttcacataagcacttttcacataatcacataagagttgcaactgcctaaacagaacagcttacaagaggacacagagtctagtgggccgaagggttaggtatgcaggtctctgcattgcacataataaaattccagacttccagaaggacaaaatgtacattggtgcaaaaagtttcttttctgtctttttttttttttttttaattttaatatagagataaggtcttactgtgttgcctaggctggtcacaaactccagggctcaagcaatctgcctacctcagcatcccaaagtcctggaattacaggcatgagccaccatgcccagtctgtgcaaacagtttaggcccaatgagactctcttaactgtgctgtcaattggagaaaccctcctgcaatccgagttcccagatgccaaccaagggccaaccttgcaagcagcctttctttatttttttttaaattttttattttattattttttttgagatggagtcttgctctatccctcaggctagggggcagtagcacgattttggctcactgccacttccgactcttggattcaagaaattctcctgactcagcctcccgagtagctgggattacaggcgcctgccaccaagcccagctgacttctctatttttagtacagacggggtttccccatgttggtcaggctgctcttgaactcctgacctcaggcaatctgcctgcctcagcctcccaaagtgctgggattacaggcgtgagccaccacacccagctgcaagcagcctttttaaggagtctgatttgctatgttaactcttttctgcacagggagtgaaaataccgcttaggtttttgagaaggaggtattgatggatacatttttcaaaacccaggagagtctgacgttaaggtcatgtctctggaagtggtagttcaggttggagcaaaagtagtgaaaccagtcctggttgtctgtccacatacagaagactggagaggtagaagagaactgggatggtgtgttaggaaatcaagagaggagagaaggccgggcgagatggctcacgcctataatcctagcactttgggaggccgaggtgagcagatcatgaggtcaggagattgagaccatcctggctaacacggtgaaaccctgtctctactaaaaaaatacaaaaaattagccaggcgtggtggcaggcgcctgtagtcccagctactcgggaggctcaggcaggagaatggtgtgaacccgggaggcggagcttgcagtgagacgagattgggtcactgcactccagcctgggctacagaccaagatcccgtctcaaaaaaaaaacaaaaacaaaaacgagagaggttcaaaaggaggaaatgctcggtagtatataaagtactgcagatgggcagggattatgggcgctgaaaaatgccattgggacataatttaataatgtggtaattgattttcaacttaaaattatctgtacacattaagccagacttacttagccagtgccttgaatagctttcctgcctatcacatctttctgttttcttttgatcaccttacaaaagctctgttttaacattttttattgtggctttgaattttttgtttgggtttagatttcacaggcagagggaaatggatgagctttgggaaggctaaaaaaattctttgtgcaatactacatacttctctctggccattatttagggacagcagcagccgaaaatcacctcttctgttctggatggaaaagtaattcagtttgttcctttaagaggattaggtttaccatttcattgatttcatcgttgcttcctggtaaagaataaaaattaaaagctgcttgttttgagtggagacatctcaaggggcttatgaaagtgtctgaatttactactacaccgttggacttctcccagacccggagttccagttattgtctctctgatatttcatttctttttttttttctgggttctcggatgctaaagttgtatagaccctctgagatgaatgattattgttagacaagaccatgtgaaccaataatggcttttcctttggttataataaaaacatatcagaacaacatttattttttcaaaaagctctttttgtgtggctgactttgagtagtaggtggtctaggaaataccagcacctcctctctctctcacttgaaatgcttcaggattagaaaatcattgcaggcagaaagtggagagtgtggtgctcaatgtggcctttgcaattctacttacctccagtggtgggtgacagtcctggccttctggccttattcacgtcattgcacttcaggagggcaaatgtgcgctgtaactgaggtggttttaaattatctgtctcttgttctaatatcccagggcttccagcaaaagttctccttccacagtaaagagattgtggctatcagctgttcctggtgcaagcaggcggtaagattgggatgaaataaagcaatgtgggctcatgttttgtcgaaatacacttgtgtcattatttgagtttctccctggaagtagaaggcattcctaatttaatgtattgcttttctcatataggatccttggaggaagaaagacagactgaaactatagaacaatagcatagatgagctgggatacactagagagataaattaacttctatattttatgtacattaaagcttggggtcaaagactagaaaatcctcccctaattctaacactgggtctagagttgaggacttctcacacctagaccacattttccctccagtacctctgtattgttgagaactcctctggtatgaaggtacaacattagaagcaaagcaacgtatgacctaagaggtccctccaacacaggtggacaggaatcctggctcttctggttttaatgtttaatgtgcatgactttttattttggggctaagtgtgaggataagaagagtggttcttgtatgcttttttaggtttggatgttgtctgtacactcattgaaatgtagctctttcttacatttgaacatatatatactcattaggatctgatggtaatgtccctatttatttttctttaatctaccttttttcccactttatttagagcgtaattcctcggtctgtaccagatgctacattttcttatttgtttgtacatgtgtacctgtgtacctgttctttcttttaccacataacatatagtctaacccaggtgttggcagactacagctcgtaggccaagtctggctgccatctatttttgtaaataaaatttcactggaatgcagccatgcccagttatttatatattgtctgtggctgttttttttcatttatgtattgtctatagacactttcatgctacaatggcaaggatgagtaattgcaacagaggtggatgatcccataagcctaaaatatttattccctgtgcctttatagaaaaagtttgctgatgcctgctgtaatttctcaatgtccctattcttttgaataagttggaatatataaccccttcattgcacaggggacctgcaaagaaaaggctgtggtgtcttggtgaggttaaaggtttgcagaaaactcctgccactacacacatcacgctaaactagccacacaggccatggggctggaacagatgcatttagttgaaacatatgaaatggacattttgtgggtcaaaaccatttatattttggcagttccatatagttcaacttaataatatctctagcctcctacatgtcagaagaacctgctgtcactagatagagactcggtggtctggaaagctcagtgtcgctgcatcacaatcctgtgacattttttattcctggcattttcatttactttcagttagttgttacacaaataatcatttcacttctgttcaagaatgtgtgcacaaatataaggccatcctagttattgaatgaaactctgtaccagcaaggcaatatctccatttgtggtcctggggtccccagtgctgctatctttgctcctggttcttctaatctggtgagaccccactggtggggcagccttctgggcagcggtgtgctcagatcggctgcatctgctcctgccctgtgcagctaccaggctgtggtgcgatggtctatccagattcaattaatttggaaactcaatcccactttacaatgaacatgtgtgctctctttctattaatctgtagtccaactgaatcactacaaaggacaactttcacctgaccattgtggtagagctttggtcagttccacttatctttgaatttcccagtttcccaccttgtagaaggtgatttttgtaaggataataggtacaaaagatttgaacacaaattacagcggttgatatgttttcacagtccaggtgaaccccttctaggatatttgatgtcagacaagcaaataaatatgtgaccctttatggtacaggagaaagaatatggggtttgggacctggatttccagggttggggttttgattccatcatttaaaaactgtgcaatcttggatgtacctctgagtctctagagtggagattacttaagtattcattgagagacttgacataggcagtctctgcgatccctaatgttttagaaatgcagtggtcatacatttgagggtttatttgaattgccaagaaaaaaaagcaatttttaaagaaggtattcaaatgttaataatatttatctggtatatttgtttgcagatcaccaataactggtggcaggcagaattattaattattttaccagtattttatatacaattgcttgattaatgattagccactggatcacagcagatcttgaagacatgtagaaatgaaaacaaaaacctctctaatgttatgtaatgtaattagggtggacatatttgccagtttttttggagacggtcctaatttgtgtttgtgttttcaacataattattatcagtgatactttttacttttaacattgttccagttaaaatgataaataatatagttacgtgaagtataatctaagaagaaactgaggttgaatttttaaaatcactgtgattaaaatttaaggcctataattattgcataatgttgattttagttttctttttcagaaaaataaatgttattacacatcactatcactttatagtcacacaaaagatggttgaaaacttgactggcctaaggtcaccagtctgagtgtcactgttggggtatacagttaagaccctaatactgtggtattgttatgatcgttagcctacatttacttcctttcaaaagcaaaaatcactttagacttgccaagagtaatagggtcattgaattttttttttagcagtccagacaaacccaacagaagcaatctctttgtactttgttacttctgggattttcaactctgtagaagagacatcatgcttcttttctgccttctctaaaccggaaagacaacctgggaggatttatatctatgataggaaaaggaaaggcaggtggtaggcattgcctttctgcctgttcatttccttcttaacgttatcttagatcaaccaagtccatggccagcacaggtcaagggaagtgtatgtgaacattttgtgcaaaatcaggattaatagaaccctccaagactctaaaacttttaagtaaatattccatgcaacgattagaaagttttagcaggcttcatcctgctagactgatttcttgttatcaatgttataagtttgtaaaccggaataaatctgaagtctggtctctaagctcctggggctggctgggtggtgatgaggaaagcatgtcctcagtcctcagtgtgtgcccatgtgtgcatgtgtgcatgcatatgtatttttgtgcatgtaatgagtgtgtgtgtgtgtgtgtgtgtgtgtgtgtgtgtgtgcgtgtgtacatatttatcccttcttgctgcagcattactctttgaccagaattgtttactggcttatttttctcttcagtttcacaataaggtgacctgcttcatgctgcatcacattgaagaaccctgctccctgggggctcatgctgctgttattgtcccgcccacttggatcattaaggtgaagaaacctcaggtaactgccaggactctggtgctgctgggccagtgcagagaaaaatgaactgctgcttcgtgcttttctccccagactagtctttgggttcctatgacctcagttcactcatccccaaggccctgtgcttagcttcctcagttcatcccattggcccatctctttcccactttgggctctctcatggaaccagcctccccatcctaatgaattcaaagttctagagcaggaatgttgcctcctcattcatgtgctaatgatattctctttgataggtgctcttccaagtttcattgagtactagtggtgggtatagctgatgcttatacaactctgttctcttccagcctgggcattcccagagggtcagtgtgagggcaaactgttcaggcttcatggtttggttaagattcctgccacttccaacctggaaggcagaccatgaatcatgaccttcctgaatacacaggcctgcttagagagtgacatttgtttttttcttaaggcaaagtagaatttattctcttaatatctaatctcattctgtgttctccccagtgcacttcctgtccttgtgagtatccacctcagtattcagggaaaccttagtggtttcttgacaaggtcgtaatctttgaaataaaatgtttctgcctttgtactatacatccttgacagttagcttcaagttatgggatggcagatttttaatgctatgggaagagagactatacctcccttagggtgcaggtactgtaggaagacttatcaaatgcaatacctttaaatgatatggtggtcctacttcctgtggtctccagactcatcatgtgattcattctcattgactcaggtttatttaaaaactggtggatcagggatactgttttgctttctgtgttttatataaagtttagactctgttgatgagtaatgtttacgaataaaattatagtctatggaagcccttgggatatttttttccagaggcaagtatagtgtctacatattaaaaaatgaggagcctagtgcttcattttatattttagaaccaaatgccaagatatgttaaatgagttacccaaggtgataaaacaaattatatatagtattactatttgaaattcaagtgtactgaattccagtttttatttttaaatctctttaacatttctactttaaaattttttttttctaaaatttggtaatctctccaaggctttacattaaacattcattcagttaaatccacatctttccattgaaaacctcgattgtatcaggaaggctaataggcattgcgataaaatacgtgatccttactcttaagagtcttgttatgaagtgggggggagggcttcatgaagaagatgggatttgttctgctttgtaaaaatgggtgagatttaggtctgtggagtagagagagagtagcaggcaggagaatggcacacaggcatgagtactgtgtccaaaattatatccgtggaactgtgagtctagtttgaccaaagtgcagggtttatgcagagggtgtgtgggagatgaacatacaattgctcaggcctgactgtggaggaattttttttttttttaataaccgtgaactttatcctgaagtagcagcagagttccttttaagcaaaggaatgatagagtaaaaaaaaaaaaatatatatatatatatatatatatagtattttagaaagaaacaagtagcaagagtgtgtaaaatagcctagtggtatgggaatttggaagtccgcagacacactagttaggaaaatcaggggataataccagtttgtagggaaattgcaaagtttactcttctaaaccttaagaaaccctttttgttatggaaattttcaagcaaatgaagaaaaaggttataatgaatcctctagccatcaacttttctgccattctttttcatgtgtctcctgctacttcatattttcattttatgaattacctttttcttttgagattcacatgcagctgtgagaagcaatacagagaaatcacttgcacccttccaaaatttcttctcatggtaacatcttgcggtattacagtacaaaatcacaaccaggatattgaccttgattcagtcaagatacagaacattccatccccaggagcatccctggtggtcccttgtcaggagtcatatccatttcctcctggcctcaccccatctaccccatcttcctggaagtggaatccccctactttttctttaactagagtattttaaaacaaacattagacagcataccacttagtctgtaaacacttcattatgcttctgtaaaagatagcattaaaaaaatccaaatgccattatctcagtcatgttaataatcccttaaaattttttcctgttgtctaaaatatatctttttttactgtttttcaagtcaggatccaaagttcacaactgccttttgttgacgtagttcttaagcttcccttagtatagaacaataccccctgttatttgtcaggccacttacccgttgatgaaattgggtcactttacccataggatttcccatattttgattttggctgattcttaccatgtttccaaattatttctcttattgcccatatttcttgtaaactaatatttagacacagagactcaattatatttaggtttaatttttttttttttttttttttttttttttggtaaaagggatacactggcagtacattgccatcacaggaagaggatatcagccatttcactctcagtgatgctaagatcaatcagtgggttcaggaactgtcatcctaatctgtctatcataaagttcaccatcagcttgtcatctattgttatctatcaaagagttttgccaaagtctattattgcattaggggttgccaaggagtcgttttccaattttcactctttttagctatgatttttagaaaagagacctttccttcatcccaacaaatacatgacaaacgtttgagtatttgcctttatttgtaagttttcagaataataagctgatgccttagcaacccttataggatgtagtagtggttgtttttttggagagtatcattacgaaattacttaattatgtttttatgtattatgtgtttttccaatacgttgtcatcattcttcttcctatgtttatattgtttcatctccaaccattggaacctcttccacatggtgtctgtcttcacatttgttatgagccatgaggttttgagagcttccttggttttaggaacaataccatgtcccaggatcatttaatgcatttcctgtccatacctggaatcagagtcttggttctttctctagagtcttggttacttttaatgggatatgggatttatagctcatagtctggatgcacagtccaaattcattattcaacatgtgcctttttattaccgtctatgattcaggacaatgtagtaataataatagtaagaagagctaacatttatatgtgttaggaaagttttcagtattttacattcagtatcttattttatcatcatagtatcctatgagcaggtatcctgttattcttactctatatctgaggattgtgaggcacagagaagtcaaataaattacccagggtcatatagttattaaatagtttgagatgggacttggacccaggaattttgattccaaaaaacaagctcttattggtatgccacactgcctcactatctttctgtagccagccttgctgaatcagatgttttaaaaattttagtagtcttttctttagtgggcttcaaagccatcaagtaagttaaccaatgaaccatagtctatttaaaagctgaggtatggtgagcttgtggggacaatgcagcagtggttaagagctttctgacttttgagccaataccacctgggcccgtaataaccttgctgtagccacgtaactaatttgtgtaataccgaacaattaaactcttctattgaaactcttcgacaccaatgttaaattctatagacataaaaaaaccacgaggaagaaaacaaggagaaaagtcattgtgtctctgatctgttcatagatgacagtaaaaactatagtttgtagtgtgtggatcatgggtggcaagttttagccatgatttggaggtcaatatattagagaattcatttaagacattgggaagtgactaacggaaaatttggaacataggtggagaatagcagagtaaaatgtttttccaaatttgaggatacacacacacacacacacacacacacacacacacacacatacatacatatacacatatatgtatatgtatctatattctatcatactgcttcaaaataaataatagagaagatgttcttaattgaattcagttcatgttaatttaactacattcagagatgctattgtatacagtaggaggtccaaagatgaatccaccgtgatccatttccacaaagagtatactcaatagtggggaatatagctagaactatctaagtcactgggcagagtgtttgtggattttgaaaaattcagctgtgtgtaaatccttaataaaagagtgcctcctactatctcggaaggtttgctttttggtcagtatgcatctttgggagaaacacacaaaggatggtgagaggaaggggccagacaggttggttgaatcagccatggtcagcatccaaggtggcctatctatccaaggtggagagtggtcagtgctacctaagatgtataaacacagtgtgaatatgaagcagtacggagcattttcggtcatggggatcagggtaagctaaatagaaaatatgccatttgtggtaggccttaaaggatgtaggcagtgtcagtgaaacacgggttgagaaggacagtaaaagttgatagaactaactgagaacagttaagatggatctttaaataaagtcagctttatttgggatatttgtgtctaaacaagtgactctagagaggaggagtaaaggaaatctatttgagggtatcatggtcaggagacatggtttataaagagttggaattaaaccgcatatttcatttttactccacgagcaactgtggaattggcagctctgtgaaaccttgatgctaaagggagtgagggctgcttgggtaatttgctaggtttcatcacctcattatttagagagatgaagaagttattttgtagaaataaaaaggtaatggaagatagatgattttaaataactcaaatgaaaaccccaaatttaagaatcaagcctggatctgttgatatatttgaagtccaagttatatttaaagttacaaatgtcagtgtttctctttcggactgaaaatattactagacaatattttgattggacaggcaagttaaagatggtcaaataccagtgcatatacttggagctgagggattgagacttacgtgaattttctgtggggtcaagttgtagaagaccacagttgggaaagcttttacaaaacttatgtatcatgagatgacatcatttgaaaaaatattttgtacttggtcccctaaattttccaaactgtcacttttttgtaactttctcatgaatctcactgggctgctcctatcttctaaaaagaatataaaatggatcctccattctctttccttaatacagcctgttgtgacttcatagtactgagtgggaacaagctggtttctttgaaagaatgatagtgctcaatcttttattgtttcgtttgtagtaacatgagtaatatataaatatgctccctgtaaaaattaaacatctcagataagagagtctcctttcaccagcatttaaaatgataagcatctccgctgtctcttcctatgatatatgcagagtttttactgtgcgtttacatgcatggaaatgcacccacagaagaaatacagaaccacttcgagtgtaagggtgtgtgtttttaataaataattcttcacataatgctttaaaacttgcctttcttagtaaaaaaagattcttggggaaaagtctgttattatatgtagacttaactcattttttaaattgctgtatgtatcccatgctgtggatatatcctagtttattgatccatctgcctactggtggatatttatattgtttctaatgttctacttataaacaatgctgcattcatttcttcatagccctgtatgagctttcttcataatagtccccctttttttggtttatctcttctggttagataatcttcttaaaatactgggaacccatgaaatgtaatagctaattttgtgcaacgaccaataatatcctgtaaattagcctcaaaattgcctgaaccatttcctttggtgaattctaaagcttcattagtacttgtgatttagtcaaataggcctggttggagctgttgggaccctgtctgtaacttttggaataagttttctttatccttctgccttcccatcctcagagcagcctttgttccctggcacaatgggagcccagcagagtaagaatgcgctttaatagactaagtccattactctctctcctactgtctaccagagttttgtccagtatatgatgggggggagactttatttgggatgacaaagaagagcgaacagatctcttctcttgggatctgttattataaccagtcatttgtgatcttataacctggaaaaatccctgaagattaataagaggtagttaagtttcagtcacagttgagtgatttacccgtaactatttcttaatagcccagcaaggagtcataagcatgatcaggattttattgataggattatttctgtggcaaggtacaattatcctggtatgaagtacaggaaaacaaaaagcctttttatttaggtctttaacaaaagagcaggcacagaatgtctagggggcgactgctgttggaatcagaagaatgcaaaaatccaagtgagggtacatacagcatttcactgtgtttttagtgttgatcttgcaaagcgaatgcttttatcaccgagttagctgcccttgatataatagagatgatttgttttggaacatagcacaagtgttacaggtttcttgcatatatcaccaacaaattctacacagtaacttcttgacataattttaacattctcgaaaagcgtgctcttttgtttaactctctcaacaacactgacccaggcaggataagcgatcctgtagattatcaagagtaggtgatttatttcatcatggtcaaaacatatacaaaatctgccttcaaacccatctgttcctagaggtagagatagatacatatttatacaaaatagagatatgtatttatacaaaaatagaagggagccatgggattttgaggtatgctgtgaaattcctactatttatcttttgtgtttgactatccgtagggctgtaagcttactcagagctcacatagatgcgtccaggtactgtaagtcaacgactgtgcttggtctctgccctgttcttgttctgtgaagtgaagaaggcctcagatgcatttggtttggtgaggctagaagcacttgtatttgctacctctgtgttacaaaaaaaaaaaaaaaaaaaaagcccgttttgtgtgtctgttccctataagaattgagttctttgcctgctctgttttcagacatcaagccttactttaatgtgtttttctaactctgtgctccccatacgtgcttgatcatcaaaatcacctgaaatactgtgagttctacgatcagacaagtttaggaaacaatcttagcctgatgcgttagatctgtctcatggagtttaattgctgacatcctgtcaaggacctaggtccatagcatgttcctgcaagcacttggtgtctggcattgctcttggcagtaaatgaattaaaactacaaaaaagttaggaggcaagcattcacttcccaaggatcctttcccaaatcaggagaggctcagtaaatgctgtgaattataggaatatttgttcattatttcaacaatgattcgagtgtacactatgtgccaggaatttgtgctcggtgttggggacacacagctgagaatgaggcattatttagaatgagctaacatttactgaagtgctcatggtgggatgaatacccagctaactgcttcatgtacctttgctggttataacttcataactgtcccatgaggtgggtagtgtcaccatcattttaaaattaagaaactgttatttcagaagtttgactgacttggccaaggtcactgatctcacaacagggagattcagagtccataccagacgtatattcctgtctctgttcatcttctgcttaacacaatctatgtgtctcctcactttcctctttctactgccatcactctgtgatagagttgcctggtaaacttttaaaaagtatccttgcctgggctttaccccaaacagatgaaagaatagttgatggggcccgggcacgagcatttttcaaaactctctgggtgatgccaatgtgtagagatggttgagaagcatttagagcattgttaattgacaccaaatacatactgttcctgccagcctcgtggtttctagcattcttcttagatcatttggctgattaaatgattaatgattccaaatcacttttcttcccttttaaacaaacagaaatctatcaaaatataacaaatactttcataatgcgaaatattcctcagtgagggacatgataaaagacccatttaactgagaatttagaaactcgaagatctattttcagggggaagtagagtcaacagtgagtgatgaggaatgacctggggtctagagcacccatgagctcctcgatctctcttttcctggtgtgactctgagatcctgagatcttttaatctgatgggaaagaaaaccttgggacagatggtagttcttgaaaatttccctcatccccggtgaacacaggtcatgtatcaacttattttttttcccaaatccaagtcaaagtaaaataaaagctaaataggagcttactaatttggatgacttagtatatgtactttatactaaagattattttgaatgctcaaagaaaaaagaatacattaaaaagtagaatagacatttgcatttcttgaggctgtttgacaactttactcaaacaatgcatgcatatatacttatataaacttttaatttaagaattctgtgtttcttgctgccaacactttgttaaacatctattatatggtcagtaatatcttgccttttaaagatagcagtctaattaatcattgactctccactaattaaatctgtttttatcttgtcttcaatcagtgggttgtgactgatccctatgacaggttcttctcaaaacatctgtatcaaatattaagagaaaatggttagttgaagtaatcacaatattgtggtctataaagtttctagaaagagaaagacaaggaaagtaaatttgggggtcactgtatttcaacaagtttgaggcacttttataagaagaaaaaaatcaaggctaccaggggagggaaaactttttaaaccattaggtctttagacagagaaagaaagaacaatgacttccatcccactctcatagtgatttaaggtgagtattatctttgcattttacatgtcagacaactgataggacagttggatcataaatttcgagtagggtcaagagtcactttatgactattactagaaaagatcattaccaaaagagtaaactaagaaaaaaaaaacaaaaaagaaaaataaaaacatgaaaaatggcctccttttttacatttccacataggtgatctccatacgaggagatgaacttgaacttggttgggcgggagacgaacctggttgggcgggagactggagcccctcagagaatttgggattcttccatttttactgggagggttggcaggtataacatgtgttgttatgtgagtccatgagagcctctggggttcttactccctgcctctccgtgtggtggagagtcagtcgcttactctgaagcactcgactgatttctgtctgtggcttatccatgaacagtggcttggaagtgtgaaagcatgagaagcatgcagtggaacagcatgcgctgccgtcatcttctacttggttctgcatgggaaagctcctgggctggctgcctctgagctcaggcatttctctctctccctacagaactccctgaaggcttcaaatcggaagaagaagagaacaagctttaaaagaaaagccagtaaaagagggatggaagtaagtgtttcagagttttattctgaggaatttccactttctttccatagtctactctgtcctatgagatctggtccaagttgatttttctgatctatcttctactactgctttctcctcactacactctaaccacaataggattctttctgttcttttaaaaaaacaaacactcaaaactaacctctgcgcttgcctggaaatgttatccccaagatgatgatgatgaagatccaagctaatatttctggaatatttggagtttacagagtaaaataaaaagcctggcttaattctctggagcaaatgataacttgagatactttcttccaagccttacatggaagtcgtgttaagagtcagccctgggaaacaaaatgtattattgggtggttttccacctcccttgccttggggttgcctttcaagccatggatgtgtatcctaacagtgctgattgcttctttcagcaggaaaacaaaggtcgtccttttgtgataaaacccatctcttctcctctcatgaaacccttgcttgtatttgtgaatcccaagagtggaggcaaccaggtgagtaatttttcatgattttcaacttagaagttttgataatttcttgacgacacaactctcactgccaattaaaatagtaccactaggatcccaagctttggaagacaccggtttctcaggaacaaggttattgtttctctgatagctttacacattacagggctgggcaaaacctagatgttctataatttatctgtctgcttccatataagactataacaaaggcacttaagaaacctaactactgactttttccttacagattttcaagaaaggatattctagaatttctcttagttcgtatgtttcaggattcctcaattcttatagttaggaggcccttcatcaacttctttttatttctttctattgcaatttagatacaaccactttcatccctatcctcagagaagaaaaaaggatgattcatgagccatgataatccctaccaaataccaccaacattatagaaaatatcaacttcttaaggtttcacttggtcctagcccaaatccaatagtacagatacttatctcatttgagaataaagaaattgacttagaaaagttaagtctaaaggcatgcctaaagtgacactggtctataaaggacagaatttgttcttgaatcctggtctttgtctcttcatccgattatcttcccactctctgaggcttcttatcaatactcttctatgggctttaattttctgttattttcttctgagtttggatgagaaaatattttctttatccacgaagtatatattttacattttgagacaagattccttcaagttttacaataaacaactggagatttgaaaccctttagtcatcccatataaggaaggtaagttgtataaataggattgacccactggtccaagatgatgttcttattactaaagacaatgggcattgtccagaatgtattaattacaataaaacttctcttatgggagcttatgatttaaatgaaatattattcttcctttcatctctgccttcaaaattctcaaaaacttgatatggtaaaaatgtgtattaacattttggagaacaaggaaaagaaatttgtgtaagcaaagaaaccatttgttttcaagtcctgcatttttgagttgctgagagatctttatggagtaatgatggcaattctaagacatcattagaggaggacctagacatgggtttccttgaaatgaggtttaattttccctgaacaatacccactctcttgggctagtatccctatgttctatcaaaggttagagatgcagttgggaaccctgaaacatggaaatgtaattagttccatgattttggccacctgagcaccacatatcaattagtttcaaatatattttgtcatgacagtccacatataagatgcatttattaaatcattataagctctctttcctagggcgcacagaggctagtaagttatctatttctttaaggagctgatgatccagttaagacatagcctgttcctattccagtctatgtgtaaattattaatgacggggacttcagagattatctaatattgcttcctatttcactaaatagaaaagggaggtcaaggaagcttaaaatgaattttctaaagacatcttgtaaatgacacaaaaggaacaaatggaaaataatttaagcaacattaactgcatgtgacttctaaattgagtggctcagactgcagtgctatgatatttcagaggtaagcagtgacttgggagtgataaggaaatggtgtcatggacatggctgaaatcaaagatgggtactacttagttatgcagaggagagaagactggaaggtctgtccttttcctgctctttactgtggcagattcctgttcagcaaattcttgttcatccttcgaggctcagtggtgcctttctgaaccatttctcgagatcaatcatcctgtccactatgccccgatagcccttggtacacacttgcatgatatgaacagtaacataactgctctatgtgcgtcttcactgttggggtacaggtccaccattgaatctgtgatttctagaacacggcacatagttaaataattgtataataggattagaagaacagatgtcatgatgccgattattcattttgaggacaatatgatgagtggtgcatgcatattaagttattggaaatgtgattaaagattagaatgatcctatggaatcacgtcttcaagaaacaggatacttcaggttgaagactttggatttatgcaatggaaactagtttttttgctgtttaaaatattttagtttaaaaaatcttttggcttttgaacagaggaataatatggtggaatttaatgtgcgtatgattcagatgggaattgtgctaaaatgcagattctgcttcagtaagtcggggtgggccctaagatgctgcattcgtaataagctcgcaggtgctgagactgctgctcagagaaccatactatggttagcaggggcttactgtgataaatagaaaaatagatactttttgttaaatcttgagttttgccttttaataatttacttattccactcacctgcttttagatataaaggattcctatctccttctgtctttgaaacttaggctttagactttttttttctttttttttaaaaaatttttaacttgcttagtcttctaagtaaattactggacaatattgccacctactggcaagaaaaatagctttttctctttatataatattttacttgtgtaagaaaaacattttgaaggaatgtattgggatgaaccgtgtaaggactgcttctatgtctctcttttaagaaatcccatattttaaaactctttaattttttttctaaattgatacattctttttgtacatacttatggagtacatatgctattttgatacatttatggcatgtataatgagcaagttagtgtatttagcacatctatcacctcaaacatttatcatttctttgtgtttgaaatatgtcaaatcttctagctattttgaaatgtgcaatatactgttgttaagtatagtcaccccactgtgcaaacactagaacctatttcttctatgtaattgtatgtttttactcactgtccaacgtctggtcatcccccacacccaccacacccttcccagtctttggtaactatcattctactctctacctctgtcagatccactttcttagctctactacatatgagtgagaacatgtcaatttttgtctttctgtgccaggtttatttcacttaacataatgacctccagttctatctttgttgctgcaaatgacaggatttcattcttttttatggtcaaatagtattttattatgtatatataccacagtttctttatccattcttccactgatgaacacctaggttgttaaatctcttcttttaaacttagcagtaattgtctctttgtttttccaacactcttaaggtagcgatgacactgggtgttttgcaaagctgtagagcttggtagcactgctgctattattttattgggatttgacttatttgaggaatcagggaccaaaatttcaactttttttattttattttatttattttattttattttattttattttattttattttattttattttatatttttgagacggagtcttgctctgtcacccaggctggagtgcagtgacacgatctcagctcactgcaacctccacctcccaggttcaagcaattctcttggctcagcctcccaagtagctgggattacaggcatgtgtcaccacaccaggctaatttctgtatttttagtagagacggggtttcactatgttggccaggctggtctggaatgcctgacctcaggtgatctgcccgccttggcctcccaaagtgctgggattatagcactgtgcccagccaaaaatttcaactttgaatacctccttcggtggaaagagatagtaagtgtaacataaagtttactccagtgcaatcccctcctatgtgtggaaactttcgagtactagagaaatacgtcccctcccttacacttctgtttgccttaatgtcaaaacttagatttttctttgaggtcctggactcattagcatctttctgagttttatagaatcctgtgatatctctcagtgtttcctgctttcacactgtctctccctcacgttctctcatgactttctcttccagtgacctagactttaacttcagggtaaagcaatgttctgacctctaggatgattctatctgatcatccctgagagccaagggatccagaccctggctttgcacactgttcgatgtggaatcctggggtagaagtatggcaggagttggatccttggattacaggtcccagggtctttatcagtagggtgatcgaggaagaggtgtccagtctgtggacagacacatggcagctgagtttacaccaccatctgggaatcggctttctcagactagggccacccctcctaagtcaggggccagtcacatcaaggtggggagaaggggaagacagaaagagtaaataacttcagatgagaaatttgagtcccaaaactgtttctaaataattggacaagcaactttaatgaagtagttacttttttgcagtactggaaacttctcaacctagtgataattcaaggatcattatgtttagataaaagtgcaggctccctaaggtttagagtaggcagggaagagggcagagggaagtcagtagacgaggacacttgtcaaaatgcagcctcaacatcttcttgtccagctagcctcaacagatggaattaaaacaaccaaatgatgaacctatggaaagtcctatttctgaaatcatagtattggtgggaggattgggcagctaagacccaaactagctcctgtgataggtctggttccttagtctgtagccagagcgatgcataaaaaatgtcagtctgggagaaaaaaaagctggtctgaatctcttaatgaagacttttcagtgactccttgttttctataaattaaagcctaagcctctcagcatacattatttaaaccacagctcacttcagctgtctcctctctcgcaactccctgtctcatggttcagaaaagtgaacagaatgtagctttttcatgggatgtcttgctgtttcacaccttttgtgcctttaccctgaaggttcttcatctattcgaggtggaaagaaatagttaagtctactcatttttcaagacacatttcagatattttacttacaacgccttctaatctctcaacttgggcttaagagtgtttcctctgggcactcatcctccttagcagacgtctgtatcagagaagttcccatctttggtgaattaatttattttgtattgctctccttccagtaagttctgagatcccgacggtacacatggacagagtaggggcctaatacgtatttatcaaataaatgaggcattctatttggattgtttgaagcagtttgaaataataatttcttaagcccttcctctcattaatgtatttttctcaggcctttcttattgtctgggcagttgttctttctataatctagataatgcctgcatgatataaaccaagacttagtaacatagcagagtttcaacctacactagagttatggtgctttgatgaagattgatgagctatttgaaccgacccgttcttgattgcttctccacacccccaacaattgtcattatgttttcctttatgaataatgcatggaacttccttctgagaacaagatcatctctgtcttgttcatctctgtattctcctacctaaaactgtgcctgtcacatagtaggtgaatgaatgaatcttgttcaatccagtcactttttgggaatttgtattctcctgttgcactccctccctagtacttgctgcttggaagaataatgttcttttactccttaggaatacccattcttataatatctaaaaaagttctgtggccagtgaggtatatctacagtagcatgcatggattgggattggcatataagctgtttttttttttcatttagagaaaattagactcttgcacaaaagttgcagtttttatgtttggcattatagcatgtgataactatgagagtgctggagagttgttagtaagtgacagatgtctaaatgagcagatttaatcctactattgaggaagaaatgaattacccttctcctggtgaattaatatttgtcaaaccattcagttacatttaataaattatctctattaaagctttaaagttacttaacccagaggtaacagcagagttaatagaattcatttaagtgtgtgagttagatctttgtttctccacacactaggtggagcattttttcaacgctttcttttagatacttacatttttggtaataaataccatattttgaaaagaagattactttttaaaagatgtaatcatatcatgcctgaatgtcaatttcaacagggtagccatgcctggctatgcaagttatctttacacaattgcaggcatgttattccaatagactgcaatagaaatgtcacctctgtggccactcggaccttttagagaaattcaagtttaaggaaaacaacctctcaatgctttttatttttattttttggaagatgttagttacctattaatatttgcataatggagaggctgaagctgagctgtgcactctactatagcacaggtggaaaggagtaattaacatcaacaattcaaactactctaggaatctaaaactgaacaaagaactttctagcaagtcagttggaaatgttttataaattagttggtcattaaaataactcctgtgttacctattaaacataaaagattattcgagataatcccaaacacacttcatagcaaggctcagcgtgagaagagggaaaatgatctagtatttagtgtgtatacagatctaagtctatgtttgaatttgataggaagcacaatatgtcatttggtgaaactcaaggattcgttgtaattattagatagaacgtgattcctaaaattatagcaagcacatgataaggcagaacttttaaattataggtttggctggtacatgcaacaaaagacctgcattggcctatgtaacaacaggagtaacaatgtgataattataagctatactttagagctcacattctcaagtgtaatttaatgagtagattaactggctgcaaaaaagaaaaggattaacggtaacaaaggtctgttttgtgccgcatactgtgctagatacgtgactgttagtgattcacttaattctcatactcaccctggaaggtggacatcctttctattttatatactgcatttctgcaaggttataaatgctcatgattactcagaacactgaagttagtttgacctcaaatctcatactatgtccagtatactgggatgactcttaaatgcagcttattagatatacaaacctaggcatattttaagaaagagcaattacgatatctactaaaacaacaatattatgagcaacaaactcggctcaactggtcaaatattatttgctatgggtgataaaatggggcatcctactgatttttaaagctcttttggtattgcttgataaaaagatccttcttgcatttctttttcttttttttttttgagacagagtctcgctctttcacccaggccgaagtgtagtggcgctatttcggctcactgcaagctccgcctcctgggttcatgcccttctcctgcctcagcctcccgagtagctgggactacaggtgcccgccaccgtgcccggctaattttttgtgtttttagtagagacggggtttcactgtgttcgccaggatggtctcaatctcctgaccttgtgatctgcccgcctcggcctcccaaggtgctgggattacaggcatgagccaccgtgcccggccccttcttgcatttcttgtttgctcaatccaatttaaaaatgatctctaaagtgaccttatgtctgctgtaatgatgatctctataaatgtcacagttacttaaaatgccccaaaaatgttcacgtgacagagaagtgtttggcttaaacaaaccagtataggcatggagattgaaaatgtcaaagtaagctgtgatcttactaaggaagttttatatatgtataaaataactgggagcctgggatacttttgcttcagttagaaaaaactatttctataaaattatattaatacttagctaatactgcccatattttatattatacagacaataatctgtacaataaagtgaaaattaatgtcaaattacataggctgactaataacttttctatatggattttcatacattaatgatagtaaaataaatattattcattaagggcttactgcattttaaacactgtgatgtacttctcaaaaattatggcttttaatccttgcaacaagtctgcaaactgggtattcttgtctctgtgttaaagaaaaggagggctgagctaaatgaaatgaagaaacttgcccagagttacacaggttagataaacatctaaactgacattcaacctatggctatccatgaccaaagcccgtgattttaactactcttctatactgcttataattagatattattttatttatttattcatcattcattcactcacttattattttttgagacagggtttcactcctgtcactcaggctggagtgcaatggtgtgatctcggctcactgcacactccgcctcctcagctgggactaaagacatgtgtcaccacacctggctgatgtttgtattttttgtagagacgggattttgtcatgttgcctaggctggtctcaaactcctgggctcaagtgatccacctgcgtcagccttccaaggtgctgggattacaggcgtgtgccaccgtgccctgtgtattattttaaataaaagtatttattttttaaatgagcagttattcttgggaaatttcttcctattattgcctttttgtgtatttattttttacagggaaccaaagtcctgcagatgttcatgtggtacctgaatccacggcaagtctttgatctttctcaggaagggccaaaagatgcgtaagtctggaaatattctccatggtccatatgtattttaggcaagtgagaattttctgcttcattatctgattaccttgtgaggtatatcctgaccatctgtcatctaccttctcacctgtactctccttcctttaaaacttcatccaaagttctctcctactctttattggcttagttcccttcgaaacatatcttctcagctattaactcaggatacgtctagtgtgtttgttacttacgtatgtgtaactgtaggttattctctgcaaatctgtgaattgagaaaggactcattgtttttctatttcttcatgtacaactttggagatgcacattaatggaatgtaaatgtatgtctgtggagggtggagccatgtttgtttatgaatatttgaactgaaaagagagagtgtgtgtgtgtgtgtgcgcgcgcttgtgtgtgagagagagagaatcaattgattatacctgaggactctgcacaaatgtggggaagacatattaattcctgctcaatcccgtttctgagcttctcagaaatctcattctctgcttttgttagaagtgtttaaaataaagtctagattgtaggtgacccatatcctgcttctctcctttggtggagaggcacacagtggaaaagaccaaggacacttctgctgttctctggttctccgttttaaattcatgtactaggatagttcagatgttatctgataaatgttagaacacaagggtaccacttattttttaataagtaacaatatcagaggaaaaggtgatttctagagaaatagtattcttgtataaaatggataaattacttattttaagcatgcagattaggaaatatgaaaattaatttgttattttcttaacgtatgaatttcttcaccagttgagtttgctgcaagattcttcctctctctgtcccataatacatatatatatatttatttatttttattttctgtacttgattatgctaaggcaaatctgctatcctgggatgtgccattttaggagcttatttttcttaagattttatcactttagttagaccctagagagacacttcagaggtcaccgtaaagaacatggtaggacaggaaatattttcagaaaaaaaccatattttgtgatttaaataggtgatattttctagattacagcctctagcaacttcacctaagcaaaagatttagcaggggcagtgtcaatgcattttcctgagatccaagaggaaagacaaaattatcttatttcaagcagagaagtttgaaataaataaaaatcagtcaatcttcccactttgggttggaggtgtaagtggtgtgtaactgagctgagagaaagactagatggaattgtagatgtgatacctgtgttcacatctgagagtgcggaagcctccccgtctcgctgaaaaagatttcttaggattaagagtagaaagtataagttagaagaagtaaatacatccagggaaaactaataaatataaagaggggatatataaggactactgattatcaattaatgatgattttcttggggaaaggggaagaggaaatgatgggaaaagaaaaagaaggaagtcaaaactaacgaggaaaataatgttgacatataatagaagttatgggaaataaaactaggacatcctaaaatcccttaaattccaacgttgaattattcattcaaaaataatgtctgatgcctacacctgttccactggtgggagtcattcttcctgtggttacttgggacctatgatagcattgtcatcctcatgattacacattttctccagcggacaccacccctacctacccatgttgtcctctgctttctctctgctctagccagtgaaatgttcttttgtttactttttcttctatttcctctacaggcttgaattgtataggaaagtaccaaatctgcgaattctggcctgtggtggggatggaacggtaggtccctgagagagaatccagttctctgccaattctatctttcttattgttttcttgtggcacttctttttattcgttgctcagtctttctaatcccctaacacatgtatatctctcatgtgaatcatagcccctaagagtaacaagggactttgttattgtccttatgaatacatacttgatccttctaatgtgtgcttcactccttcaactatgctgtattcttttgtgtgccatgaagtagggatgtggtcaaatccttaaaatgaagattatagatagataaattccttttaaaatataagctgaactgtttccatttattcttaataatttggccacagtagggagaaatacgtggacacaattgaattattatgtttttttttttactagtgggaataaaactcagaatattgagtgttgttttgccttaaagattattaattggtcctatttatgttcttttttgttgacatactttacctgtatatggggtatgtgtgatattttgttatatgcatagaatgtataatgatcaagtcaaggtttggaggtatccattacctaggctatcatttctatgtgttgggaacatttcaagttctcttttctagctactttgaaatatataatacattgttgctaactgtactcaccctactctgccattgaacattagaacttattccttctgactgtatgtttgtattcatttatgaaaaaaaggtggaattgggctgaaggttaatatcatggatatattttctcctgtttattatgcctcatcggttttctccatttggcctctacttatggtgatatatttaacaaagtaaagaattgagaatcatgacatttagattgtgttgtctggttctttttcttccggatttggaatctgatctcataggatctacgaatgtattatgaactatctttagcttttctctaatttccctaattagaatgttttattctcaaaggtagcaacaaaatcttcgaatactatctctcttagcacataagcacttaatgtagggttggatacacattatataccaataaatgcaatgagaatgaaatagaactgtgatttttattggtctctcagatactgtgtggagagtaaaaacaatgttcagttgggaaaaatagtctttatctttcttcaaggttcatattacacattattagtttataaaattcattataatgtcttacagcaaagaagccaaacctatttaacttttttaaacccaacgtttttcaaaattatttggccatggaatttttttcccccacacaataccaatttcaattgattttagtgttctagggagatcaatttaagggatatggtagggcaaaatttcccaactttctttagtaagaattacatccaaatgaaccctctgaggatggatatactgtgttcttcctaactcaagcatcccccagcttagttatctttaatgaaagggtaaactcactgtgactctttaccatacccatagttatcttccttattttagcatctacttgccttctcatatgacttcagcatctcactcacatcttttctccttttctaaacctcagtgacaaaaacagataagttgaggatgtcgtccttcctctttcttaactcaaatccacataagctatgcataacatccccagatcttggacttctttgttgccttgggtgctccacctcccaggcctccctttctccatggaaactcccattccacctctccctccctcattctctctcctttcttcttccttttcttttctttctttcttttttttttttttttttttttttttttttttgagacggagtctcactctgttgcccaggctggagtgcagtggcacaatctcagctcactgcaacctctgcctcccaggttcaagtgattctcttgcctcagcctcccgagtagttgggactacaggcacgtgccaccacagcgggctaatttttgtatttttagtagagacgatgtttcaccgtgttagccaggatggtctcgatctcctgacctcgtgatccacctgcctcggcctcccaaagtgctgggattacaggtgtgaaccaccctgcctgcccgttttccttctttactcagcagatatgtggaggaagcactgtgctaggtcatgtagtattgagatattctctgcaattagatgaatatttgaaagtatgggattccaatgaataaaagataaagaggaaagagagccaagtccacacacttgtgaaatgtataattatgggtccggagccaaagtccaaaaggaaaataaatgaaaaaatagaagaataggacagccaccagtctgttctgtcaagtaaacaaaccaaaaaaggagtttcaagaaagaggcagtagttacatttttaaggagagactgaaaagttaccattgaatatggaatttcaagaaagcagtttcaatagagtatgtggggcaaaacccagaatgatgagtaagtgaaagttggtacaatcttaataaattcctaatggccagatccgattacagtttcgaatgtctgtgatctctctgatgccattgtcagcctcctgacatgtagactacctacttctcctatttttcatatccagtcttttcaagcaactcttcattaatgatagcataactatgagtattccataagggtaactaatttttttaatgtggtaggtaccttttcctcttagggacattatctatattttaacatctgtttttacctcctctgatgtaattcacaaatgtactagtcatttacacttgggtgccccatggccacttgcattcagcatgcctaaaataaaagtagtacgtttaccctagagttggcacatttaaactaattatttttgtcagtggtaacatctgtagttaaaatacttagaatcaaaactttgcttatcttgtaccttatgtaaacccaagttttatttaatttaccttgttaggataagatgttttgtgaaaaacatggggtatatgaaatgtttgtcatggtatgtgattgattttttttgttttgttagtttagaaaatgaaacttttaattgtgggcggaggcagagtttatatagaggaaacagcctgaggaattcatgaagaaaactgctggctttaggcaagtggagtataattctgaattcaggtatatatttgacacaaggtattcagcctttcgttagtgagcacatctgtcactgtagaagctggcagaatgctgccagtaaagtgacaaagcttagggagaaatcagaaattgaatatttttcactgactgggatgaggctatattaccccataaccgtattagtttaaattaagagtattatttaaggtatagaaagtattatttaaggtatagaaagtttgcattactttggaaaaaagttcttaggcttcaatattagctactttaattgtatattatttaaaaaatacatgaaaggccaggtgtggtggctcacgcctataatcccagcactttgggaggccgaggtgagcacatcacttgaggtcaggagtttgagatcagcttggccaatctgatgaaacaccatctctattaaaaatataaaaattagtcgggcatggtggtgcacacctgtaatcccagctacttgggaggttgaggcaggagaatcacttgaacccagaaggtggaggtggcagtgagctgagattgtgctactgcactccagcctgggtgacacagtgagactctgtctcaagaaagaaaaaaatatgagaaagcagagggaaacattccccaataatgcacttggaagtggaggtgaaagaggtggttctgctctcatttctgtgacctttggcaggttccttaacctcttttgagaccttctgaatctacaaagaaatgcattcagatctctaaggttcttatagctgtagcattataataatataggctattgttcaagggaactttaatgcaagccacatttgtacaattttgaattttctagaaggtacttttaaaaaggtaaaaagcaggtgaaattagtttataatatattttatttatctaaaatagtatcatttcaatatgtgttaatttataaacattgttaagatattttatgttctatttgtacagtcttcaaaatctagcatatattttatacttacagcacatccaatttggattagctatattcgagtgctggatcaccacatgtggccaatggctgctgcgttggacagtgcaggtgtagtctctttgttactggcttgcacagttcagaggctgtcacatagttacagctgtcagatggtctgatcccattttcagatctcttggctgcaataaattcagctcactcaagaatgatctcaaaccttcatgtttataaatgagaaatagcctgtctttggtcatgtgataaatttgtattttctcacttccttggccacgttgacacctattcaactcctaatggctgtcaccctgctgaaatattgacgagcacatgaactgatctcctgaggctcacgtactctcattatggttccttaaggtgtgtgacccatggtccctatctatctggctcctgactttggtgaacttggctggatctgcaagtccacctttaaccattttaattatttccaaaaggcctgacattaaattgactccagccatccacttcatgcttatttcttgttctattggcttttctagatgaaaaagcatcccaaatggtagacatccccatgccctgactcaccacagccaatgcaaagaaggaagtattattttcctttaattgatagggacaatccctcatcctaagcccctttcctcattcatcctcagcctagttatatttcatcctctctcactgagtaagcacacagtgtaccttcagtgtggattctatattgtttcaagaaaaggtcatattctgatttttatcttgatttcttttgggctaattttaagcacatttcttttaacacatgttggctttattaagtgcaaacatacattaaaatatcaaaaggaagaattattgtgcacatattcaaaagggtcccccagtcatccaatactgtgtggtcattttctttcagagctcagcaaaactcttgttttcctttgatttccaaacgtgagtgtccttcgctttttggcctgcatgtactacaaggcagcgcaacgtgcatctgttctcttggaagaaaatatcagtttgctgtcatctccacccttcagccaccccttatgttagtatactgcagaatgaaaatattgctcaaaatgcacttggtaaacattcagtgacaactaatgctaaaaacggacagatggtggcagcattgaccagctgctgctgtgcatggctgctcagggacaaagcggaggacctggtgttctcaatctgtcagccctgcttttcctaggaaggaaggaaagaactttgcaagctggaaaatcattaggcccaatcaggataactttcttcagttctggtggaaaatataccaagtgcaataagttgcagttaattaaataatttaattgaaagggtgctaggtgagctggtggagatgatttgggaaaatacgaaagccgtggcagagttcctgcccatagaacctttcaatgtgcagtctggacttcaggtggaaacgggttccggattactgtaaagacagagcttccagtaacagctttaagatcttttgtaaagtttttctctaaggacaaagacacagattgtttcccaagatttttaatgtctcctgctattgtaagtgtgtatttgtttccattttgttttttatagccccttttttactgcagggaacctctgcttttactgttctttacagtctgcaaaagaaacgctttctgatttgatggcagctgaaggtggggctgatttgcaaactcagggctcaactttaagtggagaaatgggaagagggcatttttcttctaggaaactgggcctttattgaggaaggttggaaagaggtagcaaaatctagctgagtcatagtagctaatgttagtttagcatttcctgtttgtcaggcactagctaagcaatgtctacacatgagttgatgaaacaactctaaaagtcaggcattattattactcttgctgtacagatgtgaggggagcttagagagattaaatgacttgcctaaactcacccagccaatttgtggtggagctgagctccctgccgctcagctcggtgccccacacttctgcgctgtgctgtcttccgggaatgctggctgttggggaatgctgatagagctgctggctgaaaaaaactattcaggagctgtggaggggcgatatagacccacctcagccagagaactattagcctaatattggttgtctgtgggagaatttcaagacaaaacaaaatctgtgctgtgaaaggcaggaggcctttgatgactccaagggtgatggaatgatgaaatgcaagattttctgcttatattcaggagacaatgacatatttgatcatttggctacagaaaaaaggagaaagaatctatttatccggttcataaagcaaattgattgatgagaggcgaagcacctttacattcacacactgtgtacttgtccttttctgcatagaccaagggtaaaaggagaagagatggtgagaaatccaggcaccctgtgggctctgcctttgtgaggaatcgtagctcagtatcacgagaactcctgacaaccttctctgagaaaacaattaggaacacagcctagaagatttgaatgagggctgttagaagacgcagcatcagctggatgcagtggctcatgcctgtaatcccagcactttggcgggcggatcactttgagctcaggagtttgggggcagcctgggcaatacggcaaaagccgcccccatctctacaaaaaatgcaaaaattagcctggtgtggtgacttgcacctgtggtcccagctgctcgcgtggcggaggctggagaatcgcttgagcccacgaggtagacgcttcagtgagctgagattgcaccactccagactggacaacagagtgaaactctgtctcaaaaaagacaaaaaaaacaacaacacagcatcgattcatagaagttgtgggatacgtcacgtacttcagagtcatttggaaattgtttgtgttccatgggcagtgaattaaccccctaacgttccatctgttttagtattagcattcctcctgcactgtggaattgtttcttctttgcaagctcatcttcacaggaagttgttttatttaatttttacttttctatctctgaatccctttggtttctagtaatattgaattgttttcaggactttcagatgagagctgggtttttctatagattcctatggctccaccctggggagatggcaggggtatgtcactgggcttttgggaagtcgggttgagcacttaccagagtgaggctttctgggcttctttcagccatagtacgtcccacctttctgtgggccatgacctcagactggttttcacattccttcctcctctcttcctccctgctatgaaagagccgtgctccaggacagcttgctgtcagtagggcacacacttttatttctccattatcaggcaagccaaaatcccagcttcctctgctatttgcaagaccaggagccaagctgatccaagcctttaccccagctctgccactttgtattttttttctggcccattgaagctgcgtcttttttttttttctttctttttttcttttctatcattgttgtgtctgagtgaaatgggatattgaaagtgtaaactcatagcattttctttacccagaaaagagagacatatttcaagtgagcataagaaaaatgtctaatttaaatctgcctgaaagaaaacgggctgacttgggagcacaaatcataaaggagaggttgaatgattgtctcttagagaagttttaaggagaatgccttcttccttctttggaaggggtggtgaattagatttctactgagttctctggtgggtctgtgagtctggctctattcagggctgttgtttctgcagttggtgatcccagatgggtgggctttttctgagtatttatgtcctttttatggcctttaagaccccttcttgcagtttattagaactatctacttttactgtgtttaatctgtgcttttagcagtgcagaaacaatgtcaagcacaaacatcagaactaatttagcatcaggcatttttatttggacttcagtagccagctttgttggtattgcacgtaaaagaagagactaaagaagctctgggtcagaatctaaggatctgtctgggagtaagttccccagtttagggaagtggacagactttttgacatttataggtctggatttttagttaccacattgggtgaaccatgtggtctgcctttttagaagatgaacacaattttagacataattggtagacgagcaagttttacatcctggtaagtcacctttgtggaggagaaagaattttagttggaagtcaggagaaccaacgttaccatgactctgacacttctaatcatttggtcttgagaaaattccatggtttttttgcacctcagtttatcaatctgcaagttcactgaatttgattaagcaatgtttaaggtttcttcatctccacaggttccaaaaatcacatgccactgcttccaggagggtctggccatatccagaagggggttgagttctttatttaagggttccctataccttagcagttaaggggttggccactggcattaggcattcctatttttgaatgccatctatatcgtgtaaactgtgtgatactaaggaggtcacttacctttccaattctctgtttccttatctataagatggaaatgaaaattacattaatatctgtcttacagataatgttttaaagtttaatacaataattcattaaaggactttgctcaggcatggcacatagaaaggcatcggtatgggcctggcacggtggctcacgcctgtaatcccagcactttgggaggccgaggtgggcagatcacaaggtcaggagattgagaccatcctggctaacacggtgaaaccccgtctctactaaaaatacaaaaaattcgcccggcgtggtggcatacgcctgtagtcccggctacttgggaggctgaggcaggagaatggcgtgaacccaggaggtggagcttgcagtgagcggagatcttgccgctgcactccagcctggacgaccgattgagactccatctcaaaaaaaaaaaaaaaaaaagcatcggtatgtccatctttgtgttactgtgaactcctggagagcaatctttctaccttatctgtcacagcctagctcatttatctctttattttgattgcttagttctgggttttatatgaagtagtgttcaataaacaaatgatctagtatttttgagaaacatgactcgtacaaatatagaatgaatacatgtcaaaaaatttgcttagctctttaatgagggagcctgcaagatagtaaagctgatttatcagaactagagaaaaagaattatgtacttcgtatcaaaataatttttctaaatttgatgcaaaactgatcaacgtcctatgagagaataaaactataaactttaaagcaatcatctcttcttgacatttgtgtctctataggacagaaatctatgttaacctacagttacacaattcttaggcctgcgaaacactattttagtatgacattataaggacattcaaactcctttttgccatttcaaattttggtcaatttttctaattagttataagactaaacccaaagtattatttatcttagaaaaagattaaacagggatatgattctagtatataagtatcaatttcctgcctaaacttataataggtactaggtctgtccataattatgttttcataatgtttcattaaggaaaatagagggatattcaggaaaacactatcaatttccaagatgatactatagagggcaaccatttaataagtacttatatgggccatgtaccatgttaagtgctttatgtacattttagtttaattagtaaacaatcgtgtgaggtacgtattattatccccattttgaaaatcaagtaaatgagtctcagtgaggttaaataatttagtcaaggttatgcagccagcatgagtcagaattgaaattcagtcttattctgagttttatattccctcctatgccctgttatactaccaaagtcttaaactctgagaaatttacaagggtgtttctagttaaacgcacgcatgaatgggtttagttttgcttgtgtgatagaacatgtgcaaaatggtcctttttcctttaaccattttgtaactgcctgtgataagcgacctttctgttccctactcactgaatgaaaacatacatgttttaaagaaaaataaaaccattctgtttagctcttggaagcctctgtttctcaaactgttttctttgtaacttatttatctttcttatatctcttctggcccccgatacgcctgtaggtgggctggatcctttccatcctggatgaactgcagctgagccctcagcctcctgtgggggtccttcctctggggactgggaatgacctggctcgaactctcaactggggaggggtaagaactgctctcggggactgcccatatcatcaaacaacaaaccggattccagatccactgatgttctaatggaagaggggggtactgctgctgctgtcccaggcataagttagagttgagaatcaaagtgcccttgagcccttatttgatctggtagcttcttcagtttaaacttaaaatcagctagaagggaaaggaaagcttggtatgagagaaatatagtggttagtacacaggcctgcggctttttgaggtatccactaaaagacagtgggtgagtttggcctcaagtctgcgtgcaaaaggatcatacagacttcagttaatccagactctcagccccagctaggatagcacatctggttcaactttacacaccttacttgggagagttatgactttttttttttagcattttattttgttttgttttgattagtgtcatcagagctttggctgtataggtacttacctgtcctttccacaatgaagccaacttcaggcaagcttgggggaaatcgttctgcagtcactaaacagccatttatttacttacgtatgttatagtactaagatagtaagaaggcgcaatatatatacacacactgtgtatatatacatatgcatacacatatacagccccaccaactttttttttttcttttttgagatgcagtcttgttgtgtcgccaggctaaagtgcagtggtacgatctcagctcagtgcaacctctgcctcccaggttcaagcaattctcctgcctcaaccttctgagtagctgggattacaggtgcccgccaccctgtgcagctaattttttttgtatgtttattagagacagggtttcgccatgttggccaggctggtctcaaactcctgacctcgtgatccaccagcctcagcctcccaaagtgctgggattacaggcttgagttactgcacctggtccccaccaactttttatctgctcatatgagagcattacatgggctgggctctgtgaaaattatattcagatatttagtagatgctagttgacctttgggcaaattaaccttccacaggtctttttttaaagtaggcagtgtagaaataaaaaacgtatttacatggggcaactaaggttatcatcagtgttaacttctcccttccaaatcagagccttgcatatcctattgaggacagtctatcgtgctgtcagtaatggatcttcaaggattaagtagctccctaacagggccattcctcagtgagacttgcttcaggtcacgggaagaatggtgtcttccaaggaggtcagggagaggtgattgagagggagtgttaatagataagcattgtcaatccaatccctccttgattctttccctgcctctccaaacacatttgttttgtgtttcccccaaattcctccagtgagagccatggggagtcctgttttttactctgataacaaagtagccatccagcctccagtatgacccttaatgtgtaccggtgactattggttcttgctgctgacaaaaaatattcctcagctcaaaccagccagaactagtgtttctatgtatcttacttatagtattgtctcaaattctaagtacctcaaggtaaaaaatttgctcttcaaaccttgctaattataaaataaacaatataacggcttggctcttccttgcgtaaaatagcattggcttcactgttctccactctggacagcaatggatatgttctctgattcctcagggctacactgatgaacctgtttctaagatcctgtgtcaagtggaagatgggacagttgtacagctagatcgctggaacctccatgtggaaagaaaccccgacttgcctccagaagaacttgaagatggcgtatgtaaggttagagagttttttgttctgcagaaaggagccctggagcatctgcctgagctacaggaaaaaaaatcctggctggagagtcatgtgctgatgaattcctatgagataatgtgataatatttgagttgatggctactggggctatgtgtataatattaccacctaatgattctgccccatagacctctaaatacctagattccgtacctgcttccaaagctcagggagctcttctctgtcttcaacttctgcactagaaaggcatgtattttgtcttaatcattcatgttaatagcaaataacctatgagaagatgaaaaaatatgtatatttgtaagcattgggcacttgttctttcagtagaaatataacctcctgagatttctggcctgatataaaatatatcttacgttgaagaggtattaactatgccagtgttaccacttgggtgggacttgaagatacctcaataaatgttttgacttcatgttatttaaaaaaaaattgacttttattttagattcaaactgcatatgtgcaagtttgtttcatggatatattatatgatgctgaggtttggggtatgattgatcccatcacccagatagtgagcatgttaaccaacaggttttcaatccttgcccctctccttccctctctactctagtggtccccagtatctattgttgtcatctttatgtccagactttatgttttcttttagtgattgagcttttatttcaaccgaaaagcaaaccaagggatatatgaatagttgtaattagtactgtgagccttcagttggtcctttggttctaaattatggcctcaatttcagataaatttggtaggtttctgagtagccacttccctcatattactttccattttccttctatgattgaatttttaaactctgtatgtgtaagaatctccaggtgtgtttgttaaaatgcagattacaaggcccagtcaccagagattctgattaagtaaatgcaagttaaggcccagacatctgtactttaaatggtatcccaattatagtgaaccatgccatttattgaggctaagattttgtgggtatttccatcttataatagattaagccccatatcattttagatttagatcaaaccaacacccatttattagcatcgtgatcctgatcaatttaattacatatattataatttaatagattttcaagtttctaacttggctaaattagattaaaacatgttttactctgtctttatggttttttcacctaaaccatgatcctgaaattctagtagatttctagtagatatcatgattgctcagctgaattcaagtttataatgtcacaatgttgtttaaacaacaagtgtcatcttgagatacgaagcttttttttaatgtgtttgacttatagaaattggatagaaaacagctaaagtataaagaagagtaccatatggatattgtaagtttcttttcctactaaacttggaatagttagacgtgcaatagaaatccatatttaattctctttccaacagcttaagaaatggaaagacttcttggtgtagccagggaacaccaatccagataattaaagggtttatttaaaatgggtttttaaagagatgtatgggaaactggggcaagttttcctggaaaatataaataacttaaaaacagactaaattgggatatgatttaggtgatggtgaccagatgttctccttagctatcagtagatgttaagacatgggttagaattgtggccaaaagaacataaatggtagaggaggtgaacatgtctgtgcttttggcaggatcaccaacccatgctgtcattactaagaactggtattttgtttaagtgcaggaactggatattctcaaataagaaggctgaagagtaagacatgattttggcattgttctatgtgtttagtttctctctcggtccttcatttagtggagaccatttctaaggctcacttggactctgaatcattacataggctttgaatcaagagcttccatgtggggtcattccttactttcattagagaccaagccaatccaattttcttttttctgcatttatatctgtcttgttccctctcttatttcacttttttcttaatgaaagaaagttctccttctagtgaaacagaaaatcttgctaatcaaggggcatatgaagcactgtaaaaaacatacttttgaaatcttgagggttaaaacacttatctctcagagaagacaggtacagttcaatttgggacacaaaccggataattagctggaaacatttctcgtctttatttactttaatatttaccttccacttgagtcgcagaaggaaaagcgggagaaccagccattcccactctcacattttccgcatgctttcttaattgttctaacatttaactgaagcttaaaatcacattagttttgcagttttaatgcaggatttgaggctgcagagttctcttcattcagcttgcagtggtaacagccagagacccaaaggactctaggaaggaaagttaaagcttccatgtgtatctgtgtggctgtgttttcagatttcatggtcataataaagatataagggttgatagattaaatgagaacttgaataatagtaataggtagttttgttgttgtttttctctctaggccagcaataaccaatgggtcacattgccctattttttatatgacttttgtaaaaaagattgtgtgtgtgtgtgtatatatatatatatatagagagagagagagagagagaaaatgggtgatggataaacaagttaaatattcattttacattacagtattggtttgctgaatataaattcttgaaaaacgcacatccactgattaagttggttagacattatctttacaactggatttactttctaggtttgcttagtgaattcttctctgtaactattgcaaatatatatccttcagcataacaagttcctattattacagcatctataaaaatgattctcatttaataatttgtatttgtgacacatttcttatactatttataattcttgagaaaattacttgattttagctttcactcatgaattaatccaataatttcctgttctttctacataagcaccctccactttgagttgtggctgatctgtctcctagggacttcttcagagataggggtccagctttaggttttattcttctctttctgcctggccacacaaaattttgcctctgtctttgtttatcattgcagctccctctgaatgttttcaataactacttcagccttggatttgatgcccatgtcacactggagttccatgaatccagaggtgaggacaacgtcccatttccatctcccagggaggaagtttctagcaggtgttttgcatgttcccttttgtttgtatatcacttacgcgtttacagtgtgcttcagtgttgtttcattttaaccttcaggatgactctgggagctagacaggacaggaacttcttataaatgggaccctgagacctagttgttcagacaaatgggaccctgagacctagttgtccagggtcttaaagacagtaaagggcaggactagatgtgtgttccaggtcttgggattgttaatctttatgttctactggaagatttgaagtgagtaaaatactaagaagtgatagagactattactgaagtcactaggatattctttagcttcacaaaacactattaaagtgcaatactacacaaccacagccattgaaatatggtagcaaaaacaaaaatgtcccctctgtttgtataaaagaaacaacaggcatcttagaacaatagaggagctataggtagtttaggttgaaagcataggatgtaatggtgatgggattaattaggaaggtactagggatccccactggatgatacagaggtgtgaatgagaccatgtagtgatttcaggtactaaaagagatggagtcaagattaggggaacagaatttttgaaagagaagatgaaataatgatatgctattaaatatttcatcaacattttctcatgccatttagaactgataaagtttatgggtttgacttatgttttgtagtcccgattgatctctctctctctctctttctgtctcattctgtctcttaaactctgttcttattaatatagctatactatatatccatgtctatgcctgtatctatatctgtacctagtgccttctgaatatatataaccagaaccatgctaggatgtagattgttaagagacttgtgagataaagtcataaatgagaagtactttacttttttccctccaggttatgtaagaaaggaagtggtgtttagaatttttgcatactttggaatttgaaataacagagcactaaaagctagaattcagattttcagattctggtaataacatgaaaattctgatcatgcacttatgcactagaagtcaagagtgatgctacaggattaaaaaccactagagtataaaatacaagtaaggaacagatctttaaagtctcttactggatccagcaatgttagcagactttgaccttcctggtttcccaaggttttgagaggacaggctctgtaaaggtcaaattctgtgccaagcaggaatgatgctgtttgaagagaaagccatagtttggtattcctctctgattggccagaaaaatcacagctagaaggcatgattgataacagaacctcaaatatcctgagtcagaaacactaccactttccgcctccctgccttagacagttcttggatattaggtattcagagggacttaccttggggccaacatttatgacctgttacccttcttatatttaaggagagttaatttgggaagtacatgggggattttattcttcatttcttaccccattttttatctcatattctttagcaggatccagatcctgggcttcttaataaaataccccaaacttcttaataatacttgtaaagtaacacaattatcacaaatacatggatttccaaaaataggcatgaaaagaggtctaaatgaataagtggccaacaatgagctcattcaatgagctcaatgagctcaagtgagtctcatatttagtctaacttatccggaagtttttctaatgattcacttccttgaactatgatgaagtttctatgcatcagagtgagaagggagcagggagagacccttacatgggaagaccaggcttagaagaaaattcttttggggaaagtgatttttctcttttattttaagctgtaggactattttagagtggaatatgcaaattgttgagtgtatgaacatgtacatttatatgtatgtgattataaaacaattagttaaagatgtcaagcattaatctttgtatagtttattgctaaggcttattgtgttttgatgcagtatgaaatggaattgtaaacatttcccctgcatgtaaatcagagcctttgaggaaaatcagccactgaagggctgttaagggagaatttatgttaattggaaataataggtaaatattcatgcaggtgggatagaggtggtaaaaaaattaaataactataagatattggaaccagattttgctgatacacttagaccagaggtatggacttttcagtagctgttattctgctttttttaaatagtaaattaaaaaattatttgtctatgaaatatataattaagcaaatagcctttttttctttctttttttttttttttactgtttctgttcatttgtattttccccctatttttaactagttagtcaagaaatcttaagctaagctatagaagaaaaaacaggataagcaagaccagatttttaattgtggcaagcttacttattttgtcagtagatagtgagtggctgttctcaaaccaagaaaactcatagtgagactttaaactgttttccaacacaggcactgtctgcggcttcatggatcacttgccataaaatacctaaagggtaacacaaaggctcatgaaagccattgtgaaaaaaataagcttggatagtagaatctatgaggtattagtcaagaaaatgtaatacttttaagttgagaattatgccaatacatctacataaaaataggcaattaatataaatctcattaaaggagaatttttaaaaatttaactatggaaagaatttttagcacagatgtaaatatagcccatcaaatggacacttctcagcataactacatatattgtatttcttttagaaggaataattaaactggcattaattcccaattttatatctactttattccaaacacaaatcaaactcaaaaacatgtttaattacatttggaagctgcatacatagcttacggaagtcatgccctatgaaagtcaaagtaaataatcgcttctccaccttcttccaccttttcctgttatctcagcccgatatccctggaaaccctccaatttttacaaagcatctagagtgcctccatctttaatgtgcttgagaatcacctggagagctcccctccacagatgtatagactccacactcaagtcattctaattcagtagatctggctagggcctaatcatttgcaattctaacaagctctcagctaatgtcagtgatgccggtttggaactacacatttatagtcctggattactgtccctgtagcactgggctactgtactaactggcctggaactgggggaaagatgataaccaaaccatgggatctattggatctgtaggataggagggagctggggaggaagtaggagtgctaatctaagtcgctacctttagtgaggtctccataacaaaactacttttcctctttcacagaagcaaatccagagaaattcaacagtcgttttcgaaataaaatgttctatgcaggggtaggtatacattttatttcataattactacatattacttattgccaattcactgtgtatcataaagttgcaaactacatgagaaataatcacatatacatctcatttatatatgtctatctatggttactgtttcatggctgggcttaagaatgaaagtgaggtgtatttcttaagttagctgtcagaaagagagttggtgttcctcatctctgagcttttaagcaagccccgaggcttcatgttgaacaagagaagatgctattcaaaaagggatgtgagaaacaaacatcaaagccagtgtaagaaatggaggaattgtgtagactgaggatgtctgaagaattttaggtaagaacgtagttttcaccagggtgcgcacattgacgtttggattagaaactggcagaatatggggtgtttttcatggacgcatacgtgaggttaaagggagtgccttctttttccttcttttgtttctcaggcacgttcatagtagtaaatagagaatgaaaaaaaggcatccaaaatatcagtacagtttaaatttatgccaatcgataggaggagtttaaataaaaggcgtttgggagctgcatacgtagtttatggaagtcaaaccctgtgaaactcagagcaaataaggaaatcttagtggaaagactgtatcagcacttaatggacaaggcaagtgttcagaaaaggttgtcaaaataaaccttccaatgaccctcagaattgtctatttttcactctcattctgtgttcttaaatttatagtgaaactgtaaattatagtttggaaacaaagagaaaaatttcaacttgacaactactgcactgctttactttggattctgcagaaagagaacatgtttagaatttttgcatactttggaatccttggaatctaggatatggaagcaaggatttggtatcaccatgtaattacgaatttcttcttctttatttccctgtggtataggcagctttttctgacttcctacagagaagttctagagatctatccaaacatgttaaagttgttgtaagtattgaatatgttgatttatttcatttgaatatgatatgactgccacaaaaaactcccaaatacttagtttatatattgaatcactggactgcatagaactttggagatcattttgtgtagttcattcaacctacacttattatgtgtcaggcactgtcttagttgctggggatgaagataaatgaaaagactagtttcgctcctgaagaaactcacagttcagttttgaagaaggtcacataagtcacttcagaacaataaaactgttattcaaccgtgtgtataatatggttgtggcacaaagggagaagtgataactctgactatggtggggtcaggaagacctttataaaaaaaaatgatgttagctgggtcttgaagcataaatcggtactctccaaacaagtatctttattccaggataatctgaggaggatatttattccaggataatctccattttagaacgaagtgttgatttcattattttgtggtgactcactctcccacctggtcaaggttcctcaccactagatggattttttgtgtatgtgctgtttcttcctgggtctctatatcaggttgcggaaatatactgcttgggggcaagggagagagaaatttatctttctcaaggtgacacattcaaaaatagaataaaattaggtattaagaaaaacattaatgtttccttatagtaaacaagttaaaagaaggaaggaacatgactttgttgcacatagtcgtataagtaaatgacagaatgagaaagagaaaaaagatatatagatggaaaagaagtgatgagaatatagcaatgtttgaatttatcaatgcttgaatttatcttattctaaagaataagaataattttgatgggccaggcgcggtggctcatgcctgtaatcctagctctttgggaggccgaggcagctggattgcctgagctcaggagttcgagagcagcctgggcaaaatggtgaaatcccatctctatcaaaatacaaaaaattaggcaggcgtggtggcatgtgcctgtagtcccagctactcgggaggctgaggcaggagattgcttgaacctgggaggcagaggttgcagtgagccgagaccgcaccactgcactccagcctgggcgacagagcaacactccgtctaaaaaaaaaaaaaagaaaaagaaaaagattaattttgacaagagagaacagaacaaaatatatacatgaaaatagagaaaaatatatgatcttaagctaatgagatatgaagaaatataaggagcatgaaaatataaaaattaaaatgtgtaatcaccagtaaagcatgtataagacatgaatctcctaaatcagttgaaacaagagacaaaggcctttaccgctgctattagcaacacttggcatccctttcagatgtttcagttctcatacaataaaaatataaagcaagtatcttttagtggtggagacgcttgagactgaaatattgccttcttaaagctagatacaagaacacagggcccattgaactatgaggattattatttcaataaaatcgtggctattaaatttaagtagcagcaaccttacattaaacttcccctgtttcttcagctgcctgcagcctagcaaaaattaaactttactgccctttccagtgtgttttgcatttacaggcgcatccacagtacctgccaggagacccagtgcatgctgggtggtggccatatagaatggcagtgtactgtgcaagtcaccggattgatatcaaactctgtaacttcctaactgctagagagttttctctctcatatctcagtccccttgatgatacatgtctcatgcatgggtgactttatagtagagtctaaaagatgcttgcagagaggccaaaatggcagcaaataactaggaaagatgtgatatcagcctatatatgtaatattaaaggtggaatgtttatataaattatatcttatgaggaggaaaaaaatcattataactaggtgtaaacatttgggatttagttaggtctacctttgctaggtatatgactttggggaaatcatttaacctttcagaggagtttgctttcttcatctgtcaaataggtgtaacaagacatgtctttgatgcaatggtttttgaccattgtgctgtgacatagagagacacaaggatacttttgcaatgacatcattctatgttttcctgagtgtgagatgaaaaggatggaaggttagtgagagtgattagatgtctccccaacaacagagcatcttttctttgtcagagggtgaagtcagtgtttctaatgcaatagctagtaatgtctcatagagatataaaatatgtatttgaatattagactgagaaaatacaaaatgacagtaaaaacctacatatagccattatttgttccactttccatattttcttcttgttatttatcagtatatgagcttatacaaaggaacatattttggatgcaaatatgtccctttgtgtgtatttgaagttgggaaaaagttgaaaactgctattctaaaggaattgcacagtttattgcaataatatataaaaaaatctctgtaaagcagtatacagtgtaaggcccacattttcgtatgatttgatgagttcccagaatcactaacatgtttcccagaaggaaaaagtagaaagttaaaaaatgaattctgttctaaatacaataatatttattataatctttctgcaatgcaaccataatgctttatacactattaatatatcacatcctaggttttaagttttagttgcttataacatgcaattttgacatttacaatgtctacttttttattcattggcatagtcatttataactcatttcaagttcttaagtaagttggaagatgtttgcttagtagttgagagtactagaaaaacatctttaatgtctagaattttattactaagttatatttgaaaataatttgtttatttaaaattgtaagatttcttggaaacaattctttgagaatactcatgaaaattaggctgtatggagatcgactgggaaaaaaaatgcaggtgctggagacaacctgaccactagcaaaatcattatacttagattgaaactgatcctaaagaactctttcagaatttgcagggagcttggggatgctttgctcctctctccaaatgagaaggtaatggggaaatcctgtgataagggtataaggaaagcaaatacgagagcaggctttacgcctttgacatcggaaagtctatagtcatgactagagttattctcttttgacttttgtcaccagtgggaaatgagaaaggaacatgaaagacttttccttgatttatcaaaggatgatacccttgcagaaagcgctagcagatcagggaagccatccatgttcgagggttgttgaggccaagctaggctgagacccttgattcccaggtctaaattccaggaagacagtgaatcttagaagtctaaagtctgaatggccaggcgcagtggctcacgcctataatcccagcactttgtgaggccaaggcgggtggatgacctgaggtcaggagttcaagaccagtctggccaacatggtgaaaccccgtctctactaaaaatacaaaaattagctgggcgtggtggcgggcacctgtaatcccagctacttgggaggctgaggcaggagaatcgcttgaacctggcaggctgaggttgcagtgagctgagatcacgccattgcacttcggcctgggtgagtctgtacaagattaagtttctaagaacaaaccacgaatgaagataatactactgtatgatagatatcttttcaaaagtttgcggtacatagactttttaaaaagtcttcaaaatatttgacatttgcaaaataaaaattgtctcaaaaaacgaagaaaataaatcattatatttgtgacttgtttgaatcagataatgatggtggtgaatactactgctttaacttgaggcttttttcttttcattcttttaagtgttcataaatcttttaatgttgacaccatcagtctagataactaataatcatccattgttaagaatgataatatttcctttgattgtgagaccagagaagaaatcattttaatcaaatggaggttttgttcttaccttaagtgcgaacaaaaccaacctctgtaccctgggtccagtaaagctataaccagaatatatttttaatcactgtgaccggcattcacttaagcagagatagggcaaggagaaagagaccatggtgtgtactattgtcaaactagttatctttcataggtttttagacttgtgactacttcaaaaccccttttctgttttcattgtttcagtgtgatggaacagatctcaccccaaagattcaggaactgaagttccagtgtatagtatttttaaatatacccaggtaggctctgtttgtattgtttccttggtttgacgtgaactctgacttgaggttatctgttttcataacagaaaagtttcagatgtaaacaatgaagatcagttatctaaatgggtaattaaagatttctaggtctgataattcattctccgatttggtttatttagtgttctttgtggttggtggttttgtgcgtcatgtggcatgcattgtctgtacttacccatctttaagaaacccaggcacccctcttgactggaacatcttaatttatttctaaattactgttcttcccctcttcctccccatctaagaatgagagaattgaaacactttttttgttctcagtttcctaaaaactgttgaaaaaccatccagtctgattcaagtgcggaattcattcaaaattgttgccagatgatttctttgaaaaataggatgagttagagtattgttttctagccaggatgtcaactctccatggtgctattacgcacttcaggagaaagggatatttaagataactagactcaaaataaacatattatctcagtggcataaattatgttctaggccctgaagccaagattttggaagggatggatctataaccatttatttgcctgccaaacaactcagacacaaaatctgcaaatacattgtatttagactgaatttaattgaaatgagagttgtatgtaaatctgtggctaggaaaacacatcatagtctcctgattattcttggcagtgctcaatatagtcagttacaattttattccagaaatatttacagcttaattgaagtagaaggccttgattctcagaaagcattgtttattactttgctttattattctttctcttgtccttcctctcttgtccttcttcctctcttgtccttcttctgtcttttcttgcttctccctctttccatctgtattcttcttcctctatttctccaatttcttctgtttcccattctctttctaatctcttatctatatttcatctcttcttcactctgtcttccatagttacctttcccttctcctgtgagtacctcttattttgcttatgtattaatggcaaatgcttcccacttcatttccctgtctcttttctactggcatgcatacatcttcctttaagaccaaattctgaaaccacctatagataattcatgatatatcatagaaaacagacatacatgaatcatagtgagaaatatagataacgaacgaggagaaagttggataccacaggatacttttgttgcaaaattatggcccgttttcacagcttggtattttgtagatgataagaagtgcatttccttttctaatggaaggtgtgtaccaagaatggaaaactgtttttatgtttgataaacattgggtctaactacaaactaacacctcatgatagtcatgagaaggatgggacatatttacttctgtctttaatcttctcttgcagatattgtgctggcacaatgccctggggaaacccaggtgatcaccatgatttcgaacctcagcgtcatgatgatggttatattgaagtcattggatttaccatggcctctttggtgagcaatataactgttttattaaaatgaaatgtattttagtcacagagtttattcaattcacaggactttagttaactttttctcctgctttatcaagttacacattttatgaattatagagttgcttaggaaaaacaagaaaaaaaatcatcatttatgtcactaagaaaactgatgcacatttgtttgaacctcaagaataaatgagtatcacttcttacttttcctgattaattttctaacagaatgaaaagtttttatgctaattaaaaacattacactgggctgggtgcagtggctcatgcctgtaatcccagcactttgggaggccgaggtgggtggatcaactgaggtcaggagttccagaagagcctgaccaacatggtgaaacctgcctctactaaaactacaaaaattagctgggtatgatgtgctgcctgtaattccagctacttgggaggctgatgcaggataattgcttgaacacaggaggcaaaggttgcagtgagctgaaattgtgccactgcactccagcctgggtgacgagtgaaactgcatctcaaaaaaaaaaaaaaaaattacactatagaaacatcccagcattggcacagaagccatagcattttatacttttttggttcactgaggagttttgtgtttaggtaaaaaagagacagtagcaacttgtggatatccgtcttacttatgagtaaaatgatcatctccattatcacaaaatatctgaatatacaaagacatcattattgtgatattagtgcatactcagttgccacaatattgagatcaccttgtattttaattttgtttgcttgcattaaggaaggaaatttatagtgtaagtatattttcaaacaggttttagccatgcattcctgcttattattaaatgatgtgcggaccagttaaaattatgcttatcatttcttgtgtaaatcaggccacactgagtttgtaatgcaaataaaaacaaagcttctgcttgtcacctttggttggcacatgatttgtgctgtaccttatgcataaaagaaagaaggttgtatttctcattctaaacaaatcaaaataggtctctcttttactcatcttatgaattccaaataactctacctcaaattagtgaagtttaacagaaaaatctattgtgcttatggcaagaatcttcatcacctgattttgtgatggcccttgttaactcatctctagaataaaatagttgtcatggtagaaaagattggactggggttgacttactttccagcgttgtaacacaatatagctccttatctccagagctttttatgtttattgcaaatgaagatacaagccaagagcaaataggattaagtttaggaaggatatatgcagggaagaattctttttttttttttttttttttttttttttgagacagagtctcactctgttgcccaggctggagtgcagtggagcaatttcggctcactgcaagctctacctcctgggttcacgccattctcctgcctcagcctcccgagtagctgggactacaggcgcccgccaccacgcccggctaatttttttgtatttttagtagagacgagatttcaccatgtttgccaggatggtctcgatctcctgacctcgtggtccacccacctcagcctcccaaagtgctgggattacaggcgtgagccaccgcacccggccagggaagaattcttggaggtgacaaaatcatgcccgtatatgatggaaaaaactctctaaactgtccatacgtgggttacttattctttattcactgatcgagtgaacatttattgagtggttatcatgtgctagagcctcctagttctgactgtggtagaaggctctcagggattgtctgcaagatgacaatcccttacctaggcctggaagtccaaggggaatattcagtatttccccattgctcttaggatcaaaatctctgtccttatttggcctgtaaagttgaggttctgtctggttctctagccttccctgctctcatctttgctttctagctcaagcagctgacaagtgaagcacagcatcggctctcccttgcttcttttgtaccaccaagccattgcacgtgtgctctctctctctgaaatgtacttcaactgtttcttctatgccttctcagactatatctgtgtcttgttcttgttctttttgtagtcttttctggtatgggtgttttttttttctaacaattgtataattagtataatttttattatactaattcgtatatttagtatgataattagaatattacactaattatataggagcaatactgaaactgggtaattagtggagagttgaatggagggctctttcacaaatagtgcactaggtttatgagaaaccaattcttgagctgaagataaaaaggaaaagaagataaaaaggaaaaacagtaccagaaaaagaactacttggaaagggttacgtgataggagtgatatttgcaaagaggaagcaagcaacctgtgctcacctggcagagagcaagccagggacataaatacagcgactgcccacttcaccttgacctctagatcttctgctggtgggtctatctggagaagtctgattggaagccagaagacatgggagccactgatgcagtccaaatagctcagcctcacagagcagaaaagagggcagggaaggctggagaggcagctggggcagcaaatggtgaatatccatcactccactgtgggtggccagtccacaacagggagcctgtggcatgcagttggcaatgcgtgacgtgactgactgaattttaccaggagaagaagaatggaacttggcattctggaaaaaggaaaatttacaaacatttggaagtaggaggaattgtagtgctttgtgggaactataagtagtttcatgtagtttaaatgtaggtgaaaagagagagtgatcacaggtggtgctaaagatgtgggtaagggccagatcatagagtgcatcacagcactgatctaggagcatttactttattcagcattcttgaggagttagtaaaatttttttaaagataaatatttatatgggaaggtttcagtgtaaaaatagacaaaataatacaacaaactcccaagtatcatcactcagcttttataattttcaattcatggacaatcttatatttgtcccacctacaacctcttccattatattattctggagcaaatcctagacattacgtatatacaatatatgtcatatatacatcatatgcatagcatatatatcattttatccatcaataattcgaaatggacttttaaaagatactttcttttataaacacaaccacaataacagtatattatttaaaaaaatgaaaataatagtacctgaatatcactaaatatttactcagagtttgaatttccagttgtctcacaaatatcatttattttcttatgcagtttctttgagtcggaatccagataaaacttacacattgtggttggttgatatgaccttaaactctccgtagtttccccttcaactcttcctcatttatttattgaagaaactggtcatttgtcctgtcaagtttctgagtctgaattttgcagataggatccctgaggcatttattaaaatgtgcttctttcttttttctgtacttgatagctggatctacatacactacatatattttcccccaaatctactttgtaagcagtgttttctttttctaaaaaagaatatataatgtctggctttctttctccttttttaatgttggcagatattgatggtcaatgtctggatgtaggaaacattaagggttgcaaaatagtgatattctaattctcttttttttttttttgagatggagttttgctcttgttgcccaggctggagtgcaatggtgcaatctcggctcactgtaacctctgcctcccgagttcaagcgattctcctgccttagccccccaagtagctgggattacaggcacccgccaccacacctggctaattttgtatttttagtagagatggggtttcaccatgttggtcaggctggtcttgaactcctgacctcaagtgatccacccgcctcggcctctcaaaatgcttgggttacaggcatgagccaccatgcctggcctgatattctaattctatccttcttcatttactacttgaaatatttctatgaagagaaatttcacttcacttactatttgattacttagtcatatagtttgtataggaaaggctcaataagtgattctttttctttctttatacattttcaaaatactgagttagttctctagcatcctccaatggtgactctggttttaaatggccttcagtttttgaacaataatcccatcaaagattggaatttagcttcccctagtatttggttgggcccatgactacttggatgagttgaatacagtgaagtaacactgtgcaccttcctagtctgggtcataagaagtcctttcagcatatgggaaatttgagtgctagtgatgatgtctaattaataggattttttaaaaattcaaggtaatacttagttcaactgtctctctgctttcattcctttagtatcaatcatactcatttattgaatactcactgagtctacaaattctgcatccctaagtgggatactgctagataaaactgttaagaagtgaacccaaagaaaagccctgtcctcagtgtgttcatagctcggtgttatcagggggacaaaggagtaaacaagcaatcataatctgaggcagcaaattctaggagaaaggctggggtgagagtggaaagaattgaaatccaaacagtgtttgtaaaatgaggttgtcagcaataatttcttagaggaggaaggagtccctgggagtggaattgccaagtgaacatgaccatcagggaattagcctaagagaccaccatatcctaggagagggttccagtggtggctcctagtaatgacacagtcaatgaagccgtggatgtggagaaagggcagagatagagttctttaaactgtcaatggggaggctaaaagagatggagtaaaacagggtcagacttgtgctttaaaaagattatgcggatgacattgtaggagacaaccagaatttacaactggaggcaggtagagaagtcagaatgctggcatgtgagtccaggtgcagaaatgagaaggtctggccaggtgctgtggctcccgcctgtaatcccagcactttgggaggccgaggtgggcagattacttgaggtcaggagtttgagaccagcctggccaacgtggtgaaaccccatctctactaaaaatacaaaaaattagccaggcattgtggtggtcacttgtaatcccagattggtgggaggctgaggtaggagaatcacttgaacccgggatgtggaggttgcagtgagccaagatcatgccattgaactctagcctgggcaacaagagtgaaattccgtctcaaaaaaaaaaaaaaaaaaaaaaaaaaaaaaaaaaaagaaatgagaaagcattcaagcctgaagaaagaaagtgccaatgaagacagaggggctggtgagttcaagagagttgtttggacatagtgacgtattgtgaagggtacaaagggaatagtatacccaaattccaggaggctagcatagatagctaggtaaaggataaatgcattaaatgagatagaaaacataaaagagagaatatctcaaaagaaatacactgtgttttatctattttaaattcaaaatctctgtaagacatctaaggaaatatagaaatggacaatttaaaatatatgtttagagttcaggagatcttttcaggagagattgttttggagagggaggggttctgccagatcctttttattcttctcctatcatttgtaggaaaaagagaaataatcgcagatggtagttggcaaaaaaggaaatggaatactaaaattaggtccattatttttttctcttttcatcatgtgaataaggtaatccatatacatcatcagctagcatcaaatgcatgattgaatctcagattccagtgactctaattgcttccaagaaagagaatgctatctaagaaaagcaaaattaaatggagtttaaactgtatggttttgaacattctatgacctctaaatgtatactggcatatatttctctctttttagacacattttatcttactacttgctactcatatagcagtaaagcattgtatttttttttcattcaggatgaaataatctaatttgcagtcttcaatttcacatttcttgaactactatattgcttatatttctaaggaagtaaattatttgaaaactcaaacatttgtttaagatgattatgtaaacagacaaatatagttatttgggtatatgtgtatatatttttgcatatttaatatagctgctatataattaaaaacataaccagtaggtcaagctttttagaaacaaactatttttcttagaaatttatatgtgtgtagtaattaaaggctataaacttaaaatcatggaatacactaataaatatatttgtacattgcttatgatttcagtgaaatccaaaaaattgaaaattcagaatggcacttttattataagagagctttgaaatagaattactggaatgagaaaaaagactgtttcttttagactctttatcttgtaattgcaaatttcaaagtagaagtcttcaattcattttactggttgaaatgcattcctgctaattaagatgattcttcattgggtgctgggtaatctgattacctttttggagtttacacagaccataatcagacattgtaatttgtatttatttctgccacaattttctgccattattgtttctaaggtcctttcatgttgagtttgtttctaagtaatttaaacttctcaagacgttcaaagcattattcagtcagaggaattgggaacctaatttgccattcagtatgaaatccaaagatttcagtctcgtaaactttaaagaaggcacgtccagctttctttttgttaattgaaataaaactgtgtaagtttctttatagttatgaattaggaaagcaagaggttatccagtgagtaaaaaggacatggagaaattctcagggttgaagttttacacttaccatatatctttgttttaagaaaaaggtaatattaaatgtatgcttattttgataatatacataagaattaaagtaaattatcagttataattttatgactcataaataaataactatatttgatgtgtttctaattgctttatttttacatttttaaaaatacatgaaaccatattataaggaaaacccatactacaaatggctacctacttttttattgtataaatatagcctaatttatgtaataattattttatgcaaagtttcctttatgaagcttttaggtttttgatgttttatattgcagataatcctgtaattaacataattgtttgtaaacctctcttcacatttcaaattattttcttatggcaaatcctaaggaaattacaatgacataagcattttgaagcctcttactaaaaattatagaattattttttagaaatgtcatactgtttacttgcccaagagcggcatatagagttcctggatgagaagtgatttagtagacagagttcctggggccggccgcgactgtggcggtgggggcggtaggagccccgcaaggcgttgggggtcgctgaaggccagccagctgcattccaggtggcacgagggaccgcccttgtgctcagagaagtgatttaaatatccaacagatgttgaaaatgtgttaatggatacagacataaatgatgtttaaatattatacttgatgaaacagggaagagaataaacttccatccctggaaggaagtaaaggaattatatatgttttatacagataaaattctggaacagacaattatgtccttacaaacaacaacatttgagagtaaggataagtttatttttattgttaccattttgttttttttaaaagaagtcaaatgtgtttttttgcatattttaatgggctgtttatcatttattgttgaaatagaagagatatattctggatacaagtcttctgacagatttatttattaaaaataaattctttttgtttatacttttcctttttgtgtttttagtgtttgttttgatgagcatgttttaaacatccaattttatgaaaaaggcttaatttgtattagagctttttgtgtgcttcctaagaaatctttgattactcccagaaagattgggaggccattctcctatattttcttcttgaagatttataattttggcttttatatgtaagtatatgattcagctcaaattaatttttgtgtattgtgtaagatacatattcattcataaaaaatgcatttatccagctttttccagcactatttgttgaataaactttccttttctgtaaaattgctttggtgcttttgcttggtgtctagattctattctgttccattgatttgtttatcctcattgccaataccacactgtcttaattagctgtatggtaacccttgaatctggtaatatgaatcactttattgttctaacagtgttttccttgttctagatctttgggcatttgcatataaatattagaatctgttattatctgcaaaaaattaggattttaattggaattgcatttaagttttagataatttggggaggaattggaatattaacaatatgaatgttccaatccatgaacatggtatatttctccatttatttaggtatttaatatccatcaacaatgttttgtagcttcagtgcaattttcaggtttttgcacaccttttgttaaatttatttctaagtatttttaatgctatcttaaacagtaatttaaattttacatttaattattgctaatatatagaaataactatatgtgtgtctatacatatacaaatacatatttgtttattgaccttgtctcataactttgctaaattgacttattagatccagtagcttgttttttttaatagattccttaggtttttctgcaaccacaattatattgtttgaaatagagttttactgtttccttacatgcctttccatttttattttttatttaaaaaatttttatgccactctagaaaattctttaaaatttctttttcttggatgttcactaagatgttgaataaaaatgataagaatgcacatgtttgtattgttcctgattacatggggaagcattccatatttttcataaaatatgcttaattgtagtttttttttattagtgtcctttatatgatgaaggaatttccatttcattcctactttcctgagagcttttgatcacaaatgagtggtgtattttatcaaaggttttttgtatctgtgaaattgacatacaattttcccctttcttttgtttatatcactaatttcattaatttttaaaaatcttatactgatcttgcatttctaggataagcccctcttaggcttgatttattatcatttttatattgctagatacagtttactaatattttgttaagcatttttgtgattatgattatgagggagagcgataaataaatttcttttcttgcataatttgattgggttttgatataaaggttctactggccttggaatctgagacaagaaatgacattctcttctatttcctgaaagaatttgtgaagactggtactatgatttttttccttatatatttcataaaatttcctaatatactatttggctttgagatttctttaaggcaagtatagatatagaattattcatattatctatttcttcttgagtcaactttattaagttaaatatttcatgaaacttgttcattattttgtctaaattgttgagtttatgtttacaatgctattaatattttactgtttgtaggatcccccctccattctggatacaagtaattttatcaatttacctatctttttctcataatccttcttctctttcttaccttatgctcttttttattttttgatatggagttttgctcttgttgcccagactggagtgcagtggcatgatcttggccactgcaacctctgtctcctaggttcaggtgattctcctgcctcagcctcctgaatagctgggattataggtgcccgccacaagggccggctaatttttgtatttttagtagaggcgaggtttcaccatgttggccaggctggtctcgaactcctgacctctggtgatctgcccaccttggcctcccaaagtgttgggattacaggcgtgagccactgtgcccagcattaccttatactcttacttccatacatctttcacattccatatgagctccacaaatcagcattaatgtatttgctttgaacaattgttacttttaaagaaattaagagatgaaagacaaatagaaagtcctttgttacccacctgtctccctttccagtgctattcactccttcctgttgatccaagtttccatctggcgtcatttttctttaatttcaatgatttcctctaacatttcttatagtgaagttctgttggcaacaaatagttttaaattttatttttctgaaaatgtctttattttatcctcattctttgaattatgtttttgtagatatagaattctgaattctggactgacaggtttgtttttgttcgtcttgctttagctctttaaatagttgttttgttttcttctggcctccatattttataatgaaaagtcagctgtcatttgcatcattatttccttgtatatagtgtgtctttttttctctgttcttgagattttctctttatttgttgtttttttaaaaatcaaaattttaatttatgagtagtaattgtgcatattgatggaatacataatgatgcttcaacacatataatgtacagtgatcaaatcaggataattagcatatcgatcatctcaaacatttgtcatttctttgtgttgggaacatttaatatcctcctcctagttttttgaaactagatattactgtcaactatagtcatcctacagtggtatagaacactaaaatttatttcttctatcttgttttaattttgtatcctttaacaagttttttcctgtccctccctttccttcaccctttctagcctctagtatcctctgttctactttttacttctgtgagatcaacttttcctagcttccacaaattaacgagaatgtgtggtggttaacgttctcttcctatcttattttatttagcataatgttctccagtttcatccatgttgccacaagatttcattctttttaatggctgaataatattccattgtgtatacatactacatttttttttttattttttgttgttggacacctaggcagtttccatatcttggctattggagcagtgctgcaataaacatgggggttacagatgtctcttcaatatactggtttcctttctattggataaatgcccagtagtgcaattgctggatcatatgatacttccatttgttgttttttgaggaacctccatattcctctccatggtgattgtactagtttatctttagttttaaacctctttgtagctgtattactttcttattgctgctgagaacaaatgaccacaacagtggcttaagacaacatacatttattattttaaattcatggagatcagaagtctaaaatgggtttgtaggcctgtgttccctctggagattctatggaagaattagtttccttgtctttttcagctactggaggctgcccacattctttggcttacagtcctgtgccactccagcctgtttctattcttgcattgtcctctctgactttcattctctagaccctaatttttctttataaggaccattgagactacattgggtccactaagacaatccagaataatcttcctatctcaacaaccttagtttacttacacctgaaaaggcccttttgctccatgaggtttgtgtggttcctgggagttagaacatgggcatcatttttggtggttgtagtggtgagcactgttctgcccaccacagtggttttctttgcatttatgctgttttaggtccactggtctccttggacctaaaggtttatttttttccccaacgaactaggaatatttttattcatgtattttatgctcaattctccctttctctgcttctgggatttaattaaatgtattttagattgcttgttattgtctcataggccatgaaatagaataaaacatttctgtctctgtttttcagatacggtaatttctattcatctgtttttatcttcactggcctctttttttctgcagctttcaatttgctcttaagttcactcagcaataattttgtttttttcattttattatggatgatgttttcttgcttctttgcctgtgttgtcctagtggatgatacatcgtatgtgggtctggattgtgtttcgttgtgacttagtgtgtactgtcttagcattacattctacttagttctccacttcctgcttcacaagataaaaaatcagtcttatataagggacgaattctactggaccagtattaaaagatggatagggtatatttcttttgttccagaattatacaaatctattttattccattgctccattatattttattgattctgtcactatactgccagaatattgcagattttagaggaatgattgtccatatagctacctttaaagcatacaaatgatttttttctcaaaccgcatcatgaatacgagtctaaatctcactaacagctatgaaactggacaggtccacaagagtggctttttttttttcctgcttctcataaactcactttggtagtgactagaatctactttcattaaacaaaagtgaaaaaagacacatgtatacaagtaatcccaatgagagttttgagatttttacaagactttttcatagaaaaatttttgacttatagtaagtatgcaataattgctactattttttttaatttgcagaagggaggtttttcaaatgcagttctttctttttcactctctagcagtttagagtggctggacaatatcacatcacttatatagtcaaggaaagaaacagggctctagatgggaggaggtggaatttgagaacatgattatagaattgtaggtacaaggccaggcgcggtggctcacgcctgtaatcccagcactttgggaggccgaggcgggcagatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaattgtaggtacaacctagaatcataaaacgctagttctgaaagtgattgtagcagcatactgtaatcactttacatatgaggaaactgaatttatcgaattatttttgctataaatatttattagtgtggacaataattaataccaccactactaatagcatttaggttccctacagcatgttttaccatggagctttaaaacacaccagtgggctgggcgcagtggctcacacctataatcccagcactttgggaggccaaggtgggtggatcacctgaggtcaggagtttgagaccagcctggccaacatggcgaaaccctgtctctactaaaaatacaaaacgaaattagctgcacatggtggcgtgcacctgtagtcccagctactcaggaggctgaggcaggagaattgctttggaggcagaggttgcagtcagccgagatcgtgccactgcactccagcctgggcaacagagtgagactccatctcaaacataaataaataaataaaataataaaaaaaacccagtgcctagaaatgttaattcttgataaaatgaaaaaaatcttaatgatagatgttcctgacagtaaaatagcttgtaaaatgttgtgtcaaaaactatgaattagctgatattggtgccactgcaaattatgtaagtaaaatttctcattttggtgactagctgagtatatcaaagaggaaaataattcaataggagatagatccattgaggctatttagtacaggaggctagttatgggatgctagaagaactgaaaagaggtcaacccatagattagcaattcataaatcgacaactgcaggaagtctctgtcacctctagggctagagggacagcgagagaagatggtgttattagcatcaaggagctcaggctataaaacagagctggaacctgggagaagtggccacctgagaggcctgttgatgggcatggtgggagggtcatacggcagaactagaactctggagaagggaatcgctccaggagagttggagcctcagtgagggctgcctgtctgagttggagccacagggacaggttcgcctggagagagtgcttctcagtaggaaatggaagctcaaaggaattactagctattgccagacactgattgagaaaaagagatgggaagaaatacttactctctcctccctttcagcccactaatatttatatttgtatttttatttcttgttcctttgtgtatgacgtgaggtagaatactgattttatttttctctatatagtgggaaatattcccagcctctttggctaaattatccatcatttctccaataatttataatgccacatcaccgtagttcatgtactcgtatctttgagtctattctgttctgttattcatttccactggctttcactattttaatgactgcatctttaagtattatatatttcggattctaacaggggcagtctgctatccattgcccctgttctttccaactatccttagtaatttgtggatctttatccttcaaaattaattattgaatcatttttataagtatattagtcaagattctccaaagaaacagaacaaaagggagtgtgtgagtgggggagagagattgagatttattttattctcacgtgaattgtgaattggaggctggcaagtcccaatttgcaccaatttgcagggtaggctgacaggctagagacccagggagcagttgatgtttaagctcaagtccaaaggcaggctgaggtcaaattcttcctgttctgggaaggttcttcttttttctttttagagtcttcagcaagttggatgaggcccactcatgtttgctttactcaaagtctactgagttaaatgttaatctcattaaaaaaatactttcatagaagcatctagaatgtttgaccaaatatctggttactgtggcttaggtaagttgacatgaaattaacatgacaacaagattccttaaaatagtatttctattattttaatttgaattacattgaattggtacattaattttggaaaattaacattattagagtattgaattattctgttcatgaatataacatgcctctccatttacttaagtcttcccttacatctttcaataaagttttaaagttttctgcataaaagtctgcatgtactgtttttgttgatattgtaaatggcattttatatcctattgtatttgtttatttaatgctagagtagtagaatactattggttttttaattcaacagtgtatcagccatctttcttatgagttttaacacttggcctgtgaattttcttggaatttttgtgtgtgggatgatatcagtagaaatattagtaagtttgcattttttcttttaattctttttttttctaattttatttctttgtctcattgtgttggtcagtacttccaatattatgttgaaaactttcgttgctgatggataactttgtttcttgaaaggaatgcttctaaatttttttttattgtgaataatatttttttctaggtatcttggtgggtgatctttatcagttacaaaagctactttctgttcttagttttctatgaaattcatttttatcataaaaggcattgaacatctttttttgcttaatcttttgagatgataatgtggtttttctcatttaaataattaatgtactgaaattacaatgatgtattttctgatgttgagtaattcttaatttcttgattcttaacaataaaccataataactttaacttctataaaagagaccactggcagcaattagatgtttttaaatgattttggcattatgatcatgaatataatttaggataaaattttttgttttcttgtactgcttttatctagttttgttaccttaaaagctatagcatcatattttctaaagcatcttgtactaaatagacactgtctttccttaacatttaggtaggacggacttataaaacatctagcctctttgacatttttggggagggggtagtggggcaggtaaaatgaggaacattttttgataactctttcaatttttaaaatagccctaatctatttaatttctgtatttattacaccaaacttcgtaagttatatttttccacgaaatttctttcttatctaggtttttcgatttattgttttcctaaaattcctgcatgattttcagaactctgtattatctctttagctagctccttattttatttatttaattttattttttagatacagggtcttgctctattgccaggctggagtgcagtggcgtgatcatagctcactgcggccttgacctcctgggctcagaagctcctcctccctaagcctcccaactagctgggactacaggcatgcaccaccgtcctcagctgatttttaaattttttgtagagatggagtctgactatgttgccctagctggtcttgaacttctgacctcatgccatcctcccactttggcctcccaaagtgctgggatacagatgtgagacactgcacctggccatttcttatttttaataaagaaaataattttggccaggcacagtggctcacacctgtaatcccagcactttgggaggccgaggcgggaggatcacgaagtcagaagattgagaccatcctggccaacacggtgaaacctgtccctactaaaatacaaaaaattagccgggtgtggtggcacatgcctgtagtcccagctactcagggggctgaggcaggggaatcacttgaacccgggaggtggaggttgcagtgagctgagattgcaccactgcattccagcctggcaacagagtgagactccatctcaaaaaaaaaaaaaaaaaaaaagaaaatagttttatgttttctattcttttttgtttagtcttacaagaggtttgtttaccttgttagtctttaaaacacaagcagatgatctcttgcgcttgatctccatgtcacagattttttccttcgggtactttgttccaggaatgaggctggggctgatagtggcggtgaggaaggaaaggagagtaaggtttgctcttgcttcacccctcccccaacccaggattgcctgttctttccatctgacagcaagtagaatgacttaggcagtaaggaggaggatatgctttgagaggggttgagggaaaatattccagggaagagtgtagtgtgaaaagatagaaaatctcaagacatagctgcagtgcaaaggagagctatggtcttgggtcaataaatggcaatgaatgcattaggtcagggactgtctcagttttcctctcaagtcacagaaaagcaatatctgacgttctcagaagactaacacatgctaggttaaatagacagcgactgtcacgaataaatcaaagtattactaatagtaaatgattcattctagaaagtcttggggctttctattagggctcttagagactatgtcttataagatgctaagcctagaccaatctgagacatgaaaagtatgtatttctaataagttttaaaaaattacttatactctaatttgttccaaaaataatttaatgtgaccgtgctaacaataatggaaatgtctctaccctgaaaagctaattacagtacttcctcttgtctctgtgcaaccatcttggattgattgtgaaatgccggtaggggcggcattgacagttattaactctacctgcttgtaatatttgctgttgttttatttttgagtctgagaagatggcttaaaagtggtctagactactgtgtatgacttcaaataccaagaggttggaaggtgttcaagccattttcagtccggttagactcagcagaataccttcttaccaggcaggttttacattttatctgtcatgaggcctactcaagactacaaaataaaaagagtaaaatcatatcagataataaggcaaaaagaattttagtaacttctcacatcattctcctctgctttcttgctcaccagtcagttggcgggaggtgtgtaatagactaggaaggggcacgtaggaaccttctgggtgttatacattttccaaactttggtctcgatggaggttcacatgtgtatataaaatatttattaaactgtataataaaatttgtgtgctctatgtatgttatacaacaaaaatgtatgatttttcttttatttcctagaaggataaataatactaaatacattttttttttactaagtcagaagaggttatacaaatgtgttgctccttaatgacagacttttaatattgtcttgaaactccattctgtggctaccatgatgaactgagttctgtctttcattttgatccttaaagctgctttgctttccagagtgttttaaattaagtaattgatgttattttgcattttgttgatcttatacaggttagagatagcttgtggaagtttagataaaaagcaaacacctatttaaacttgaaaagtaacaatgtgctgcatattaaagtattggataaatacaatttagaggttaataaactacctgctttatattcttcatattggttttgttctactttcattggttatttaatgagaatagataacacaaagaaaaagctttgtattaaactaacatgcttaaatttagatttgaaacatataagagcaaaaagtgatagttaataggaatttatggtaaagctcgtcaaaattgtgaatatttggtttatttgcattaatggtttatccaggtttcctactatggtggtggttaattttactaattttagtatgtttatcagagactccttggttatgtacaatggacttgggggtttccagctttcttttccttttttttctttgagatggagtctcgctctattgcccatgctggagtgcagcggcttgacctcggctcactgcaacctctgcctcccaggttcaagcgattatcttgcctcagcctcctaagtagctgggactacaggtgcctgccaccatgcccagcttttttttttttttgtatttttagtagagaccgggtctcgccatgttggccaggctgctctggaactcctgaccaccggtgatccacctgccttggtctcccaaagtgctgggattacaggcatgagccacagcgcctggcctccagctttcttaaataataactaactccttgctcccctttgactcttgtttttataggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgagtgagtctgctcatggcctaccttgcttaacatgaagaccttggagaggagagtgcagagcatgtgcatggtctggggacctcactgtgttgggaagaggaaaaaagtccaggagactcagtagttccttggtttctctcataggaacacatagagtttttttctccttgtttattatacagttccatgcccttcttttagtagttattactgtacatgagatagatgattcttcttcactgaccacttgagaatatatttactgggactagcagaaaatcattgagagggattctaggatggtaaaccgtgttcaggtaaatgcgtttttgtttgttttgttttagggaagcacatagttagcctgctctttacccaggtcgcttggagagtgttggtttctccagtcacgggtggttggcagagctggtcagtggcttgcctctatccacattgcatctctttctgcctgccagtgaattgttcccttcctgatgttcccattttggggtcctccatactctggggcttcaactcagtgttggctttctgggcagcatcctattgtccagacatagcctgacccactctttctacccctgaacacatggtatcccacctggagttttcctttcttaggcattttaataaactgacttgaggtaaggtaatattggctagatatttagaattcatattcatcttatagtgtgtctcactccaactagtgattaagtgtctgtggggttggagaaggggacggaaaatgaacataatttttggcatcttttgagtatttcctctatatcatgctatgtgcttaaggccatttcaggacttagccttttgtcattctctatcacagtgagggactctcaaaggtgctcctcccgtttgtggcctgtaatgcatggttacctatttgcactgagtggctggcttccttgtggtgcctgtaaagcaagggcgtgctttgccatgcatttattgagtcaatataacggtatgcagaagtccttacaatagccagcaacacaggtgccctcattcactaccaacacttactgctctctctctgtggtggcacatgttggttgaggaacaggattagacagtgctctcagagtgttccagcttttggcatctgggtctcagtttgaagctggggtaaaaaatcctgtctgtcctctccttccttctctcccagaatctggacttcccccagaatttttcctagatcattttccagaggtgttttttagttacatgtctttctttgtttacattttgcatttagtgaaactcctcgctcattcctcctgtcctccgtgcctgctgccctccctgcctttaccttctatcaggttaaatacacaattgctgaggttatatgttaaaaaatgtggcatgccagtggttgtatatggttcatccaattccccctagaaatgttagagttaaatggaccaagggtttgctggaaatctatgaactactaagtgaaaaaccatctctgaaactgtgctatagcctatgttgttgggtcacttgtagatagttaagaagatatgcagaatctaaaagtttttactatatataggcagagaactcacagtcttagacctgctgcttctgtatttaataaccttatcagacatgaaatggttttcaggtatttagttttaaacagcttttacctttgtgttgagaattcgtatttgctcagcaaccatattgttaagagttcatttgactttctgcatctatagaagcacataaaaagaatttttttctttttgtactcaaggcacacatgatatatgatggcattttttgtagcacttagctttgcaggtgttcaagaagcagcctcaacttaaaaatactgttactggctgggtacggtggctcacacctgtaatcccagcactttgggaggccaagatggccagatcacttgagaccaggagttcaagaccagcctggtcaacacggcaaaaccccttctctgctataaatacaaaaattagacaggtgtggtggcatgcgcctgtaatcccagctactcaggaggctgtaatcccagctactcataagaatctctaggaccacaaggcagaggtttcatggagccgagatcacaccactgcactccagcctgggcaacagagcgagactctgtctgaaaaaaaaaaaaaaaactcaaacaacaacaacaacacaccccaaaactgttacttactttctaccagaggcagtgatgcctgcatccaagccaccccatgccctctgaaagacttatgagaaatgggaataatagtataattttcattttattaatgaatatttataagacttaaagataacaaaaatctttattagtacttgtgaaaaattatcattcaacactatattttgagaaaatcaatacggatagcacattttcaaaagaaagcaaaaaaacctagtcatcatgtaatgtttgcttactaaaccttaattgctctcattctgatcttatttaccttctaacctatgattaaatatttctttcaattttaccagaaaaccttgttttgaaatctaaggtcttccactagatttccaagtggagtttcaagttcaaggtcagcctttccttcaagactgttctataagtgttcttccaccttctgagtccttcaagcctttgtctgctttgaccatcaattgtgtgaagtgcaccatttgaaacaatgaagaaagagaaacttgaaagacattttctttatttcctgccttcctgtctttgcctgtcttcttttttcctttacttgaggagaactagtcgaaaatatctttagcatttttagcttaaaaacctctgtgtgtgtgtgtgtgttcccagtaagaagaaggtggttgtttaattcatctttaaaaattaggcttctttcacacagcatgttaattggatattcgagacgtaagtgctgtggctcccgtaacaacagttccctttccacttagatgccagtgctccttgtggttctgccctttctctgggagactgtatctctgatctgtgtcttcagcccagaattttcttctaaaaattgaagactcatacccaaatatcttagttgacatttttaccttaatgtctcatagtaacctcaaactacatgctagaaactggactcattaactttatttccttgacttttctaccccaccatccagtgagcctattcccttcacagctgtacacatgaaactaccatccattcatttgtcctgttcctggcctctggggttccctcagtcgcttctacttctatacacctgtgttagtccatttttgcattgctgtaaagaaatacctgaggctggataatttatttatttatatttatttgtttatttattgagacagaggctcactttcttgtccaggctggagtgccatggtgccctcttggctcactgcaacctccgcctcccgggttcaagtgattctcctgcctcagcttcacgagtagctgggacaacaggtgtgcgctaccatgcccagatgtatttttggtagagacagggtttccccatgttgctcaggctggtctcgaagtcctgggctcaagtgatctgcccgcctcagcctcccaaagtgctgggattacaggcgtgagtcactgtgcccagctaaggctggataatttataaagaaaagagttttatttggctcacagttctgtagcctgtacaagcataggaccagcatctgcttcgcttctggtgaggcttcaggaagtttacagtcagggcagaaggtgaatggggagctggcatatcatatggtgggagagagagcaagagagacgggggaggcaccatactcatttaaacaactaattctcacatgaactcagagtgagaactcactcactacctcaaggagggcaccaggtatttatgagggatctgcccccatgacccaaacacctctgaccaggccccacatacaacatcggggattccatttcaacatgagatttggatgggacacacatccaaaccatatcagcatccatcagggtagctactacattctttgaactctatcttctgtttatttcccaagtctttgactctcatctcctctatcttctctaccagtaaagcagccagagttcaaaagtcacgtgagctacctctcagcagcattactaaaatatgcttctgactattttctgttcctgcccttgctgccttcacataatctgtctcttctgatatacccgttagattgatataagaatcccaagcctgtgttccttagctttgcagacctttttgatcactcccttcttcattctctttgctctttgttccagggaagattgctgttcctggaacagtagcctgtctcctacatcatcctggttttgctctctggtcctcttcttgcagtgccctctgcacctctttatcttctgctaactcctcgctcacagcttaggaccccattgaaatgctactattcctaataagccttttctgtctacttctagctgttagatgtacctttacgtgtttcagtggtgctcttggttatttccattacaccacttactaaaaatagtgtaatcattgattcactcctcccttctctgctctgtggggaggccctaggattttcctcttaggatcctcagtgtctgtcatagctcctgagacagtcacatcttgcatcagcgactcacacatgaatccattctataatgctgtctctgctgtgtttctcagaaattgctttctaagataacataaatctaaaattttgtgaatataaaactaatatcaaatgtgttttggtcacattgtcttataagtgaaagatacatatttaataatttcaagctatggtccacatggacagaaggaatttccatgagaaatagttaactaatagggcttcatgatgccactagatcttcatttatgcaaaaggaaaaattaatgttttctaaaaaatatttcttggcttataatcccatttgctattattatacacaaactaaaaagctaggtcccactgtgttcagaagctccttatatatatgggagcatatgtcatttatcatagcataggaatctacacagagtatgaactacagtaaataccttccccacaaaaagtaataagcagatttatctaggttcatattcatatgctagttacctgatagccaatatgctggattatgttctttatttgaaatgtgccattgaaggagaatagaaacaaaattacccaggtgttttgggagatcttcagtgaactattaataaatagataatattatccttagttcactagtaattaaggctacattattaaagatgatcgtttcatccaatgaccaggtttctagtcagcaaactttgaattgagcaatcgaattccatcatcctaggctgctgagaactattattgtttggaaacgatagtacttggaggataacacagacagagagagtcttgggctggagttacctcatgggtgactttgcatgagaagttatgtatgctgcagaacagagagatccgtggaactaggtctaatgtagttataatgaaactctttaaataagagagtggagagaataattatgtaaagtcaacaaaacattttgggtttagtttcttaaattctacattttgtcttttctagcagctgctgtagactccaatataaaagaagggagaaaagggagaaatctgtggtttcatttttctacccagaatgtgggtggaatgatagcaatacagtgatacaattagactttcttggtattacctttggagtttttaaaaagcctttgttgtttaactgaaggaagttgaagttttggttgagacactctttttaagatgattgtcttttggtgagtgttcctataaagcctggggaaacctgatggctgtgtgatgaaagggttaaattgaccttgaatcttttcaaagatgagtttaccatgccagcctaccactcaatatgtaagtgtgtgccttctctccttgggtgtcctgatgggcctgagcaagggaggccatggtcatccccctacaccccccgacctgccgtccagcatcgatcccagcctggccccgctccggtctgtgacttgcctagaaccagcgccttccgtgtgtcctgttggcttcgttgctatcaccggctttttttggattatttccgtggctggcttggttttccttttcctttccttcgctgttcggtgatgcgctcatttaatttctgtttaaattttgtgtgtctctctttctctcccctggcttgttccttgtctgtccacgctgtcgctgactctgtcttcgctgctcattccctgctgcctctagtattcatcaggtgcaaactgcggacctgcggcgagtgtctgctccccccggctccttcaccatgtgagtacagtgccattctgtttctacattttctccccagcctcgtctcctcagggttggactacctgtgtcccttgccttcacaggtctgttcgtcagataaggaagccacctcaccagaattgctttctgttgccctctttgatttgaaatggagctgtgaagtttttcatgttctatgtgcttccatcctctaagttaacagttcaatttttggatgagatactttagggtccatggttgcctggggttgtatagaattccatgctaagcattggtttttatgggaagtgcataataccgttagactatgtcattacttacggctcagagataagctcgaggaagtgcctgcagccctcaatttctggatgaaaccttaagattatgcgtggagttttgagtgtgtgtgtgtgtttctgttttggaagatccatagttacagtaaaagttcaatgaccccaaactgtcactgagttagcaaaatgcatttttatgtatatttaggagtttttgcttaatgtagtccagggtattatttttttctagtgagaacaaaaaaatatgttttttagcatttcagctcagaattattttgtgctgtgtactctgctttgtcctttgttttctccatatcacatatgcttacctagcatttattatgtttcagggactgttacagatactttacatattaattaatttgctctcccaacaacctttggccatatgtggtataattatctcccttctatgcatgaggaatctgatagacagagaggttaagtaacttgcccaaggtcacacagttaataaatcatagagtgggattcagactcaggcagtctggcttcaaagttcatgtttttaacaattcatagtctgctgcctttcgtctgtcaggatcctgtatatttctcaaggcccacttgaatgattacctttccaaagaattcttctttgattcttgctgtcagagttaattacaccctcactggagtttatcattcatgtatctgttgcagttctcaaggtttaatttggtgttaattacattaactctgtgtctgtgtattttacacagtagacttaggctatttgagatgattggcaatatcttaatatgaatcttgtgttcccagccatgttcacagattttaatatgaagtattctgaagccaaacaatgattgattggttttcttggtggaatgagtgaataaaagaatacatgtctaaatagaattgcacaatatctaacatctggtgatatgtatgacaaagcaattcctaaagttcagttatataatctactttcaactctcatcttatggatactaatttacttattatttaaaatatgtatttattcaaaaacctttattttgcacttgctctgtgccagacagtattttatgctctgtgtctagtggtaagcatgacagagcactaccttcctgaagcttacacttgagcagtcaaagaatcaataggaaaatgacattcaattgccaaactgaatgttgtggctggagtaaaattctatattctatataggccagttcaataaatttgagtttaaggagtggctgcatgtgatcattatttttagtggctccgttgattgtgatcaaagaattgagaatgttaacagcagaaatgcatatgatagtcatcttgtttctattatgggttaagttggttgtatttacactttagttgtgtatcttaaattggactgtttatctcttattccatgagtgtgcgtgctacatacagtaaagtaaattgtccatacttgtttctgtagggtgcagcaggctctaagttgtggttaccttaaaacttgaatgttaatttgaaaatattttatatctacatatgatatatattgaatattacatgtcatagattttctacctatagataaaacatttacataataaacattaaatcaggatattattttaaaaatcagttaataaaactatatggaatacagcaaggaatgtggagaaaagtttaagcacaacatgtgcattttgtctttttatgttatggcagtgcggatagccttgatttactcacacactagtgtttgctaatttcagcaatgttgaaaaaaccatggtaacattgctttggtcctgtagaagttaggagccccagtatcgttaagtgagattttatatatttttggcggggaggggaagggggttgctatctaatcagccactctctgctcagaacaactcttttttacagatggtcttttctttgggtgaaccctctctttatgctgctcttgaagcaattgttgcttccttcaagaagcttgaagtgatctttttttttctctctagctttcagaagactttttctccaggaatggagtacatggtggtaacaatgcaatgtatgaattattaggaattgcaacatactactaatgtctgtgtatgtgcaaaatttccagtttattcaaagaaaaatcatgaaattttatgttttgaccatatatgacaacatatgaattgatgaattttaatcaatggtatttactggtctcatccaataggacaaaacaaagcaaatagaatatttctccataaatcttgtatagtgcaagttaatgaattaataaattctttataattgattggcttcataatgaagtaaagtcctcattggaagacacatgtacacactacatttcataaatcatgactagtcatggtaaatgctgtaattgccaactcctattcagctaatgccaaaaaagtataaaactgcaaaatgtgtctttctagaactctcttagcctttagtagctacctctcattaggttctgtttccctcctgctcttcccccatcaaaatgaaataatgtgttccatttacacctaatttattcattgctttcatctttaaacaaacattattgagtgtttacttcagttactcaatgctctgtgggatattggagaagcagagacaagaacattaaggtttcagttgtgttgcctatgacagaattacgaagccatgtgacaagcatccaagtagaggttctggttgttcttccatatgaacgactttgtattgaatgtttattatatttgcttttatttttaatatttaaagttaacatactgtaaaacggacttttctggtgtacagttccataaagtttaagacatatagagattcatataaccaccaccatagtcaggatatagatcagtcagtcaccccaaaagagctgcctcatgatgtattccactgtagtcaaaccctcccatctcccaacctctggcaaccactaatcattatagttttgtgttttcaggaatgctatataaatggaagtatacaatgtgtagtccattgtagatggcttctttgactgaacactacacctttaagatttatccaagttgctgcatgtatcatttatttgttcctttttattgcccagctgtatttcattgtatggatgttttagcttgtttacccactcccccattgaaggatatctgggttattcttccagtttggggcaataatgagtagagttcctataaacattgatgaacaggttttatgtaataagctttatgtctctaggttaaacatgtaggaatgggattgctgggtcatatggtaagtgtatgttcaccttcgtaagaaactgacaaactgttttccagaatggtcgcaccattttgcatttctaccagcaatatatgatcattccagttgctccacacccctatcagcacttggtactgttagcatttgggaagcatatgtccaagtcttttgatcattttttaattgggctgtttgttttcttcctgtgaactttgagagttcatcatgtattctgcacccaaggcctttgtgtgctttgcagacattctctcccagtatatatcctgtcttttcattctcttggtgatatcttttgtagagtgaaaccttttgacagaatccagatgatttttttttttctttatagagttgtggttttggtattacgttaaagtactctttgtctaattccaggtgaatattttctcctttgctttctccctaaagttttataggttttctattttgcatttagttctgtgatctattttgagttcttttctatgagatgtgccatttagcttgaggttaatgtttttgcatatggatgtccaatgcatttggcaccatttatgaaaaaattatcttttcctattgaattgcctttacaactctaccaaaaatcaattggatatacaaaaagtcatcccttagtatccataggggattttttccagagtcccttttcttagattctagatgctcaactccctcatataaaacgggtatttgcatataacctatgtacatactttcatgtattttaaatcatctctagattgcttataacatccaatacagtacaaatgctatgtaaatagttgttaaatgcattgtttggggaattgtgatgagataaatagtctgtacatgttcggtatagacaaaaccattctatttttctgaatattttcaacctgtggttggttgaatctgcagatgtagaacccacagaaatggagaactgattatacacacacacgcacatgcacacacgtatacgcacacacagacacacagatccagtgtagactctattctgtgccattgacctatggcttatgcctttgccagtgccatattctttctattattgtacctttatagtaactcttaaaatctggttgcattattcttccaaatttattcttcattgtcaacactgttgtggctatttgagttcctttgtctttccatacacatttttagaatcagcttgcctatgtctccaaaaattctactagaaattggatgactggaattatattgagtctatagatcaacttggggaatgttgatatctttactgtgttgagactctcagttcataaattctctgtgtctcttcatttattttatttgtccatcatttcttggtagttttttgcataaagattttatacctattttgttagatttgtgcctaagtagttcatgtttttggagccattgtaaatgttttttttttttttttttttttttttggtgtgtttttaaaatgtttgtttccaattgctcattgttagtatatagaaatactatggattttttttttcttttgatacagggtctcactctgtcacccaggctggagtgcagtggtgcgatttcagctcactgcaacctctgcctcctgggttcaagtgatcttcccacctcagcctcctgagtagctggggactacaggcacatggtaccatgcctagctaacttttgaagtagtgtggagttttatatgttgaccttgtatcctattggccttactaaattcattttttagttctaggagtttggtagcatcctcaggattttctacatagtccagcatgtctgtgaataaggatacttttattcctttctctctcatccttatgccttttctttcttttgcattgttgtcctggctaggatttagagtacaatgttgaataagagtgatgagagtttcccttcttgctttctttctgatattagggagaaatcattctgtctttcaccattagattgattattagttgtagaatttttgttgaagtgttttgtcagcatatctggaaaagattagggtattatttgttctttatatgtttgttagaatttaccaatgaaactctcagagccacaagattttttcctctttcttaagctataaattcaatctctttaggagttgtaggactactcaggttatctatttcaccgtgaatgagttttagttgtcttatagttgctcgaagtatttgaggaattggtccatttcatctaaaatgttaactaatgtatgtagagttgttgtatttctttctctctttcatgtctgtgaggtctgcagtacaagtcctcttttattcctgatattagtaacctgtatctttttcttctttgtcaatcttggtagagatctatccattttattggcttttttgaagaattggcttttgttttactaactttcttggttgtttttcaatttgcaattttattgattcctgccctttattatttccttccttctgcttgatttgggtttattttgctctttttttcccatttttttctaaagtggaatcttttatttatttgcttcagtatgcaattgactcaagttcaggccacaagttttgactaatcttctaagggttgtggttacaacgttagttttattaccaaagtctttgcattgctattcttatctgtctggcttatgcatgactaagttgccagtatgggatctgggtggagttctaccctgtagttcagttcccaaagtctatggtctggtgtttagggctagattcatgtatttacagcctagagataaacacccaagagttcatgaacatctttatggagttgttttctgagttccttcctttctgctgtcatccctggtactttctggtctcttggggcttcctttgtttggtccttgtgccagaaagctaagggtttagttacctcactctgctgcatactgcctgtaactgtgttcatgtccagggccaaccaatgataacagaaagaaaaagaagcaatgatagtttctgccactctcttggcgtcacagctcttgtgattagagaggaagcccctcttccctcctaattttaggtgccagaaggctttgtcattgcggctgccagaaatagtgaaaaggcctgagtagtgtagtgggagaaaatggaggggggaaaaaagaaagggagatccttttccatttctttcggcattcagagtcccttcttttcttagagctggagcacaagcattttgccagagctctttctctctgctcctggtgtccccttttgggctttatgctgcctggagtccaggctggggcttattggagagagagggattggggagtttactaccaatttgatagtatcttaaaatctgatgttcttcaccaatctactgctatcgtttacttttcaaagttctcaaatagctgctttatgaaacctgtccacattgtatagccgcatgcagtggggaagaaataatgctgtgtgctgacccaccttcaccaggataagatctcccctgttttttgaagcagagaactatcggactgcatttcttcttgcccactgcagtgactcagcgagtgtcatagctaaattcagcaaaacaactctgcagagacaccagtgtattttgaattacaactaacatatgttaagtgtaatataccatcttgcacagcagttgcaatttaaacataaacaggatatatcccactgctaaattgtgtgggtctgcttattaccttgggaaaagcaaagttagaaaccgatccatgaagaaagtatgaattgtcatatttgaccactgaatatgactcagcattccaaaattccttgtgataaatgaagacttcttggtaaggatgaaagtaaattgatttttgttccaggaagaaagggaattttattaaaagcaagggaaatattttcgatatattaaaattttttatggttctgttttaggttgagtttaagaattttatttttataaaactaccaagacagagcaaagaacctttgatcttcacaattgaagaaaacataaattagccatagatggctaaatgtttgcatgcctctggccagagaagtaaactagaagatcttttgaaaagctttctaaaattctgtaattctattctacaactagtcacatcaaaacttttgttctaacatttacttgagtttgtataattatattatgaaaggtctctttattctgtttacttagttgtggtcctacaattagaaaataagacttgatttgtgttattcagaaccctctttcctttcctttcctctctttataaactctgccacaccttaactctttaaggaagtaacaaaaatgataccaaagtggaaatttacatgcatgcctttgtaaactataaggcttacctctaaagcagctgagatgatccatcagatatggtttgcctcaatgaattaagctgctggtggctaatacacaaccttcctgagagtctgagaatgaatcgcactcatgggccagtggagcctccagaaatgtgcttcatgtctggggcagaaatctgtccagattctgattcgtggattataatttttgaatcatacctcctggacccaaaaaccaatttcgagggtaccaaaacagcctaagtacttcaacttgtgtgattaggtttgttggtcatgcttttgttattattattattgtatttctaggtgattatctctgaattgtaggattatcgataatttttttttatttctgtattttctgatggatttccatgaatggggagtacttctaaaaagggaaaaaaagcagaacatttcatatttttggaagaacaggagagaattgctacattcgtagaatttaaaggcatgctatttgctgaatcttaaggtcggatagtgaagtgtaagagttagcttcaggctacctggaaagcaaagctatttgctctctaaacttctgagcaaaggaagatgctaaactttgcccatcgtctcttcttccttcctctctctcccttggctcctgaatttcttgggtactcttactagtaatttcacttcagactgtgcacagtttcttgactttcagtcataccatcatgtcatcccttctttcctcttgttatgccactcttccctgctagttccataaaacagacatctgcaatggacaattccaaagaaaagaaataatggttacttggacttcagctcatgccagtttccacactttatctctcagtttccatgagagcccaggctgcaactcggttaatgttgttttttttttaatttgttttgaattttttaaatgaatttctcccatgagttccctcactctgcctgggcttccattccactctgagaggtctagtgacacaaagaaaaggggcagtggaagcagtccacgggtctgtagccagagcgtcttcctccttattctgcaacccctctttccttatggtaacatccttctgatttgagtatctgggggaaccctgcatttgtctgtgtaacatcagccatgtattaaccttttgcatttcagtttttcagatatttaaaaactgcagttggtccttcgaattcctatcagctttgaagttctgttatggtagaattcaaagcatgatcttagaatcataagaaaatctgccctccaaaaatctgtaacatgaggtggatgagacttgctatgggacaagacagcgttgtccttggttctgagtactgggcaggggggccgggccctgttcttcattggtaagcatagttcatgtctcaccttcctgttagcaagaaccaaagtggatttttacatttagtcagagacataatatgtacctaagcaccttgctctgtgatcaaatttaacaccctactaacttctaaggtcacagttgctactagtctcattccctagatgagaagacagagaacaagaaatggtaggaaacttgcctatgattgcatgctatacattgataaagttgacatcgtagcatttaaggcatttatctctgctgtcaatatcacttctggtcattttcttgtgtgtgcatatatgtatgtatatttatctctattatttatatattttaatccaatcatattatataaacttttaaaagaaacttgattatgaagaataacagttcaattctgagtgttgcaaatgtgtgaatctttggtgtcataggtttatagttcaagtgttgttataataaaatttcagaatgacaaatttcaggtaaaaatagcaccactaagtaatttgaagtcttttagaatcgtaaggagtggcatttgaactgagaaacaggcttatcaggaaatgtcatgctgacatccacagtggaggaatcgttcctgtgttcttatattagtaacagtccacccagagctcggcaatcagtccacttatgtaaaggcgcaatacacttagggccccttccacatttaacattctatcttattgctttcaaatttatttttagaggtgaattatttatgtcctcataggtgtagaaatagtcttaccactcagcacttttcatacagtaaaaggttacttcaaaagtgcagcggatatttactgcgggttttgttgccttgagtgtgcagggaataagggagctcttgcagaagtcagacttgggggtaaaggagaaagtttgcaggaaggtttgggggtagtacatgtgccaggtatgtttggcagggaaaaggagggggaaacatttatgaaatttttaaaaaataaaaataaatttcacaaatagaaatctgactttagagatacaattagtccaacagatacaacacttgttttttagatttttctatgtttttaatagataagtgaaaattagggtctgaatagccagggcggggatatcaaattggcagagattcccaagccagattgaaatttttgaaaattaaaaattagatttctctcattcttccattatatatctttttataaacactagttgtaggattagaacaaaaggagttagttctttttgtgcatctttttagtagatacctgtatgagtttactaggactgccataacaaagtaccacagagtgggtggctaaaacaacagaaatttatttcgttacagttctggaggctgaaagtctgaatgaaggtgtcagcagggttggtttcttctgaagcctgtctccttgtcttgtagatgctgtcttctcatgtcttcatatggtcttccctctttgtctgtgtccaaattccctctttatataaaagacactagtcatgttggattaggctccactctaacaacttcatttaaacttaattacttctgtaaagaccctgtttccaaatacagtcacattctgaagagctatgggttagaacttcaacttaccaatttgggggacagataacttagtacataacagcatcatactggataaatttgattgaattttagttatatttctgtgtcaccctctgaagactaaactttgtgtatattatttatataaatattttagttgtttaaaatatttttttattaaagggtataaagagagctgaagaacattaccctattattcataacagattttccatattaattatatagatacaataaggtgattgacatctctggacccaaattcactttctgtaaaataaagtggttgaacaatatgtactttaaatttttgttcaaatctgaattcctaaagcatgattatagtaaaaacaatctgcagaaatacatgcagactataaacgggaaggaaaaggaatacttttgttagtctttgtgagtaaaatatttatttaaaaatggactccccacccagaaaacaaagcaaaacaaaaaacctaaatatttttggaccgaccattataactgcaatgttattaatggatttactgcattcaggaaggaaaaagagacatttcaacttttactccagtactagaataagaactgacattatcctctgacatatcaacaaagaaacctagatgttcgttttgagcgttccaaacaaataatccaaataatccaattattttggattactttgctgaagtggtaatgaagtgtgaggtgcgtttcatttgtaggagggcttcaatttaattataccaattccactgagttttgctggtctctcataacaccctgaaacacttccatgaaatgaaaagagtacattttaaaaggcataaaaagaaagtactcgttgatgctacatttaattaatccctagaacacatcacattttgtgtcagaaaatgaagttctatacatgattcaccaagttccaaagttatagctcaggtatttgactgaaatagaaatacttttcatcttgggccattataaaaattaagaaaaaagataaataaaataaaatgaaagtaccattggaagaatcacaaatggaaggaaaaggccaaagcctttcagtcttataatatattataaagacctatagttgtatttattttgaaaaagtaatcacttagaccttactgctcttaagaaaggtggctatgtcctctaattgggacgtgattatgtcatttggcttgatgttattttgttgtccaggaaaagtaaaacaagtatgttttcttgagtaaaagctcttgtcttataaatacattggtttgctgcctttaatagagacttgatttactttaatgtggtaagtgaaaggagagaaagaaatggaacaagcaaaggcactccaaattattttcacattctattatgatattatcaataaaaccattattttctttctttttcattgttttctttttagtatttgtagcatcaaaatatctaactattttgtgtttgtttctccttcatccaagtaatttattttatatatttactttcatttttttctgagacagggtctcactctgtggctaggctgaagtgtagtggcactattatagttgattgcaatcttgaactcctgagttcaagtgatcctcccgcctcagcctcctgagtagctaggacaacagttgcatgccaccgtgcttatttatttatttaaaaaaaagtttttagagatgatctcactatgttttcagggtagtctcaaactcctgaattcaagtgatcctcccaaaatgctgaaattacaggtgccactgcacctggccccaactgacccattagtccacccattaaagtatattctagggaactctttttctcaaccttgctatcaaattttgtaaaagttatttttgttgatgaataattgttatattgatataattattgtgtgattcttttaagttctgttctagaaatgtctttattctgtcatttttacaaagacaagaagaatgtttccaagaaataagagcagtttataaaatccctcagtcattggatcaggaattagagaagggaaatgaaaggtttcctcccagttggctaaatgggctgaattgggaaagcgggagggtcaggtttagaggactctcaattattccttcttggatttccgacaagaaaccttgggctggtgggaacacatctgagctactaataggagctgaagttcccaccaactgtagattgatgaacagaaatatggggccatctatatctctttccagagccaaatgtagctccccactgaggattgaggaccttggcaagcaattgtcaacctgtccaggtaaaatattaattacctactaatgaagaaaaacaaacaattctgcaataattttttctctgatactcagattttaggagagtatatacattgtttcataaaatgttttatgtgaagggctaaaaccatttaagaaaatgccttttatgtaatgccgcttattgtcaggtcaatccttactttttatttccattataaaaacaaaacatgctcttcccttgactgagcctgtttcctagaaatgcagatctactaccacacaatctgtagagtagcttttcagtagtaatgcgtcctgtagctcatacattccattctttctatacataattgggttatgtgatttccccattttaagatagcaatatctgttttcacttcatcattgcttcatgaattttggctactgttttttttgatatttttatttataacacattctgaatctttgattttttttttctattggtttgtagatgaaatgtgttcaatatttaaagattatgtgtagtctattttggttaaaatgctgttttaaagttacacatagacactcaaatatcactaattaattcgttaaagtgcttagagttactagagggttagcaactataccagtagttagaagcctagtttcagtgttcttcatggttggtatgaaagaccacaagtgttttcttctgtgaaatgacatttttaaaatacgcaaatcataacacttcatccacacccttttttagcaacgaaagtgaatttatcggttgcaaataagaacaggaaaatacaactgtttgtgattgcaaatcctggggaagatttttagcattttaaataacaattaagtttaagagatccctctgatacatagaaactgaaagctgaagcagaaaatgtctgtcttcctgaacacatgagatctaaatccattttgatggcttaagagtatcattgtcctcttatgtctcattggttcaagcccaactgctccttgctccactaagtatagtgatgaatggtcctccctccaactgacagtaaaagaattctccatgctgtgagaattccatttagtaccattgattgcaggctatggtattaaaagtaactcatgttagtgttttgtgatagaatctttaatcatttttaataacaaggaaaccttcattacatggatttacttcttaaagtggaaatgattttggcctgatgtgatgaaagacagggcttgagtttttacttgttcccattccaacagttcttaatttttcttcatctcaacagttggaatttgcagaattcttctatgagaatgcatgttacctctatgtctaatttccatttgtttctatttcctgtggtacttacttctcctttgccttttattaggatatttgtccaagttttatactccttaagcatgaaagaatgtacaaagagtgtatgtgggaacttaaagtctaaaattcctaccttaaaatacttttttaaaggttgtcatctctagttgccagttcaccaatatcagggcagaagacggcatcttcgtaagacttaaatttgcaataatatctagtaatgagtagaaattcttctcttttgtattaagcaggggcaagccagaggctcaactcgatacctgaaggtggtacagcaataatgtaatgcataatcagtgattttatttcttgtttgttgcttttagttatgggagtaggtttttcctttgaaccaaattcttttgagtggtcccattcaggccaatgattctggcctaatcacacatgattaggtgtgatgaagaatgtagtcagatgtcagaaaaaagatgtttttctcatcgcaaatttaggaagtccatatggggatcagtaatttaacacatattgaaaacctcatattaaacatatgtagtgggagatttaaagataactatagttgggcatcctgtccttgaagagctcatgatttaatggggagagcaacattgtcatatcatgattacatttatgttttaaacagtgtgcagtgtgatgaaatttttggatgcatggggcccaattagcctaggtgcaagatgatattagcttggtctaaaggggttttagtggaaggagcaaagaagcatacgtatttgaaagatttagaggaggataaactgcagcagagagaaagaaggagcttctggtaacttagttggcaaaccagaagagtgttttgaactgaattccaaaagtaaagagcttcaggcagcagggagttaaccacagtgtggaaggctactgaaaagtgaagtcaggtgaatttaatatgcatggataaaggaaaaagagaaagtaacaatattgtatagtcttatggagagggaactttgagtttctggggcaatgagttgttcagtggcttaaaaaataaatctgtgactctggtaataaaaagttataacatggccgggtgcagtgactcacacctgtaatcccagcactttgggaggccaaggtgggtggatcacccgaggaggtcaggagtttgagaccagccttatcaacatggtgaaaccccatctctagttaaaatacaaaattaactgggtgtattggcacactcctgtaatccaagctactcaggaggctgaggcaggacaattgcttgaacccaggaggcagaggttgcagagagccgagatcgtgccattgcactccagcctgggtgggcgacaagagcaaaaagtcataacacatgtatgtagggatggatccatgtaaaattccagaattggatcaacgagccagtaacagtgatggcattcactgccacaaaaggaaacaggtggccagaagaatttgaaatatcattcaaggttgttagtatgtctattttcctttaaaacaaaaatgatgaaactgctatacttgttaacctgctctgcaatgccactgagggaagccactgcttgcttgttctatacctttgcttccctttaaataccatgaacacgacactgaacagaaaacacactctagaataaccatgtggtaaattagttatgggagtaagtttttcctttgaacagaattcttttgagtggtccctattctggccaatgattctggcctaatcacacatgaaaaatctatgctcaaaagcatagattttttttattttaaaaagttttgtaagtctgtggagtacaagtgtaattttgttacatgcgtagattacatagtggtgaatcaggccttttagggtatctatcaccaaaatagcatatgttgtacccattaagtaatttctcatcattcacgctcccctaagcacagaaatttattacaaatttccatggaggctttaaaattttaattacaatgtgactttgaagatctccagaaaatttaaaaaataatttctgtttcagccaatgtcataaaaatttattgacatttgatgcttatagtctgtttgcaatatgttagccatcaaggcagcaaatatttctttgatatgcatctagctttggtggttaatgtttgcactcttttgacattagtccatgtgactgattatttttgtaacttaaaagccaattccctaaaaatggtggtagatgggctaataaatagagactgcagagaggaaaatttagactgcagggagaatttgcaaatgattaaggtagcctgaacaaagactaagccacttccattagcatcttactgcttggtgaggatcaagcagagacttagaatagccacttgaagatgcagtcataggggcgtatagaattagatggaatagcaaatactgaattagatgagatcgaagattgcttttgactctataatgcttccatgatgatcttataagaagggctggaagaatagctgcctcaaataatttgtaagctgtaacatatcctattacctcctcacaaatggatgtcttagagactgagaacttactcaacttccatcaaaaaagaattaataacctctgaaggtactttctccaggaaaacatgttgggcagtgggagtgcatgactgattgctgctaatgtgattttggtttatgcttggtttaagaatcaaaaacttctgtacaatgtgtttcagatttccgaggcattatttaattgaagaacaggtagttcagaaaaggtttacttacttttttgatggggacatctaccatttgtaggttcttctgtctttttatttgtgtagattctactggagataaaaagtgggaacataattcaacatggatttatttcctgatccagaggtcaaagaacagaaatggatgaccaaatcagttatgactttttcacaaagggaaaagctgctagaaagcagctcagaaatgctccaatgccaagctgtgctatagcatcagaaccatgtacagttgcagaggaatttgatttccttgcattcatttactcatttgttcaaaaacatttattgtaagcaacatggaccaggcattgttctagctgctggagctgcaaagaggaggaagagattcatagtgtgaattcatagcctttcacactgtgaattcacactataaattcatattttaataaaactctatttataaaacgagccagttcaaatgaattctattagattagttagaaacaaattttattatatctagattatgatcaggtagaattgcttgaaagaagttaaggcaattcattattactattaaatcagggctaaagggtgaaaggcagacagagttatgcttttctgtctcataaaagaaaaacaactctatatgagtagcaaatgcctggttgaattacaattatttataaaaatcaatgtttctacatagtgcgtgttacaaggggcaagccttacactgaactaagaaatgttaatgaaaacaggatatttataaggtacaaaatgtagaatgattacataactttaaggatcttgtctcaacatgagttaagatttatattcataatatctttaaaaagtaaaaaaaaacttgcaaacattcaccatccctacttgcattattgtccaaaagactgtggatagcgacattccactgaatcttgtatccctactgatgttgacggatgcccattctgctaaggtttcctgtctactaagtgctaattagagctgcaactctggcttcagctatgatattattatctaggactgaataaacaatataaggcttatggaaattgcagaagcgctagggcgataataatagtaacaacaactattattatttttgaccacttattatttgccaggaaggtgctaactgccttatatatgtctcatttagtgctcactacatttctattatcagtcccattttcagatcacaaaatggtttaaagaaggtaactttagcgttctgaccatttagattggaactaaattttttgaccatacgtcttgctttatccacttgctatcatgtcttaatattaacggatatcactcctatataattcatgtttccagtgacagaatgagttaatggagtccgtggtttaaaagtgaccctggagaaccaaaacgctcagcccatccactttatccataaagagattaggcctgggtgggagattggatgagaggcgtctcttatcagtccgagaggaatagtgtatactaaagaaattgatcaaaaggaggaagacgtttgagggcactagggaggaatacgactctgatggattgaaattctacatgggaacaattgaaaaagaagctattggcaacatctacaggagagcagagaatagcaagattaagtgtaaattgaatagcagtgagtgttcagggagttgtcttaatggaaagtcagtctacctcccttccaacatctcagggtaaaaggtgtgtataacatggataagggaagctgtggcatggaggttactggaaacccatctgagtgattcaacaagtgctcttattatggttcttgagaaagtgttcatgggagacatttgggaattaagtccagagccacgaacttccattctgcataaggatctcaatcacagtgttgcagagaattggggtagtgacctaaacctgtcggcttagtgagaaggcgacaggtttaggtcactaccccaataggaaagggaattcacagactgctaaatcccttctagggagtttgagatgttccatggaagccgggtttagaacccctgatccagagcctaatcagtatggcagtatcttgtggcagatgttggcaggaaggcaaatttatttttacccaggatgtttgtctcttctttgctctactaacttcccagacaaaatttaaatttagcaaactaatggcagtgctattccccagactccaaagaacagctttgtcatcctctaccttcagtcagccattaatgggacactaatatattttgacataaaggtatgaaattgaattacttggctttcatttaatctctatgcacttcccccgactcccccatgttctagctgtctgttttcatgtttttagttggccttttaaaatactaggtgggagagcacccagaagtgtaaaatgtcatgccaccagccaagctagacaatctccccccagaggtagcccagcaccttgtcagaaatgtttagggaggttccttcatgtgctctaaacattttccaatatctggcagaagcagcaaatgctgttgattattaggtagaaccttatctaggagaacgattttcagaataattattataatgataatagctaaaatctattgagcactgacaatgtgccaggcatttttctaagcatatcacatgtattggctcatttaattctcttaatatgcctatgaggtggatactgatatcatctccactttacctatgaggaaaatgaagcatagagtttcctgattaactaggaactggaagaactttacttcaaatccaggcaatctgacttggagcctgagctcctcaccactttgctgtgttgcctcccatacctgctgtttacaccagggttgcaaatgattcgagaaggtttaccattattgaccctggggtctaatgccctagaatttgctgatgagtctcaactgggacatcttttgataggagtttaaaaaagaaaacagataccccgcccagaagactaggtttaagtaagctgctgctagtgggaaagtggaaactgttgtaggttgttgggaaaagatgggagctaagagcaagagagcaaaagtgtaggaaagtggatgggagaaagtgttaagcggtggttagagtctgatttcttctgtcttgcttagctgatcattctggagatgaactgagatcatatgtgaattcatttgggatctataaagtttgattcaaataatagtgtcttttatgccatggtgtgccccctggaagttagggtggagtagtgggtggccagaggttcaggagacaacagtgcatgggttggaatcagagggcatagatgagaacctgggaggacatggcacagggagcagccactttatgggttttgagaaaggtgatacacactggtaagccccaaattggggagctccaggaaggggagtccaggaactggtcagcagtcattctccaaatctcatttcccatttgcaactactgcccaatcgaggtcttagtcctgatacctccagcccagtagagaagactgaagcccactgccattagatttactatgatctcaaataattgcttaggtagagttcattcaacctctgcccctcctcaacttctcctattagggtctgataggccactacattctatggttccagcttcccttttatctgctgtgtgtgcaggaaaatattttctaattacagtctttgcagatcagttgagtgaacttggaaataaagggattatcagacccctttaatttggggataaaaatctaatgtgaacaccatgtggtcactctgttaattgcgtaaattttttcctccctacttgcatctaattcctaacactctttgctataggccttatttttattcttgtcctgcattattgtttatttacatatggacgtgcttttaaaataactatattaattccttaaaaattatacttgatataaaataatgcccaggtttcaccacacagagataacaacttgcaacagcttgttggacgtgtctccatgcacttctcttgcatgtgcaaactcctgaagtccacaatttatatgaaggagcttatgccatatataattattcatgacttttcttcacttcacagcatgttgtagccacacttccctctaaatgaataaagaccttcagtatattcaaggtctgttctactaactgaaggtctgtatctataaatatcccgcctgatgattgtttattgataaagaaagaaatctgagcagcacacagagatcatcagactctgccaatccagactttatagttttgccgtcaaatccatgggattcttggtatttatccattgacaagagagtctgaactcctcagaggagcagagaaagaacatgaaactgatgagtgaagggtccaaggctttgcgtttagcactgctacttagtggctatgtgaccttaaaatcacttcacctttctgaacttcagtttccctacctgtaaatgatattgtgagttttcagtatattcaaggtctgttctactaactgaaggtctgtatctataaatatactgtcaagctgtatctccaatcacaacttaaatgcttcggctttatttgtccatacctttttgatgtccagcactatggtaatacaaagtaaatacccaacaaacacaatttgagtgatggatcggtatagctgttgaatctgtcttttcaaatttcccccagaaatatccatctctgtagttttatactgatttttttaagccagtgaacctcagacatttttacctgcctaccatctctctttagaatttgtgcatgtatatctacacttttaaatagccacagtttaaatctctctctctgtctgtgtgtgtgtgagagagagagagagagaaagagagagagaatgcaccatgtgtgagtgtgcacatatgtatctatagtttgatatgtatgtgctattttgggtgagtaaagtgggattccatatggagggagttactatactttgcactaaaatgaggctttagacaacagaatgagattatttttttactccctcttccagagttttactgaaattaaatgggtgtgtgtctgtgtctctgtgtgtgtgagtttgaagtgaaggtagagaggggtgtcctaatattgtagacacagtattcccttctttcatgtattctttcttatctttcctgttttccttctttccctccctcattctctcccttcctctctccctccgtctttctctttctttttttctttatttctgtttccttctttccttccttttcctcctttacaggaacaaattaaagaataatgccattctttctactttagtcaatgacgttagtcagtggtgacttttgtcaccatttaatataaaaaaaaagagaagcctctgtatgagaaaattctctcaaccaatgaaatcccagtataaggtcgtattgaaagacaagtaggtattttgttatattaatatattgaagaaatgtattgacccatcgtggtggtgatgaaaaccaaattattccactcaactaatgcccaagattaaaccactttcaaaatatcgcttaagaaaatcaaggagtcgagttacagacatttggggagtgaatagatgttcagaaagtttggtgctgcaccattttattgcttaatatgtgtctggagtcagtatgcattgaattctttcaaaatgagttacgcacttcattctcttcctaaagaaaggacactgtacatatttaaacatttttcttcattttggaatgctcagagccaccattacaagcagtgtttattgcaatatgctttgactgagaggtgctgtcaaaagaggctattgagctgtgtagagctacttcggtctcaaccctgtggcttctggactcttggtctgctttttaaagatagtttttccatctctctgagggtcaggctgcccctgaccatgtcttactgtgatgtgcatatctgcctgtggttcttaaagctccactccacctcccactatttcagatttgctgaatctaatttattatgtaacaagcacatgatcttattaaatgttttaaaaaatcaatagaaaatacgatataaaagtgggctccaaaggctctttttgcatatttctatattcttatgtaaattccagaaacttttggtttctggagaagtgttctccagatcactgttcaattctgataaggaacccacctttctggtttgaatgtgaactcttccttctaaacatgaagagacaatattgcccttattccttcaggtgcatggctaccaattccgctctctcatttgtatctgaccactcggttcttgttttgcagtccccagtctgtcccagatcgtctgaggatccgggtgaacaaaatcagtttacaagactatgaaggattccactatgacaaggagaaactccgagaagcttgtaagttggaagtgcctcattgatttcatgcgatcagcctatcttcagcttcttgatcctccttggtttgatgggtagattcatttatccttgtgcctgaaaatcatggttagagaagtgaagtgaaacacagtaacatgtgggctccaagtgataatgtatgggctacagaaaaaggaactggaaaaggaaagcagctgaataaaatcattctgctgtggatgccaagtcaggatctcttggcttattcgccactttagtctcagatttgcctaaaatgaggaaagcaaaaagttcgtgataccaatggtatagcaccatccagaaaactcttgagacaacacagatctcttcttggaggctgcgttatcaaacactgccctcattcgtcacagagatgtggcaaagaggcacattcagcacttctagatattatgctattatataatgtcagagaagggcctacgggaatgttgtgatattaaagtgattcattgatgatgaggtgccattatttttgaaacctgcacttgagtcgacgtatgaattacttctcaaagtttgtattttctgtatgcttctttgaatacatagctaattgttagttcatctcactagtcaatcagtatgtattggacactttttacaatctggtacattctgatcactgcattaaatctgtctgtataataatttatgaggtaattggttaaaataagccagaagttaagaccatgagagtgttagatattagggttctcggctccttcctaattgtgggggccaatagtcaactgcaataaagtcaaagaagataaggaaaactggtgtccaagggaataggcaatgatgctgatataaagaaatgacttttatatggaaccaaagacttacgaacccagtccccaaatggtctctaagtgtagacctggctacctgtgtaaaagaggaaaatagttagaactggcaggattaatagtaggaaagccttcctgggatggtcttttctgagctctggtttctgagactgatctgaagtaagctttagtggatggaaattctgaggtccaaggataatcccaggggtgggtacagagggttctacaatctggagttgccacgaggtgaggagccatatccctggtagcctaatcactgaatctactagagaatttgctgtgaattttctttcttaattctctcagctgcttcagcttcctaaaccctttatgttgttttccttagacatcaatatcttttaatttctccccagccttctcacttccatactttaccctcatttccttttataggaaagtgtgagctggaggaggagcaattccccaaacctctgaatttcttccttctgtaaacaacatattacattttctaatctaagtgaacttataagcgacagactagcatataatctgtttgatccataaagtgttagacatatatttttgcgatgggaagtgtagctacaatgcaaattaaattgagttctaaaggttactaatcataaagaacagtgttttatgttctttcttgtttgaagcttccaaacaaatagctaacagttcttaaaagaagataacagatctcaaataatattttgcagcttacgatcaactctgaagaaattcaatttggagtggggacacatttgaaatttttagctgaaatgagatttgaagcttatttatagctttcaattatctgttttatcttttctgtggcattatctgtctaccattcctggaggtaattgtggtttgaggttttccaacaagatgacattttctggcaagggctttactcagcatatgtgataaaatttctatgtgaagaaacttcttaagtcaaatatggcataaatgtaagccaaataaattgaacagtgtctttgggaccccaaagaacacatatactctctaaaaggggataaaggagttattctaaagatgtaaaaattcattccaatgatttggatttgaagaaaacaataaaagaattggaattaaaagtgaccaactcaatcattctacttttaatatgcggtgatggtgcttctaactgtggtttttcaggaaagtttatcctttgaggttctggattcactcctactaacctttactcttttgcctggttccaacttgaaacagaatacagattcatgggaaggctgacagggctcaaactgagtataaagacaaaagcaagcttaagtccatatatgaggtgcatgccaaaataaatgttatttcagaagcattaattaagtgaaatttgcacaacacatctagataaaagggactctaggaatgtactctgacctgcatcccagaacaaagagagtgaatcctcttaggtcattcatttattgtcatcaatgactgacctagagcagtagcatggtactgcgtttgaagttagttccatttcttgatggtgtgccaagtgatatcttcaggcagcatgtggttcttttccatcactgtttagcagaatcttgctcattgttcccgttagataacaagctcgcatgtttgtcacctaacaaagcccatcttccgtccataatgcagggctccctgacaataatggatggcagccctttaaattgctttgcttattttagcacagagaaagaggactatactctttcagatatttcccattcctcttccacttagccccatctcactggggggcaatccttctaaaataatatcccggaaaaatttagtccttgtcaatctttccctcagctcttgctggtaaatttcagacttatgtaagacactaaaagtcttcctcactccataggatttatcaaccctcagataatagttgtggtttgcaagaggggacagtctattcaacttaagaggtagaacataaagagaaagtggccatattaaaaaaattaaagcaaatctgtaataatgatatcagaaaatcactctcataaacagaagtatacaagtgggtccttaataaagcttataatcatataatctaggcaaaggatgatctgtttttaaaaatctgttgtatttctaaccccagaagagattcactgacacatgatatattttttaaaaatctgagataacttgatattcccccaaatttaactctgttcccatgcaaactggttaaacttcagtttgagcaccagtttattctgcacttttaaattgccatgataatttacacagatctagggtttaaaacacaagcagtagaaaccagcttgaagccaattgaaaacagatgtagtctataaggatagggaattaacatttgttgtatatcaaatacagtgtttgacaatgcttttacatacatgatctcagtataattcagtattatctggatgtttataacatgtaatgcataatatatcaataaatagggtaaaatcctagtatcgttagtgttaaccaaactaggtatttagttaagcatttgccctaatggaatttccttgtttggtgatttagtagaaaagtcagaaattttggtgtttgaatctcagttgaaaccttgacaaagtcatttaatttctctgatgatcaaatctctcatctgtaaaatgaaaatataattataaccccattcagtgctgagggttaaatgtaatgctgtatatggaacccttggtgtgaagtctggcacattagtgtgctctccaaaaatggtagctatgatgcttgtggtggttgttgttagagaggccctgctgtcatactgctcatcagtcttcaagtccataaaaccagactcaaagtaggtcatagaggctgacttcctctatgtagaactcttcctggcttgaggcagctcacttcaaactgcacacaccaccaccctccaactcactttcttactttcaaaaatagaattgaaaatactggtaaatatcacagaaagattatgggaagaaagtgtaactaaatcattcaatttacttttattgtgtctacttgtgtaaacatctgctgtaatgacaagatacttaaatctatgaagcatgtaaatactgaatgcccatataggatgatctgaacgtttacctgcaaatttccttccttaagtcctaatacattctcttaagtgtgtcatctgttatccaccactgaattttttgcaacaaatttttattttggaataattttagatttacaaaaaagttacaaaggtaatacagggcattcctgtgcattcctcccccagtttttctcattgttaaacactttacattaccatggtgcgtttgtcaaggaaactgatattgctacattactattaactaaacctttggaatttctatcccaggatcaaatctaggataccatattgcattgagttgtcatagctccctagtctcttctgatctgtaaccgtttctcagcgttctttctttttttatctttctttctttctctctctttctctctctttctccctccctcccgccctctctctctccctctttctttcctctctttctttctctttctttctttctttctttctttctttctttctttctttctttctttctttctttctttttcttttctttctttctttctttctttttcttttctttctttctttctttctttttcttttcttttctttacttttcttttcttttctttttcttatgaccttgatggttttgggggaatactgcttcctgtagaatatcttccaatctggctttgtctgttgttttactcataattacactggatttatgggtttttagaaagaatactgtagaggtgaagtaggctttttgccccatcatgtcaagacttatgtgatatacacatgacatccctggtgatgttaacctgatcatttggtaaaggtggtatttgccaagttccttcaccatagacttacaattttttccccttccctactctattctttaggaataagtcactaagtctaacccactttcaaaatgatcagaggaggtggatcaagattttttaaattgtttccagtttgcatatttgagctcaactgaatttgttaactatgccaaaatggtagagccattcaaccattcatgcattcatactttcaataattacatgtttgcatcagttatatgtcagataccacactagatgttagtcattgaaagatgaaactagaaaatccaacattataacataatttattcagtgtacctttattgagtccttaccgtgagcaggggttggaagaaaaaaaaacaacagaattcgttcctgattttctggagctttttttctttttttaaaaaatgtgataataactgtgatggggctatggaaacattctgtacctatttttctagcaaacgtcatttaaataatgaaagaaagataaaatatataagcaagaatgagaaaatccagtctaaccactaattaagtgtgtgaccttgggcgatgcatttgtcttcttcaggcttctgtttccttatctgttaaatgcagtagttaaactagacatttcttaagaacagattataatataataaatgtttagttttatagaaattacacaggattaaaaaatttttcatcagcatatttccttagtagagtttttaaagctccaacatcattcataatgagtataagcattagaaaccatgtaagtacattgtgcttcaagagtttgctaaaaacactgattttttttccctatcaatagcttcatctaaaattgaatctttccccctcatttaacaagttgacaacagggctgttcagtagagattaggcctccatttggtggaggtaggctttccaagttgaaatctgtctgaggagttaaatgatgtcaatttgtcctctgaagggcattgtccttcctttttgcaagtgtgtttatgtttattcctattttcacgatttgacatttacccagagtttcgtgcttagtttcttttactgtcttttcccatctcttgtctgtctcttatatttatcattttattaaaaatataataataataatggttaacacacatcgtactattgctgtgagctaggaaatgccttttttacatatattgtgtaatttaactcacccgacatctcagtgtgatagatagtactgttattcccatttcacatataaagcaattgaggcacagaaaactcagacagtctaaggggctgacattttgaatacttatttaatcactgtgttttctgcttcctccaagtagtacttcctatttttcatataaatgtctttaataacataagtaaaaatttacatgtcagtctttcacaattccatttcaaatgtcttcttacatttaaactgactttgacttagtttatcacactcaggtttgttggacaagtttctgtttttggatcttcctccaacctcaaatcagccattcataaattcaacaaatattaattgactgcttaccttatttctagtactatttcaagtatttctagtactatttcaagatacagaaaagtgcttgcccggaacttatgttccagtggagagacagacaattgaataaataatacaatatggagcaagatgctataaaggaaagtaaagcagaacagtgacagaggatcctgtttttgataaggtggtcagcaagagactttctgaagaagtgacatttaaagagagaccagaacaaaaagagtgcatgtatatgtggatttctagaagagtatccctgggcagaggaaatggcaagttccaaggccaagcatccttagtatatttaatgaatgtcagggatgtccatgtgactggaacctgcttagttgaatggagatagtcaggaagttcttttaaagggtcagcacatggagggggcttataggcatggagaaggctttggattttattcaaagtgtaatgagaaggtgttggaactacttgaggagtgtatcatgcctgaatttattctagataaatttggctactaggtagaacattttcaggttgcaatgatggaaatagggcagcaggtaccaggctaatgtgatactccaggtgacaggcaataggaatgagagagttaaagtagtagagttggagagaatcagttggattctggctacattttggaggtaatgctggtaggatgagatgatggattcgctgtattgcataagagtgtaaaattcagttgcctctgatgttttgaccttggcaacttggtaaatagaggtagggaagatgcagaggattcagcaaaggagaccaagaaggagcaataccaaggaggagcctatggttagctacaaaaacagcaggagagcttgttcattggaatcagagagaaaaataactcataaaagctgtctagctgtcagcgtttcagagaagttgagtaagatgcacactaagaattggtagttggattggagtagagggtagttagtggtagcctcacgagattgtggagtgaaaaatgtgaaagtgcatagagaggattcgtgtgcaaatagggtcaagtgaatgtcagatgtgagctgcataatgacatcttgatcaatgatggactgcatatacaacagtggtcccataagattttattttattttattttttttaattcttcagctaaaaccgcggaagaggtgatttattatatggttgttacactcggccacaaataaacacagaaatagtccagaatgtcacaggtccagggcagaggaccaacatgggcattttgttcatgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgcagaggtttccaaaaaaatggcgctaaggccgagagcaagattttaataccatagttttactgcaccttttctatgtttaggtattttagatacccaaatgccattgtgttacaattgcctgcagtattcagtacagtaacatgctgtacaggtttgtagcctaggagctacaggctataccgtatagcctaggtgtgtagtaggtgattccacctaggtttgtgttaagtacactctatgatgttcacacaatgaagaaatcacctaacgacatgtttcttaaaacacatccctttcattaaatgacatatgactataattcaccacagattgctcttttaaggtatttaactataaaactaaggaaagaaatgggatgatgactataaaagaatatagtagaatcaaaggaggattcttttttttaatttgtaagataatacagcaagtgtgtatgctggtgggaccaattcactagagagagaacttgattcagaagagggccaaatgcaggagcagtgccttcgagtaggtggtaagatggaacctggtgagcaatagaaggttgtgggcaggaatgtggggcaggttctcccgagtacagccagagaaggcagaggagggagtacagatacagatagcttggtgtacttggtgctagggagaaacagaagttctattctgattgcttttattttctcaggaaaagaagaagcaagcttactagttgaaagttggaaatggatagtatcagtgttctggaaaaaaagaggaaggtttgaaatagcttgaggagagagacagtgacagggttcggcagaattgctgacctttactttggaaatggatgattgaattcattgtttttttgtaagcacatagagcctgacttgccggtttctggctgtcttggtttatagatgagcctactctatgtctttctaatttcaaaggactctgatacccggggaatattgggccaaaatatgatcttattattaatataaacttttttgccatctaattctgtttatgacctaaaggctttctttctttataagaaaataaaatatgctctggtgctgtgctatattagaagttaataatgttagatttcagacaaagaactgggcctaaaatgatgatgatatttgatccttccttcactgttaaaacttagcctttggcaatgagagcaatcaattgcaggtagatccttaagtctctgcccaaaataatattttctcttttcattggtttattttatgtaacacatactcaaaattatggccaactcttactatttatagaccagcctagtccatttggttgctgtcttaccaggttgacaactctggaatgtaagctcagatggtagttagacttccctttgaagactttcttctaagatctttgtataaaattattactttcattcatcttgctaaggtttgagtagtgcagtgttggccattgcagagtcacaactatcctgtttaataataaataataacatccaatcattgcatagggcttcatggtttacagagggctgttgtatacactggccacatgcatcattacaaggacacttaagattgccttgcacagggttacattgctgtggtgggattttaataagaaattatatattttctctcttaatccagggcactttctagtatacagcctacttctttataaagacaaatttaaaagaatttgcggtcataggtcttgtcatcatttgagtttctggggaaacagactgtgagactgagttttgtgtacaagggttttattgaggatttcccaagacggaaccacagctgtgcagggcaagaaaagtgggaccaggaagagggagatgttgaactttgctgtagtcacaactgaggactcccacagggacctttggacctgggacagccattttgagttttctaaattgaggcaagggttattggacacagatcaggctctgccctggaaggggataaaccttgagtgaggtagcagcctttctggagaaggactcagctgtgcgctatcagcaaacttttagcctctgggaaaatgagtgcctcaatcctaacatgaatgcattgcttcagttccgaaagcagagtcttgctatgtattaataacctgatttttgaactaaggccaagaaagagccacccacataccaaaatccttgagttcattcattcaactcttcatttaacaacgatctattgaacacctactatgtatcaaagactgttctaagtgctggaaattcagcttcagtgagtgctagctctgaagtgtttctcttgttatatcttttaacctgatttccctgctatgccaaattcagggaattggagtacaagttgattattcagaagtgtctgaattagcaaagtaaaatggaaacctaaaaggtgaatgctgacctttccttaaaagttctttctgatgaattattgccaagccaaatattctccatttggaatttgagtaattaaaagtggaaacctgaatataaagccacctcaatttctggctgtcacttctagtctgacgctatagtcagcagagaaaacttcagagtttgattctcaatgggatgtgtattttttatatattcatttcttccttcactgttaaaatgtagcctttgctaataagagcaattcattgattgaactaaacagaatcaagggcggaagtgtaagctaatctgaaaataacatctttgcagattgactcagaaccacaattttatgcactagttacgtggataaaaacttcaggctttccctagttcacactggtggaaaacagtctttctcagtaccgagtgggtttcctgaatcactggtccactgccagtctcctggagtcatctgtaagcagaattagagatgtccccaggctgtcagctgctagggatgtctttgtttgagactgccctatttcacatctcctcatagaagctgtccatgtataatttgtttattcattttatttcccaaaagaggcttggggccccttcagctgattttagaaaatttttctgtcatgaattcttcacatgtatctaatcaactcagaaattccaggctgcatgactgaatgtgtccccagcatctagttgttggtgaccttgaccatcaccctgcagtgtaacagacagcatgatgtagaaattgtgaaagagatttggaccagtgtatctaatcatcatttcaagtattgaagttttaggtatggttgtgaatctttcctttcagacatgtaatatttcatcttgattttcagatgtatctggctagcctggccatgtagccaagattccagtgtcacagtcaagcctttgttatctccctcccaagtacttgagcactggtagtaaatatcagtagtggttctttctgtgtctaagaattttacgaatattcatttccattgtcaagggcatgctaggacctcacagttaaaagcttatatcacatttaacaccaggaataattgccaaaagattatatacatcatcttgttgtactagtactttattgcatgcaacattaggaaccttctttgaaatggaattatcttcatcaaaagtaggcatttacatcattgtcattaaacttacatattcagttggacaaggatgacatgtcatagcactatttggtctggacctttggttcctactatgtattagaagagaagtatgtgggccttctgcccatacttgctcctggataaccacggtcaatgcgtgaaccgcagtcatcagaagtaggaaaaaggccattacgaacagcatccatgattggatctcatgctccacctgacaacttttgtctttgttcagaagaccaggctttaacatctcctttttttttctccctgggattttctttctcatttctgcttttccatttatcatgtcatgaatgccaaagatttggaaagagaaaaagaaaaggatctgttactaactcctgaggggttgtgggctgggcttcgatgggcacctggagagtgtagtgttccctttcattctctttcttctgttctttcttctccagccttcagaattttctttccccaattctgtctataacacattctaactcagaaaccattttcttgtattttaggtgttatcaaactgcctttgaggcattgacaagtggtctttgtcctccatcatcacagttttcactaattttacattattttcacagtctctctgctgccgccttctttgctcttttttgctctctccagctcagcaggccacaagtccatggtgttaggtaagtgtatcagaaggttgtaacccccacagctatgcaaaacgacttcactgtcactcttgctccttttccctcttcccatccaactggccacagaggagttgcttccttggacttcgtatctctctcatatgcccttcccttcttgtctttctgccactcctctattccagacctcaccattgctcagctcattgactgtattcgcttcctcactcatcctccagtcactcacctaatttttcatcaatttgtcttccgtattactcccaatgatttttctaacattttgtccaagaaaaaggtgggagatttttaggcactgagatgagcgagtggaaaagtactggaggatgttgtggggaggttggtcaattgccaacccattgtatctgattattgtcatccatcaagtaagaattgtagttttttgataaccttggcacatttgaaactaacagaataaaaggaaagattccacttgtgtttacatcctcccttaggaatttgtttcttttctctactcccctgcctctcctccttgagttccttatttccaccatccttttgacttcctgagtaatgtgaatgctatgagtaacaaaataggtactgataattgttctatgtcaggatgatctcatcagcaaagtatctgtccatagcaaactcagaacagtttctttttcttttccctttctcttgatttttctgtaactaggcatctgtgtttgctaattgtctcttattaccaataattatttaggctcttacccacccacagagcctgagagagaggggctctgtctttcatgatgtttacatttcaaaaaatgacttctagctcctggagaaagacattcctgggttgtaaaatttggcatgagtctgggagcagatttacatacatctcaaaggggcagagaaaggatttacaatggaaagtttgctaaagtaaatgctctaagaaacaagtgttcagagccatataatcaagaagaaacctgtcggccgggcatggtggctcaagcctgtaatcccagcactttgggaggccgaggtggacagatcacgaggtcaggagatcaagaccatcctggctaacacggtgaaaccctgtctctactaaaaatacaaaaaattagctggacatggtggtgggtgcctgtagtcccagctacgcaggaggctgaggcaggagaaaggagtaaccgggaaggcagagcttgcagtgagccaagattgtgccactgcactccagcctgggcaacagagtgagactccgtctcaaaaaaaaaaaaaaaaaaaaaaaaaagaaacctgtctaaagttccatcatgctaagggaaacatgaaggctgttttggtcagtatacatctggaaccttcaccttctgttggaaacctattagtatctacccatccttttgagaataaagtctcaacttcttagtataaaaatcaaacctctggtcttagcctcaccctactctactctgtacctacctaccttcctaattcctgaacatttccttttcttcttttcatgctgtggttccttagagcctaagggtggtctgagataatttccttttgtctcaaaaactcttgttccttttgtcaaaccaccttattttcttcacagctcctcgtggaagagtgtctggtcttggggaatgtgtagcccttctggattctaaacacgtggagtacatgtctatccaattcctgccacaaagatatcatcagtaggatgttttcatgtactcccctcctcctccaattctgtaaactccttgagggcaggtaccatgtcttactcagccttctgtgaccaactgctgacactagagttgtccccagcaccagaaagtccttaaaacccgtttgctaaaatgattaagtgaatgacttatagacgtgaaaaatattgtggcataattctttgtatatgcaatatatatttaccaaattaatgaagatagaaaccatgagttgctcttcaagattatcaatgccataagcatttaagaggattttttttaagtgagttgcatgttccttatgttgcccacttaggtagtatactatcatgataaaagcagaattggatctgtacttggaaacccaaatttctagagaacctgttagtttctggaaagcactcagaaatcttatccttgaatagaatccaatgaaaactacataatttacttttatcttgtggatgacatttttaatggactatagacaggacctggtttagctcaagctagggaatccaaactctataattacttttaatcgtaaggactaggagttgtgaaactgctgacaggtcccagacatggcatggcaaggtataaagttcttgggatgttatgtttccttttgaatgctaatatgcccattcgttgctccccattggttccaggtgagcagtgggaaattaatgatgaccaggtggttgtaaaatggacctgtgacccacagcagggaaaaactggattgaaataccatattgcaaactgattctatctaattcttatcagccatcaagtaagaattgtagttccatgataaccttggcacatttggaactaatgaggtaaaaagaaagatcccacttgtctttacatcctcccatattatatttcctatagacaaagtatctgtctgtagaaaactcagaacagtttctttttcttttctttttctcttgatttttctgtttctttttaactaagactatttttcagagcagttttaagtttacagaaaaagtaagtagaaagtacagagaattccatatatcctctcaaccctcccctaccgcaacctatccacacacagttctcccctttattaacattttgcattaatgtggttcatttgttactattgatgagccaatactgatacgttattattgcctgaatcccatagtgtacgttaggattcactcttttgccatataattctatgggctttcacaaatgtgtaatgacatgcagtcattattgtattgtacagaatatttcacaaggaataccttgtgttatgtcttttcatttctcccttcctctcccaagcccttggcaaccactgattattttattgtcagcatagtttttgccctttccagaatttcacataattggaattatacatcatgtagcctttcaaattgccatctttcacttagcaatcttcatttaaaatacccctatgtcttgtctttgctttatagctcgtttctttttattgttgaataatactccgttgtctgggcataccacaatttatctgttcacctaccaaaggacatattagttgcttacaagttttggcaattatgaataaaggtgctataaacatccctgtgcagatatttatgtggacataattttcaactccattgggtaaataccaaggagctgatgctagattgcatggtaagagtatatttagttttgtgagaaactgccaagctgtctttcaacgtggctgtgctgttttctatttccaccagcaatgaatgaatgttcctattgctccacatccccaccagcatttggtggtggtggttttttttaattttagccattctattaggtgtgtagtggtatctttgttgtttaatttgcaattctctgatgacagaaaatgttgagcatcttttgatgactgtatttgctgcctatattttctttttgtcagattttgtttagatcttttgcccagttttttaattggctctcttattgttgggttttaagaattctatgtattttttgggtaccagtcttttttttttttttttttgcatctcttatggattctttgttgtaggctcctagatgtggattgcagagttacagaacatttaggaatactagtacctactgtcaaagtgcacaaatttacactctgaaacaattgatttcatggcacccttgccagcattgaacattattttttaatcttattttaaaagaagtgaatattctaatttgcttttatttactaagctttccccctgtattcactcacaatttgtatctagggtaattctcctgtttcaagacagaatgaattagatatgacatgaaccaactacaacagcataaatgagatggtttctctgagtattttccattgctcagatctgattattgatctggtgagccttgctgagacaaaggttgagcttctcaatgcacgttctctccaagaggtaggagagtatcataaggagaaggcatcattatgtccatgtgggacaaccagcttccttctgtcctgtggcctcagtcttttcttttcttttcttttttcagaaatttgtgcaaaatttaagatcagttttctttttgttttttcttctatccctcccccatccccccacccccagaaaggccccagtgtgggatgttccccccctttgtctatgtgttctcaatgttcagctcccacctatgagtgagaacatgcggtgtttggttttctgtccttgtgatagtttgcttagaatgatgggataccagtcttttatcagatacgtgttttgcaaagattttcacccagtctgtggctaatttttcattttcttaacactctcttttcacagagtggaagttttgattttaatgaagtctgacttaaccatttttttctttcatggatcatgcttttggtgttgtatctaaaatgtcattgccataccaagcttatctagcttttctcctatgttatttctatgttattttctagggaatgggttttttttaaaaggctattggtttcttaatactatgcataggttgattaaatgataccaagtacttgcataaactctattgattatgttagtaaatctaaaattgatgcttaaggaaatgtcaagtttttaaaatgtgtatatacatagtgttaacaagcttattctaagatgactatattttgatggtttaccatattgttcaatacctttcctattttctgactttttaattctgtgattatatttattgttcttttcagaaggtgataaccttttttaaaaagcctccacaattcatatatatatttaaaacttaaagcccagtctttgcaaacacagtggtttctgagaagcttttctctaaggtatcacacgttcttataatgatcctattgaagatagtttgtttgtgctttgaataggtcaatggcttcatatggctgcaattctattttaacagtaattgcactgtaacagcaatgtcacataattaaatctttttaaaaaaatgctgagctctcagctctttatttccacaatgacatcttgttgaacacatcatggtaccttgcagagaacgaattaactgctgtgtgttttctccctttttataaatcccattatcactttcacatggacttagtgtgaaaggtggctctttctgctttggctcttagggccttggcttgtgtcatcaagcaggcagctgtgattcccctcatctccttgtaggtttggttgattcttttatttacatgctttagtttagactctagagactttggcacaacacattatctgctataaaatgttctcacatatagtctgctgaaattggtttgggaatttatgaaagggcagtacatgttgataatagaattaagggtaaaaatgatgaattaaataaggcttagaggagtgaatataggatggtttttataggtaggacttaatcttcacagtaacccagtggggtagataatatgatctttctcagtacattgggcctttacatactatattgtaaaagaaccaaggggaagctaagctcattgagcaataaaaataatcaaaagtatctggaatcgtaattttcctgaatgtagttattgaccaaggataattaaacattaaaatgaatggtatgagaatatgtactatagcaaaactaccaaattgataatatcacaggctagccagactgaaaactaatactgttaagtaaacacaacatcaaaaatccttgggaaacacctttgaatagcttgtgcctctgatgtcatgaacttttcacacctcaagtgagaacgtgggttttgttttatgtttggtttgtgttaactgtcattgaggtcttcagttcagtattggaaattctgttgtaagaattttaatagcaaaacaagtcacagtgattttctgtaataatcttgattaaattctaggtactcttgttatctctattgtcccaataataattagcatctgctcacaattgtatagttgcatttctttgtaaagtaagcaatacttactttaattctgtgacccctaaattacagacaaggttatatagcaaggctgtcagcagttttgataagcttgagtcatggtctataagttcacctgaatctggcctatcggaaaaggagaggaatggggagcctttaaaaatgaccacatttctgccaagtatgttcacgagaatgtgtctgacttcactggtagtttctgagtctgatggttctggtcctttgtccaggcctggagatgtttcctccctgtttacagcctttccctagtgcttgtgaagctctacatatgggactcgtgagtccatcctcagctgctggtcagcctgtcactggtttgtgccttcacttctctgagctcagtgttgaaaactagtagaaactccatccttatgtgcagcccaagttcaatggaaagtaggaatagttcagaacaggggctcttgagtaagagaaacctaggatgaaagctggtgttccgttttagtggttgtaatatttagggcatgttatctatctgagactcattttcctcattttaaaaatagaaataatgacatccatctctcaggattgtggcaaagattaaataacacagtaaaactggtatattatttatgtgaacgtaggttattttttctccttcctccttgccctcccttcccctttctcctcctctccttccttgttcttcctcctcctccatcctcctctctttttcctccattttctcttccttctcctcctttttcatatcatgtaatcagtattatcattttcatgttcatccatatttgttccacccctccctaaatttatcatatgacacaatgctatgcaacatgacacacaattatgtatctttaatatcacatggatttgatcatactcccagatcgcaggcaatggaagtctgttctggcttatctggcttttccagaagtgtggagtatgattcactcacgtaagaaaataaattacttcagctactctgatccttctctcaatgctacttccttgaacccccaggcttaggccctgtattagtccgttttcacactgctgtcaaagacatacctgagactggggaatttacaaaggaaagaggtttaatggagaaccaacagttccacatggctggaaagcctcacaatcatgggggaaggcaagggggagcaagtcacatcttatgtgaatggcgacaggctaagagagggcttgtgcaggcaaactcccatttttaaaaccatcagatcttgtgagacccattcactatcatgagaacagcatgggaaagacctgcccccatgattcattcatctcccaccaggtccctcccacaacatgtgggaattatgggagctacaagatgagatttgggtggggtcacagagccaaaccatatcaggctccaagcagctgtgcccaggaaaagtgatcctagctcaattcagcatctgggagctcatgtagttggcatgtgtgttaacctcagagttccatctgttgtgaattttcattggcctctacgcaattcagcacaaagatgctgtgctaaaggttgtgccagaatgaaatttgctttagacatccctgggtagggcagtttaacctcagagtcggtctacaagggtcttttggctttcttcaacaaataattcacttgaggaaattatttgactgtcttttgcatcataccaactgaatcaagttttcttaaaactctacactgttgatgggaatgtaaattagtatggccaccatggacaacataatggagcctcctcaaaaaaactaaagatagattaaccatatgatccaggagtcccactgctgggtatgtgtaggtacaaaagaaaggaatcagtatatggaagagatatttgaatgcctgagtttattacagcagtattcataatagtcaagatgcagaagcaacctaagtgtctatcaatggatgaatggataaagacaatgtggtatatatacacaatagattattgttatgccataaaaagaataaaattctgtcgtttgcagcaacatggatggaactggaggacaggatgttaagtgaaataatccagacacagaaagacaaatagggcatattctgtctcatatctaggggctaaaaaagtcagtctcctgaaggtagagagtagaatagtgattaccagagacttggaagcgtaggggtaaggggaagtgaagagagtttggtcaatgggtgtgcaaatacaggtagatagaataaataacctttatggttctatagcacaggtgatagtagttaataataatttattgtatatttcaaaatactaggaagagaagattgagactgcttctaacataaagaagtgataaatgcttgaggtgatagattgcttaattaccctggtttgatcattatacattgtatacacatatcaaaatatcacatgtaccccataaacgtgtaaaattattatgtatcaataaaaaattaacttaagaaacaactctaggcacctttcattgtaacctttaacaacattggtttataaagctttgggcaattcagtctcatatatagggtccctgagcttgatttattatctggctgtttacaatttgtggtgaaatctatgttttataaattatattttgttatgttttatcttggtgtatatagactttaaaagttttttatgaatataagagtataattgtggattggttgctagaagattttgaatttgctgaggttgaatagttttcatttatgcattatttggcataaatttgcataataagttcaagtagtctaacttcaagtatagaagacaaaattaattagtgtgacctgtgggcattttacttcaaacgtaaaatccagagcatgcacacgtaaaatgtataatggatttctcaaccaattaatttaatcacagtctggattatgagacatttaaaccaacaggaaatagggaaagagggttaatggaggtcaggttgaagccatagaagggtgctagggcaggacttatattttggctggaaaggggtaatttgtagtataattttctcagggcttaatatcaccagtaaattccacagtgtagttcctattacctgaatttgtcaaagcttcctcgttgttttagtctgctctggctgccgtaacaaaatactatacattggatggcttaaataacagacatttatttctaaaagatctggaggcaggaagtccaagctcaggatgccggcatggttgggtctggtgtgggctctctttcttgcttacagacggctgccttcttgctatatcctcaaatttgtgtgtgttagtccaggttctctagagaaatagaaccaactggatatgtagatatgtaacaggacatctattatgggaattggctcatgcaattatagtggccaagaagtcccacaggataccatctgaaagttggaggaccaggaaagccagtggtgtaaatcagtgcaagcccaaagacctgagaaccaggggagctggtggtatatcttccagtctgagagcctgataactggagtgcaggagtgggtatcactggtgtaagtcctggaaagagaaccaggagccatgatgtcaaagggcaggagaagatggatgtccaaactcaagaagaaagaattcacttttattccacctttttgttctatccaggccccaagcagattggatgacacgatgacacttgcccacattgacaagggtgggtcttctttactcactccactgatacaaatgctaatctcttctggaaacactctcacagacacagccagaaattgtgttttaccagctatctgagtgtcccttagccaagtcaagttgacacataaaattaatcatcacagtgcgtatatacaatacagaggtttaaatattagtagtaaaataggcaccggtgtacctgccacttagactaagaaatagaacaagtaccacccctcactgttctactgggataactactttactcgttgtatttgccattctcttgataggtatatatttaccaccaacgtatgcatccctaaaccagatattgagtggttttgaaaaaactaagtagcagatctaaatccccctgtgtaaagaaaaggtgatgctttcacttttagcttaagtttcccaagaaagctgaaaagagtctctagttcattgttgagcttcagtttttctgagagtgcacacggactcattctaagagaacttagtgggcaaggtaatgactgactcctgggcagtccttggcaggtgttaagttgagttctagctatcaaatgaatatattatcacagggaataggcttctttgaatttttctgcttcactatgatccaactcttgctgtcaggaataggttcaggcagagcatgtcagggggtaatatagtgtcaatatattttatataacactcattcgtattgcaaattcaactttattggggcagataacccagtagcttcttgacagatcatgggtccttcattcaactcttgcacttgtttgattgtttgggttatctgtaaaagtcttagaactttgaaggtcttgtttcattgtcttccttactgtatggttgcctttgagaagttcaaaaacattccaaattttaatcctttgtatataatctggtttttcctttctataagcttgtagattcttccttttgtccccagtactcttcaatttcaaaacaagatgatgttatattgttctgtagttattgtgcttggcatttgatgaatcatttcagtttggaaactaatgttttaggaaatattcttcattttgttttttatatttattctctattttcttttgttttttgagactcgtattatggggatgttttttgaaactcctcttattgggacctcctggactaggtttctaatttttttagtttttctctcctactttctatctctttttatttttgctctacttttttagagattttctcaactttatcttttaacttttctaatgaggtctctatttattttatcaaatttttattttcaaagggttttgtactcttttattctctgaatgaggttcctctttgttttccttcatattctttgtatcatttaatattataatttttccatttcttggaaatttccattccattttctctcaactccctgaggatattaaagatatcatgtttaaagtgtttttctttgcgcaagttcattttctatttttaaaaaaacttttagattcaggggtatatgtgcaggtttattatacaggtaaattttgtgtcacaggtgtttagtgtgcagattatttcaccacctaagtagtaagcatagtaccagataggcaattttttgattgtcacgttccttctctctaccatcaaggaggccctggtgtctagtgttcccttctttgtgtccatgggtacacaaaggtggggaatatttgtgtcctacttataagtgagaatatgtgatacttattaaatagatttctgttcctgaattagttcgctgagggtaatggcctccagctccatccatgttgctgcaaaggacatgatcgcatttttttttaatggctatgtagtattgcatggtgtatatgtcccacattttctttatcctctctacccttgatgggcatttagattgattccatgtctttgctattgtgactagtgctacagtgaacatacacgtgcatgtgtctttatgttagagtgatttatgttcctttaggtatatacccaatagtgagattgctgggtcaagtgctaattctgtttgagttcttagagtaattgccaaactgctttccacaatggctgcaataatttacattcccattagcagtgtataagcactccgttttctccacaacctcatcagcatctgtcatgttttgactttttaataatagcgatttgactggtgtgagatggcatctcattgtggttttgacttgcatttctctaatgatcagtgatgttgaacttttttttctatgattgattgccggatatatgtcttcttttgaaatatgtctgttcatgtcttttgcccactttttttttttttgtaaatttgtttaagttctttataggtgctggatattacacgtttgtcagatgcattatttgcaaatattttcttccattctgtaggttgtctgtttattctgttgatagtttctcttgctgtgcagaagctcttcagtttaattaggtcttatttgtcagtttttgttgtttttgttgttgttgcaatggcatttggtatctttgtcatgaaaactttgccaagtcttatgtccagaatgatatttcctaggttatcattcagggtttttataggtctaggttttacatttaagtctttaatccatattgagatgatttttgtatatagtataagggaggggtcagtttcagtctctgcatatgactagtcggttattccagcaccatttattgaatagggagtcctcttcccattacttgtttttatcgactttgttgaagatcagatggttgtaggtgtgtggcactatttctgcactctctattctgtttgatttgtctgtgtgtctgtttttgtaccagtatcatgttgttttggttactgtagccttgtagtatagttttgagtattgtgatgcctccagctttttttttattattattatttccttggctatttgggatttttttggttcatatgatttttaaaatagtttgttctaattctgtgaagaatatcattggtagtttgataggaacagcattgagtctgtaaattgctttgggaggtatggccattttggtgatattgattcttcctatccatgagcatggaatgtttttctatttgtttgtgtcatctctaatttctttgagcagtgttttgtaattgtcattatagagatctttcatctccctggttagctgtattcctaggtattttattttgtttgtggctattgtgaataggattgtgttttttattttgttctcagtttggatgttgttggtgtataggaatgctactgattttttgtacatttattttgtatcctgaaactttactgaagttgtttatcagaaaaaggagattttgggcagagactctagggttctttatgtatagaatcttattgtctgcaaacagatagtttgatttcctctcttcctatttgggtgccttttatttctttctcttgcctgattgctgtggctacaacttccagtactatgttgaatagaagtggtgagagtgagcatctttgtcttgttctgatttttaaggggaatgcttccagattttacccattcagtatgatgttggcttatgggtttatcatagatgactcttattattttgaagcatgttccttcagtgcttagtttgttgagggtttttaacatgaagggatgttgaattttgtcaaaagccctttctacatctgttgagatgatcatgtagttttggtctttagttctatttatatgatgtatcacatttattgattcgtgtatgttgaaccaccttgcatcgcagggataaagcctacttgaccatggtagattagctttctgatgtgttgctggatttggtttgctagtattttgctgaggatttttgcatttatgttaaagaaggattttttttttttttttttttttttttgtctctgccaggttttggtatcaggatggtgctggcctcaccgagtgagttaggaatgagcctctcctcctcagagttttctttctttttttttttttgttaaatagtttcagtaggaatcataccagctcttccttatacatctgctagaatttggctgtgaatttgtctagccctgggctttttctggttggtaggctttttattactgattctgttttggaactcattattggactattcaaggacttaatttcttcccggttcaatcttgggaggatgtgtatttccagaaatttaccaactttttcctgtttttctagcttgtgtgcagagaggtattcatagtagtctttaagggtgttttatatttctgtggggtcagaagtgtcacttctgattgtgtttatttggatcttctctctgtttttctaccattatgtaatgttgttctttgtcttttttgatctgtgatggtttaaagtctattttgtctgaaattatggtagcaacccctgcttttttctgttttctatctgcttggtagatgttttgtgtgtcatcgcatgtgacctgggtctcttgaagacagcataccattgggtcttgtgtcattatctaacttgccattctgtgcctttgaaatggggcatttaacacatttacattcaaagttagcattaatatgtgtggatttgatcctgtcattgtgttgttagctcattactgtgcagatttgtttgtgtgattgctttatagtatcactggtctgggtatttaggcatgtttttgtagtggccagtaatgacctttcctttccatatttagcactcccttcaggacctcttataaggcgggtctggtggtaatgaattctcttagcatttgcttctctgaaaaggatcttatttctcctttgcttttgaagtgtagtttggctaaatatagaattcttggtttgaaattcttttctttaagaatgctgaatataggcccctaatctcttctgtcttgtagggtttctgttctaaggtcagctgttagcctgatggggtttcctttgtaggtgacctgccccttctttctagcttccttaaactttcttcctttcattttttccttggagaatctgatgactgtgtgtcttggtgatgatcttcttgtgtaatatttcacagggtttctcttcatttcctgaatttgaatgttggcctctctaccaaggttggggaaattttcatggatggtgtcctgaaatgtgttttccaagttgcttgctttctctttttctctttcagggatgctgataagtcatagacttggtctctttaaataatcccatatttctcagacattttgttcattcttcttcatttttttttgcttcatatttgtctgagttattctggaggactggtcttcatgctctgagattcctcagctggtcaattctgctgttaataacttgcagttgtattctgaaattcttgagttttttagctctagcatctcaatttagttatttcttaaaatggtcatttcatctttcatctgctgtatcattttattgtattctttagaatttttggattgggtgttaactttctcctgaatctcgatgatcttcattcctgtccatattctgattctatttctgtcatttcagctatttcagactggttaagaaccattgctggggaactagtgcagtcatttggaggtaagaagactctctggctttttgagttgccagagttctcgcgctggttctttttcatctttgtgggctgattttccttcagtctttgaagttgctatcttttagatgtttttttggtttttgtttgctttcattttctttggtgttgttgggtgtttgattatggtataaggtgggtttggtcaactggcttcatttctggaatattttagggggccaatgctcagctcaacactcctgagctgtgtgctttaactctggtgggctcattttgggccccctgctttcatctctggctcctcagggttaggaacctgttgccttgatgggcagtgacagccaaagagcttcactgggtggtggaagtaagatctgtgctcatttgtacatgccagaagcaacagcagtgtgatgacatgcatgctcatcagctggagtggggccctggtgagccaggggcttccagcctccatacaggcatttgcaagtggcagtaatagtgggtgcgatggggcactggcgggtgtggggctggtggtctccatgtgtgcattcacactggaggcaatggcaacatagggcagggagtggggctactgatcttcatttgagtactggtgctaacagtggtggtacagctgggtggatgggggcaggttgcgctcatgctggcagcagtggcacagtgggtcgtagatacgtcccagcagggaagggtaggcaaggtctgctggcacacacacactggcaaaatggtatgggggtggccttggatgagtgcatgccagcaaagtggtacagaggatgctgcagtggtgggagggtgcgggtgggctgatgtgccttggcagaggccactgggctggagctatttgattgtcaggcacagtcagccagcgcaggagctattatgcatgtccctgggagacaccccagttaggcatctgcggctgcactgcaagcaggagatgccagcatacaggggtcactcaggtcagactggccctgctctgttcaggtctgacagtttgcctaaggctaaagtttcctaggggagcatgggacgccttggggatgggtatccctggtcatgcttcactgtggacattgctgcaccaaaccctctgggctccacactggctggagccctgcccttaccacctctctaagcaactatcccttccagcttaagtttctgtgggggtcttgtggtctcctcctgccaggattctataagtccatggtgagagtatgtcattccttccctgctcaactcaccactaccccaggggttactgagggccaggaactgatgaatggtagcccctgcagggtttccagcttcctcccccttaaacccagcatctgtgtcctttctctagccattctcaataccttccttctgaagatctgcttagagtgtgccagtcttcctgatgtcctggtctctcgatggcagatgttccttctggctgtgtctgttcagctatcttgcctggaggatcctgtttattttgatctttggcttctgcattagaaaaatttctcaattttctgatcacttttgcctttctcttcattattaaaagtgggaaacataaaagctgcctggaagttctgagctcatgcataaagcttattgacttcaagcttcgatgtgggggaactgagtgaactgtttcttgggaatgatgaatcagtgctgtctttagacctatggaagaggtgcttcagctttcgatgtcctagatatgtcccatttctggctttgccctgcttcatgggatgatttgtctaaagtgctaaggaaaagggctcatctagggatttctctacccttttctagactgtgctttggattcttagaattcctgccccaacagctccagacctgcttctaggatctgcgtaggcctcttcttctggtctagtctcacaggagtcatgtagagtgggcataggactaaggaaggccctttggggcagcagtttgcatgggctttggagaaagtttggggatgtggtctgtagtatctgtatacataagcacaagttctttcatgttttgaacatccatggagtggaaagagaaggaggtctaactatggaccacaagcactatgttttgttctaatactccttggagtacaagaattatgagtttcagcatctcatttaggtaactacaaaggaatatttatcaggataggaagatagaacatatttcatttaacagttttggggattaacattaaacttataaatatctagaaatatggaatgcaggtctttatgttcttgccttgagccttataaatgttggtagtgggcctgttctcatgttaatatatttcctcatggttttgtcagattccattgagatgagttttccaatgtttttcctagaaagtaaggttctggctgccagcttttggggaattcagggtgggaagaaaactggggatcactgcagtcttcagatgatcaattaatcttcattttctgtaaggtaactgtgcctttccacaatgggtggtggatatctggtgatctaacatccagtgcttctatcttaaccacctcctttaacctcagctcctgaggcacccggtactgccagtttgcaagccttttgagggttttgcagtagaaattattttggttcatgtctatacccactagtggtttaggatttgactctctaagggctctgagtcagttgccaatttttcatctacttcatctgttattttatccttatttttgttgatttcttttaaaaatctatttactgtaggttagtagtatttctggtgagagattaatatgtgcatgaaatatgccatcttattctggaacacagcttgttcttttcacttagttagaacttgtgaattccatttaatccctgcaataaaagttccattgtgaaggttgagtattaactcatgcttcctggacttaaacaaagtctctgctaccaaaataagatgaattgttgagctcagggatagtgacactggtgctcaggtgataagtgctctcactactcctaagtaaaatagaggaaatgtcaaggaagcttggcagttggttaaccatagtgtagaaggaaggtggtaatttttgaaaagtttctgctttttcttcgccatgtaaaggcccaaatggaagtgtcagattacaatatttttctactacgttgtttttttacatggcaggaagagtagaagttagtttttagaaaactggcatataacttacgaaactactgctagctaatccttgtagtactatgctaaattaaaagatagatgattgggtatgtctgttttctggctaaagatgctcaaaagatagtgaaaagagtaagggagaataaaaattgatgttttgataatttatttttaaatatagtgttgtattgagtctttacaaaaatcctgtatgacatctattctaaacaccgtagtctttaaaccaaggctcagaagaattgactaagtagctaagttgagtaatttgcaagaccaaagcaatactgggatttaaacccagcagtggatgactgcaaatcctttctactgcatattgccaccttcttggaataaatttgacagttgttggtaatcgtgttataaaattgtggtagagaatgcccttttttctttcttttctcctcgcaattaacagctaagtattgctcaatcaaaagcagttactcttactttgctccttgaagaacaggcaaagttgttgattttatacccatattagagatgaatgacacatgtttgaaaacttctttttagctattcctcttgattccatatcttgaatatacaatctctaattgtagtttaaaatgtctgctatgaagtacattgaatttatacttggaccagactaactccaaacactgataatagaaggaaatcagaggtgttgatgggattcctgcgtatgtataaaatatatctcctaacttaagtaaatggataaacattgattaaaatctattttctatttttgcacatttaatattaaaaggaaatattaagcaagattccaatgtggatgcttatgttaattatagctatattccacttccagatttattatctatgtcaaaattccaacttttcctcatcattcctcaaatattagaaattctattctgctcttatcttggtggatcaacttatttccatctttatagtaggtctagctgaagatgattactctaatcactatttttaggagatctccttattgaatttcccttccatttcctgcaaagatgcatgattgccatgctgaaaactttttgatgtttctgtttatcttttaaaaggaggagaaatattcttttagaatgattattactcccccaaagatatgacagttacaagtgctccttatcctctactgactgtcttttgcttaccttgtttcttgtctaccctggacaggtgacttgcacctgaaagacagactttctcttttgcatccaaacagtcgttaagcccatcttcctccctctttttatactcatttattgaatatctaccatttctttactaggcattggggaagtgaaggtaaacaatccacactcactcacaggcttccatagttccacaaaatcatggatgccttaaagatttatgtatgcaggactttagaaacataagggaatggggtggtgggattgattaggtctccctagcagaaaccaatctaggaggtaacattgagatacaaactctatttctttttctctagaccacctttactcctctagctaaaacgtcaagtgaggcttcatgttcttcagagagcctaaaatctaccccttcacccaggcaagaattagcccctctttcctatagttttcaaatgactaagttaatacatttaatacggcctgtgttatacttatcatttttttgtttatatatatgccttctctactacgtggagattcttcaaggttttttatgcattttaaatcttcttctgtgtattatgaatttttaaggccctagtactttgtattttcagacagatttatggatgatggctttaaatatacactcaatgagtgaacgattgtaaaaaattcttagagaacaccactgtcttatcatttgcttgctacttaccagttggttaattcaaaattttgaaggttttatgttagatcatggatttaatcgtgtaattgtacttttaaaatgagaaatttgtagatttttttttaagttttggaaagaagactatttttcagtatttcaggactcttgtgattctatctgaagtaggttctatacactaaagccactgtgtgtgtttgacactacctaagtaggatattttataaggtgcataacttagtcttgtcttattgttttctgaggtcctactgttaccactcttacattggccatccttaaaattagttggattttttaagctttgcctcttctagaagctgttttttgttcttttctttctaacattttatgcctttagttctgatattggccaccaggtagcaacagtgccttgagtagctcaagtctcataaataggaaactgttgtagacagacaaaaagatgaagttgtctgcattcaggaaggaaggagtaagtgtccagaatcctcaatgtttaattcccccggcactgcatcctcatgttgtctattgcaaatgcaagcataaatttaggcataagcataaaaaatgcaagcataattatcaactgtccatgagcagcctccctgttctgccaatccatcgttactgcgacaattcacttcatctcagggccagtgaaacacaatgagatgaggggcaggtggcaaggggcaacatggatcatgctaggaaagtgtgtgacaactgcaaacaagaagagactgaaataataaaaaaggtgtagggagaaagtacttctttctttttacggacatatctaaaaaacccataatatttatgagattgttttttaaccacgagaaacacatttatgctgatatagaaaaatcaaatatgttattttagatttttcttcttccttcacccttagcgatacctctgggtattctagttgtgcgtggagactgtgatttggagacttgccgtatgtacatagaccgcctacaggaggtgagtttatttagccaattttttattctcctcaactttccatttttgtaaacaattaccagccatatatatttgcttctgaaatgatgcatttggagaggaagtggaaatgtggtggctttgtccttcaagcatacgctgtatgtcaccctctcccactgtctctgttgttcactcctcagatggttgaaatgggaaagcattgactacagggtgctgttgccctggtgtgttccataactatagcttggaacttgtcattttaccagacacatacctgtatatttgagatgttcagaatttcaacagggactgataaataatgaaagaaaacagtgatatttaatgttttgtgtctgacacttatgtcagagacagctagattttgtaaacaaaaaaataaataaaacttctatgggaaagaaaaatcctctacatctcataggaatttgtcagaacacaaaagaataatctatttttttttctcaatctagtcttgctttagagaaacagaaaggaagtgaccccgtatatggcactcccataaatgtgaactgcaccagcaaagccaggagacccaaactcatcattacaattgttgttggttgtttttgcaaaaatttgagggggagtcttaaccgtctccattccacaaattgcaaaaagcatatatgacgatttctttatcattttttttgatgaaagatgtatattagagtcacttttcttgggtgtggcctagacatttgtatttttaaagctgttgggttgtcttgataccccttgataagcaattctgtcccagacaacatgttatacataggtaaatattgtaaataaagtagacacatactgtttaaaatccctctgagttgtaaccacttcaccctgaatatttgattctgtttctcttggtagaaataaattcaggggagaggcacatagtgatgtgaaaaattactgattttgagaaatagatgacaaatattgaatactgatgtggatgagagaaagatggtcaacaaattttacacttacggcttcattaagctattttgactgaggatagctgcttaaacaagttaaaatacgtgaatttttagtgactcaggtccaattctgttaatatgttcccaaacttctagtatctcatttcccaaaataatgtttgtattttgctgtggaatctcactccagaaacctgtaatgaaaaaaatgaatcataattggtaccaaacctttttacctttttttaaaattaacacatgtagagctttgttaacaagacttcacagtagaataatattaatacacgattgatgaattgactttgttaaaaaccaacttaactaacttaatagcatgcttaatgcaccaatattcaactaaaagtaggatttttaaaaaagaggcaactcaacaaataaagaggaaaaatttttaaaactaatggaaagtaatgtgatgaaaccctgtgggaaacaggtgtaaggacaaaggtacccaggattgctgacatctgtgaatagaatcactacactcattagcaaggaagcctaggaggcatgacaatggtgacaagttcgttataaaactttatgaaaggagtcaggctttcacaatctgccagtaaaacctcattaatttcaaccctgttaatttgcactttgtgataatgtggaggtggttggtgattttctctttgtagtctatgaaaacccctatttgctaagcgacttatcagtataaacagttaccatgacagtatgtatctggtctgaggtaaagaaaagctttctaagtgtttaaagggatttccaaagccttcttcacaagccaaaagtttatatgcacattaaatataatccccatttatcagaacaaaattgcctgtcttttacttctggtctcctctataggagattgaaataataatataacacttactttaaacactatgtaggacttataggtttcaacagcttaatgaccttctctcagtccagcttggtttgattttattatttctggcattaccttctttatttaacctttatgaatttgggtgtgttcgatactttccagatgagcatagtaatattaaattgggagttcagttgagattgagttgtggggcagcttgttcaaactaattttaaggtatggattttttttttcattttctcattaggacctacagtcagtttcttctggctcccagagagttcattaccaggtaacaaataattgactctccttgtttcttaccttctggccaaatgaagtccatctttcaattaatgtcttattttgatttagagttcacatcttccctagggatagagttcattctaagaatctagtgaaaatggtattctgattcttttgcattttcctgattttggaccagcctagtctagcacaaatttagactgtggattttctcctagatcatttagaaaagattataaaattgagtgctttcagtaacaaataccagaaaactcagctgaaactagcttagcaaggaaagggtctcttggttcacataagcaaaaagtccagatcaaggtggatttctcatcccatttggtcatggctcacactccactttcctgctggtccttctactttgttctcctcttcctgtcaattttacctctgggctagatgactttgtggtccaagatgactgccattagcaaccaggactatgtttttttccatcatctcctgaaaaagagaattacatgcttcctacaaccatcaagcaacagttttaaaatgtaatctgagtggttcatcctgggtcttttggacaatctaataaacccagtctgcatctctctatggcccatataaagtctgtaggagaacactcagttattctttatcccagcagactttgggggtgcagtttctttccaacttccccatcccacttgtgatgcacagatctcttcagccatcctcttatgcattagatttctcagacatgatgtagatcctagtacacagtattactcccgactgcaaggagcccaaacaaagctctttgactggtctcattaaagcccttttatctgaaggctccttaccctgccctgttaagaggaaaggtatgtgggaatcacagcatgccaacaattctctccaaataaatctcttcaaacccttcatacttccatgtggggaggaatataactatgcctaaatttataaatgtgaaaatcctggtttagcacttcactttggatttttgtgtctattttcccatgcctgaaatttccaatttaacatcctttaacataaatagaaaacacaataatttaaagaaaaacctatatcttgtagccttctaggtattccccctaccaatgataccctctgtccttggctgaagcagcatatcttcagccttaatgacaggaatggcctttgtgttcttatttgtgtatttatttctcaaacaacgtatcccacacttccagagttctttcttccatctgtctggccttgaaaggaagaaaagtcacttaggatatgtttacattaaaaacaaaacaaaatgaacttcttctagactgtttttaccaaacactagaagacaaatttccaccaaattttttagatagagcacaactttcatcagagtgactatttgcatatttacccagagccactatcttggtgtaaattttattttaaaaagcatagtgctttcacaatagcaaagacatggaatcaacccaaatgcccgtcaacgatagactggataaagaaagtgtggtacatatatactatggaatactatgcagccataaaaaggaatgagatcacgttctttgcactgacatggatggagccggaagccattatcctcagcaaacttatgcaagaacagacaaccaaacaccacatgttgtcacttacaagtggtagctaaacaatgagaacacatggacacagagaggggaacaacacacactagggcctgttgtaagggtgggaagaaggagagcattaggaataatagctaatacatgctggttttaatacctagggtatgggttgatgggtgcagcaaaccaccatggcacatgtttacctatgtaacaaacctgcatatcctgcacatgtacccaagaacttaaaataaaaattaaaataaaaaaagcatagtccttttaaaggtaagagctgatctctaacaattggcagtagtagttataagactatgaggatattgtctttaagagtttatactttttcctcttggacattttgaacctttaaaactttatcaaaatatgttagatttatcctagctaggtttatgaaactacttttatttattattcctggcttatatgatgtagtcatttttggtgtgagagttaaaattgtgggtattttgtaccatatttttttatgccctatctgtaactattcatggagatcaacggatggataagatactacaatatgagtgagttatgtattgcatgtattgtttggtaataacactcagaaggattaatgatatttttctatgtcaaaatattgctgcattattttgtttacttacagtcaagtcaaatcttggtgtcaaaactgctgcattataaatgccacatcaaaaggttttgtgtgctgaacatctaggataacgaatgcagtgatcagggatgagtgtcagaggtgtcaccttttcccatatccttccttaggacaaggaaggcgcaagaagagtgataaaaatcaggggactttgagcatgaaggaatggttggaacaaaaaagatccaagaagcccagaatttgctcattaaacaggaaagaaaaagagactgtgttagaactaacgtggccagagcacagggagaagctaatgaggaatttcctgagcagggcaaggagaactggttgaagcacgaagctgggagagataaactttcatgtttggccaagatcatcaaaggaggaatgagttggaggcataggaaatagagttctgtgttagccgtattagttttgatatgcctgttagatccaagggggttggtgagtaggcagttgggtatacgaatattaaacctcattaaaaaattcaggcccagagatagaaattttggagtcatcagcaaatggatgaatggtgcttaaaactacaaggccggaggagatcacttagggaggagttcagttaaagaggagggcccactgttctatctatgtttattcatgagtcaagaagagtgcaggttcaagacagcaactggtcaagaagaatcatggaaactgagataagcagcagggaagctggaaatcaaggagaaggtggtatcacgaaagccaagagtgaaatgtatttcagagaggaaggagtaatggacagtgtcaaatgccattgagaggctgaaaagatatggattgatttccgtatttttttctaggtgtgtgtattataaaacacatgggatataggtgctattaatttttatgtagaaagtgactggcaggaaatttaatactaaatcttttatttcttagtgcagaaactgattacatcagaattccctagtttgtcccggtgggagtaaggagtgttataggtgaaaaagaaacatgaacgacgaaatgccttaaatgcctgttaatgaagtttcttgtctatgagatgacattaaatatgcttggaggattaactgtgaagagaataaattaataccagtatgtttgaaaacttgagaaattcctgtcagctcactaatttgcagctagggttttagctgactgttttctaagaccagaaaaatctcaagagaaaagcagcatttagaaaggtgtacacgtgcccaagacaccttattagtgagccatgtggcagtttctcgccacttaagcatttcattgctttggtttcttccttttccaaatgcatagtgaattgccaacaaagcactgaagctcaaaaatgacacctcatgttaacctaacaaggtattatgggttatacaagaatgtgttagatatttatagcctgttgaaaattcctgcctacaccatctctgaggtcaaaattcaaaggcccctccatcctaatagcattgatgtaacctgtaactaatatgttttacaagcaaaatgcattgcacttgcagatttaggatattcttgaggttgccaaatgaacaagaattaacataagaattggactctacctgcttatttgataagggtcctttctgaggccacctactttgagataattccttctctgcttcctccctcgaaatcatgatatcccttcttaaccccaaatcacaaaggtactaaggaatagaggcagatgtgccattctagtgatttccagctgggaagaatttgctccctgtaggggacatttggcaaggtctgaagactttgaaatctgttggataaaggccaaggatgctgttaaacatcttagcgtgcacagagaagcctcctaccatgaagaattatccagccccaaatgtcaatagtgtagagcttgaggaaccctgagtcactctgacggttctcagtacataaatgagaaccccagataggtataagacctagatgaggaaatggaaaggagaaagagagaagaggaacaaaagaaaaggtagggatggagaacagaaggaggcatttatagatgtagtagggtagaataaagagagaactaggagcaattagaggggtttttttgtagacaccctgggtttccccatttccccagggtgattctttatggggcattaaatggtaggaattataacttgagattttagtgcataccataggattcacctgtagttgcaaaaatagattcaaccaggtgattactttctctaagaattaactcacttaaaaatagtaccagaatggttggaatatttaaaaatagagaaaacattattgaaaagccttttcattcttcagggtggtacagatgtctttcactttcataagaaaaaaaaaaacaacctcttggtcagatcggagtctacattacttgttcctcctctgatgtcctttgttcctacatgcctgctcttctggaggaccagcctatgttgtattccattaaaattgtgtctagttctaggcaaacagcattttcctataaatatttcattcatcccctttctctttattctggctgtccttattcatctctctcctttctctgaaatctcttcctcctccatttgttttctggagtctagaagagtccttcaatagatagagtgggacaaggtttagagagtcttcctgggaattgatttatcttgtgtgagagaggacagtaccagctagaaactttggagaatgccattcctttggactagattaaagctgtcagaaatgggtcaaatgaggaattaaataagacttgcctagggtcaggtctgttgtctcttacgagtgaagacagtactggagttgtcattattgctaatggagaactttctcacacaaagggactcttgaaaatgttagaatattgcttatttctatcttctaccccactgtcttcatcttcgaaatctgggttgaagaatggctatgccatttctgtattcctccactgtaggagtcatgagtggtaaagtaggttcgagatggaggggttttaagatattaaaataaatagtagcaaacctatttggggctgtagttagacagagacacatacatacctatttgtatgcaacattatgttaaaaaaatggatagatggcttgtatgtgggagatgttggggcagacagatgagaattttgaatgggtaatgagagaaatttaaaagtaaggtgattattgattggccattattaaatgaggcagggattcccaagccatagaacttttgttttgtttctgtttatgtcttttctcaattttatgaaagaaaaagaatttcattcacattgaaggcatagttcaacactaggtgaatattgcttaattggaaaacttactagtgtgtgatggggctgctgtgccttcattaaattatgtgtgcatcagctatgagcaattgcatgtaaattaagggtaactttggcatatgcatgccaaatagtggttcagatcattttctcatcaattttatataatttgtgccagttggctttcagaaatatatatatatatgaggaatgtcagttttgtgtttgtgcatgtgcctatatttttagcacaagaaacgtattttccattaatatatatcataagagaagattcacgtatcagggatttttgaaatgagcagtttttgctaatattattcatttaaagagcatgtaattttagaagattattatatttaaaatagaaaggagcatggtatatctaaggttatgtcatttggcctacattacagagcaatgacagttgcattcatctaaatcacaccatttatatgaagaaaagtcacagatccaaaatgggcaagtcaagtatcttatctctttgatgaatcattgatttgatcatgcaatttgagaggactggggagactagaggccctaaattaccattgaaagctttggatatgatggttagaggcacagctcagggaaatatagctgcattcatacaatcctattgcttcagtatctactgtcagatgcttttgaaagacgcatatttttaagattgtgttttttctctctattggaaaataggtcactgtacatttatttaatgtgcagcattcacaaatcaaacacactctgaccatttgtgttcttgtgtagtgatgagaacatcgccaggtccaacctagagcttccatgaagctaaggtctgtcctggaaccaatattcaccccctttccaggagccattagtttttcttacttcctatttccttccaagtctaattcacggtccacattgcactgcttttcacccttctgcagagactagaggatgcccctgaatcaaggaatccttaatgccagggctacccagtctaccagtcttccagaccctctgagaacagagaaggtgtttacctgatgtgagctgtgtggattagtaacgagagttactttaaacactaattagagaaaattcagtaatacctgtctattaacatcactatcactcacttacactccaattattattatttttttgaagtacaagagaaaggtgtatagatagacgtgatgcaggaattatttgtaccctgcgtacggaagaaacccattcatctgtgtggtcatggtaggttaagaatgtgcgagcataaaaagtttatggactatcgcggtaaattgtgaattcctgtctgatattctgcttctctttattcctgctccatttttaacccatacaatatgcatttctctctgatatcaaggtcctcatggtatatctcttgacttttataagctatgtgtgttctgcaatctgccaggttttataatcttggtttacctcagttttgatattgtacgtaattctagacttctgtttggtttttaactctccacccaatgtagacctttatggtgcgcatttttgttttcctacatttatacaaagttacgcacatagacatacatgaatacatatgtggggattgttgtttaaaaatacaaatgtagctgggcgcagtggctcatgcctgtgatctcagcactttgggaggccatcatgggcagatcgcttgagcccagcagtttgagaccagtctgggtaacatggtgaaaccccgtctgtacaaaaaaacaaccccaaaattagccgggcgctgtagcatgtgcctgtagtcccagctacttgggcagctgaggtgggaggattgtttgagtccaggaggcagaggatgcagtgagctgagattgcaccactgcactcccgcctgggtgacagggtgagaccctgtctcaaaaaaaaataaaaattacactaaaaataaaaatgtgtttacaatttgcatgtgcacactatacatattataccacaatttatttttaacagtaatgtaccatggaaattcatcttgctaataggtgaaactctaattcagtctttaaaaattatcactctattccatggtatatatttaatgctgtttctatggatggcatttttaggttgtgtagtattgttgccaatgtttgcaaaattccaataaactttatggtacttcaaaaataaaatcataacagaaatgaaaaccatgcaacatgctaaaaacatattaagattggctatatttgtgtgaagattataagttacataatgcatacagcaaagttacccaaaatctgtaattggatttttcttcacatggttgtagtctcggttcctgtgtctgggttggggttgcctgccattcccattgattaccatatttctgtggaattcttaggcagcagggaacacagtggtgggaagtgggaagagagcaagactgaagaatgtgtgggggcaggaactctgagctaccaggagcaaactgtctggtaagaaacaggaagcttagtttgacatctgtgtaagatccttgactagagtagaatgagatcttcatagccatttagatcattctaggtttgctttcttcctgcttttgtttgagctgagtctagaaaattctgagctctcaaacttgatctataccaaacctcactcttccttcaaaacctgaaatcataattcctctagaagctgtaaaaccctgtgcataaggtcatgagctctgaagtaaaagaagtctgtactctccaccactgaatagcttggggcttctgggtagtttacttaaattctcaccactgcagttctttattgtggccagctcttacatgcaggagaagaggttcaggaagaatagtggggtggattgcaggagaggtaggtaggagctagattatgcagccttcttaataacaaaacgaaaaaagcctgcacatgcatagaagattatgggttaaaattaagctattattgagactgtagcctaatatttctaaattatctctatggcagtgtccaggtaaccctaaaactaagggagatgactatgtgagacttgaacactccaattgtgaattctgatagtaacatatatggctgagtgaaattttatcaagtataaattattcagtagatgaaataaaaaatggaatagtctaagctttatttaatctatagccaccattaatacagaagtagagccatgtttatgggaaattctcagaagcaaaaaatgagcacaccgtaaaaagaaaaaaaaaggaaaattaccatcaccaaaatgtggttcagtgattttttgacagcttgtccggattagtgtttcttatccttcactgccagacagtggagatgagtcagggcagaagctgtaggtggaagactaagagtagggaggaatgaacgagagccagagtcaagagctacctgttctacttgacatcgtgacagctggcctctatgtaacggggttggatgactcaggattgtatctgctggcacttcttggccgtacgtcagcaccaggactatttgaaaactactgctccagaacaaaggtttttagccccaaatttgagactttgaaaggaaagggctttcttaaatgtgaattgagccttccatttggtttgccaacaatgaatttattctgctgtcttctatttttttttttaattaccaagctctgattcttttggcagctggctcaaaatcctttttccaaaattggtggctgttggcagtagccaggaaataaattgaaatcgtaattaaaatagtcatccattgggaaaagaagttgaaacttggtaaatcagacttacagtaactccaagaattggagccagaaagaagcatgcagagcacctagactggttcctagtgtagtggccaccctttaacgacatggtccatgcttcgttttttgtgaccttccgtcacatgccttgcatttcattggctttaataaatacacattaaaaaggttgatcacagttgtatcacaggaaaaagaataatgtatagttttgtgacaactgacaaattagcaagtgacacgttaattttggtgaaactaaggaaatagcaagtaggcagttactattgaatggggaagggagacatcagtaaaataaaatgttccgaaatgtatgcttgttggtgatagaagacattcagccttgaagacaatatcctgtatttaagacaattatataacatctaatgttgtgaacagaggcactggattgctgattaagacaagccctataagcaccaaaccaacaaatggcatgatttcagcctttgtttaaagccactctgttttgtgttcactcatacaaatttgtcctatttctttgttttctccaaaactcagaatctgagtgcaaatgtatttatggataaatagtgttgtgttaggggtagcaccatctaaatgatctggtctgaaatgtggcctgtgtcccatgagaccctcatgtgactaagggcagaattgttttaggtaaaataatgtctcagctgcctaacatgagatataattatctctcgcataattatatctgcacataaacatgtttcggcaaatgggttaagcattttatgtgtcattaattcctcaaaagaaccctttatgatagatattattgtagccattttaaaatgaggtattcaaggaactggataagaaactatcctacactctcacagcgagtagcgggtagggcgccaggattgtcgtgcctctcaaagctggtgtgcttcccatcagccttccgccgcctctgggcttgctgcttaattggggctggatcccatacaatctctcgccttgtttttccatctcattcatcagatctgtctcccctacgatattttaacacctcaaggacaggaacattttttggcatctcaattcttagcttgtctgtgataatgatgatcacatcctacaacaatttcagttttgcgaagcagactttctcactatctttttgctctgtttttcaactcaagtgaaatccagcatccaccaccgccacctcaaccaccaccaacttttctgtccctagcctgctcttcacctcctattctgtcttggatctttgagatatattttcagcacccatttatgcttcgtacctggattttcttgtttcttgttttaccgattactggcatattttgtgggtgtattttgcatattgtcaatctgttatgttggaacatcattttaacattgacttcaaaaaaatctccaatttttagtgtcccgatgtaggtgaagcattttcatctgcttagatatgtacatggaatagattcaagggcaattttttttgagacttgatgcttttgtacattttatatatgtagaatttttaaataagtagtttagttgcattatgaatctgcccagatagtaattacagtttttcattggaattcaaatgacttttaacgtaggacctattatgtgagtagctgtttctttaagaactcacttcttcttaaaggaacaaggtggaaagagcttcacaaaagttggaagaggatgcaaatgtatttcagggaagcatttcacagaagttagaactctacttttgcttttctaacaactcccaaaattgaagtttaattgtcaggtcaccaggaaagtatccaattgttaaaatcagattcctgtgcctttaagtaatgatgtattgtttaacttcaattattaataccatacaatggtaaatataaatacattttttccctttgtttataaaaatgaacataagtagaagaacttaaggcactgaaaacaaacacttgggagagactatggatggaaataagcaaaaagttgagtctttccatgtaaaaattgacctagtttcagtctgctcctaggagaatagccacaagctcagagagcttttgttgtttgttgttttggtattacaattaccagtaactttgcattggtgattcctattctcataaggcattttactgatcagaatcttcttattttgttgaattctctgtgacataaatttttgattctttaaattaatagcttttttagcatcttggaaatctcagatcactttgataatctagaaagcagtggtttttctgtccaggaaaatgaacatacacatagacataccaaatctggcatacaattttggagagttcaagaattgttgaacctatttgaggacccattaaagtattttaaagagctttatggcgacccatgtgttttcaccaaacaaaattgtaatgttatctttagacgaaacctctttaagaacattgagttatatcagatgtttctgtagatcaaacatttttgcaatttccatctatggatcaaaatgtagagtaaataagtgaacaaaagcaaactacattaaaaaagtcaggcatgggcataaaactctccagacacacagccacctgcacataaaaagatatataccatctatatttccttaccaacctgtggtagtcatgttgctgaggcagtgcctcaatctagattttactaacctagactaaataacatccaattttctgtaattagaatagcctagagatagtgtgatggatccttaggtttttaaaacaataaatcaagcattcctgtattttttccattgatttttacatacagaaattaggattttttttattgtgtcctctgcagcatattcaacatcaaaatgcagaaagtgtccttgatgttttagcccctttattcatagagaagataatcctgtttctgtttaatctctttatttattagctttcatagttgccactaaatattttgaatcacttccaaatgtcttgatctataattacatttctcacccaactgagagacgtcagtagctttatctgtttttcaaaaatgcattaagtaccttaagttcctttaaaacaagttgtcacacatgtcaaaatataattctcaaaatgttacacataattctcatataaatagttactaagcacatgtcaagattttacttagctcaacaatcaggatgaaaatccagttcaaaaaagaggaaatatatacacgtgtatatataatatatatgtatatataacatataatatatacgtttatatatgtatatgtacatataatatgtatatgtatatatacatataataataatatgtatatatacatataataattatatgtatatatacatataataattatatgtatatatacatataataattatatgtatatatacatataataattatatgtatatatacatataataattatatgtatatatacatataattatatgtatatatacatataataattatatgtatatatacatataatatttaatgtatatacatataattattatatgtatatacatattatattatatgtatatacacataaatatacacatacatataatattatatgtatatatacatataatattatgtgtatatatacatatattatatgtatatatacatatatatgtgtatgtatataatatttatatgtatatacatatatatgtgtatatataatatttatatgtatatacacatatatatgtgtatatatatttatatgtatatatacacatatatgtgtatatattatatataacataatatatatgtatgtatataacatatatacatatatagtgtgtatataatatatatgtatatatgtctgtatatacatatataatataatgtatatatacacatgtatataatatataatatatacatgtgtatatattatatatacatatatacatatagagagcaagagagagactatatgtaacatatattttttctgtatatattatatagtatctctgtatccatagctatatggatatatttataaatataaatgatatacatattttatatttataaatatagattttggtagcattcctgaatgagaccattttttcctctatcaattatttaattcacagaattcatttagagtaaaactccatacactccaggtttctagtttactaagatgcatccttttgttcggtaactttaggttctttcacatacatcctcagacctatctgaaaggcttgttaaaacacattgctgggttccacccatagtgcttctgtagacctgggatgggccctggaaatttgtgtttctgacaagtttctagctgatgcacactttgagaacaagtgatttaatcccaggctttatttgaggatcaagtagggcagcagggagtgttgattaactcccaggaaagtcagtacaacctctgattgggtccttattacttcttctatgttattcctgttttcttctcctgtcccctctgtacacacaagatcatccacacctgcggcttcagctgccaagtctttattgctgcctgcacagccgcaccccagtgctgctccctacatttgaacatttcaaatccctattaagggccagactcccagtgtcttccccacagagacctggcctccctcgtttgtcccatttctgtcagtgatttcaattccactgcaaaccagggctagaatgctccaaatcacatgttgtaaactagaaggtgctctcctccctccccagttatcactggcaggcttctcttagtagagaaaatgtttaatttttaaaagtttggaatcttaaagagaaaatcctttcagttttcaatctgccagttctctcttctgtttcgtggatgtagccttaattctttataagaaataaaagcttctgagacttcaaggaagtttgggaactgagaattgtagtaagtcagggaagcaagctagtcctggcaatctcttggaagggcagctttggaaggctgggaggtcagaggccaagcttctagaggtcatgtctgaggtgtgtaagtgagacttggagcaggagataataaacataagcttcaggagtttggaagggcaagaaaggagagtttaagaagattatcaaaagatatatcagcttcagtttcagctactcaggaggctgaggctggaggatcacctgagcccaggaaactgaggctatggtgagccatgatcacaccactgcactccagcctggaagacagcctggaagacagcctgtctcaaaaaataaaatataaatgaaataaaaattaaaaaaatagatgtaacaagatcagctgagggtaatttattttggaagagagggaactattgagagcagaagaattaatgagtggattttaataatgctacagaaataaagttcaaaggagaaagaaagatagtccagagtctaaattaagtgattgactttggagagaagagaactatttttatccgaacccagaggaaagaatgatggtagttatgtcaggcagacttgatgttaaataggagaggggaaattgggaggtcatagaaatgagacgcctagaaaatgctcaggtgaatgagcacattgctgtctggatgagtgttggacagagtgattttgtcatgagttaacctggcactacttttcttccttgtctactcctctgtaattaggttcagtggagaaggctgaggttagagatgacctcagtatgcgaggttgattttctttgtttccatgtagatgaacagtccctgtgtatggatggctgctgctttttctcacgtaccgtatgtcccgtgtggccagtagataacgtttgattcattcccattctgtgccagcgccttagacctatgtgtcaatgacagccagctgtcactcattccttggcttcacaaagggaaagaaagaaattcccataaggaagtaaatgtcctaaattagattatttatgtttaatggaataattgaaaatatttaatggaataattaaaaacctcgtgctaattttatgagggagtcattttcaaaagttctatgtgaaagaatttcaaaaaagagcccttctttgtgttcctagagaaaaaaaaatgtgatttgctcttctcaccagtgctttgtgtaggaaaggatggcagaatgctgagtgagggaagcccatcaggttattgaaatgcagccactagagtgtgtgtgtctctttccaggaccatgaaacctccttccccagggctctctcagcacagaggctctctcctcggtggtgcttcctagatggtgagttctgcctttcttgcgggtatcgtgggagttggggaagttgaagagcaaggcatcaattgatagggtgggctctagttttccaaaagattattcagaaagccttcatgtgactccacatggctggtattggcatgcggaacaatgtgggcctgctgatattgcactgtcctttcctgaagtcatttccctcaacacagcttggttaactctggctgaactcagcatcaagttgctcaggccgatgtttttctttcatcagccctcttttcttaaagcttgactgcctgccttaaattaattcagaccagtagctggattctatatgcataggatggatataatttctatgttatttgcatcttatggaacattcatattatttttatgagaccattattgcagtatgatgtatacatttctggaaaaaggtggaaaaattcagttgcattcaaatctgctcagatccgcatgatatattgcatgcataataggttagttatcttatgattgtttaatgagtccgtttttttatctcaagtatctctctcctagatgctgcctaatactacatttctatccaattacccgtattgcagtaccttctcacctctgtatattcatgcttacatactaccgaatgtatctactacccattctctcttttgttcatatggagacatgattttcattgtagaccccttttttgtttttctgggtgagcatctgagaggatataaatgtgaatatgagtatgacaggatttgtgagtgtatgagcaagcattgggatggcagcagcagagatctattaagatttaaggactgtccagtagcctagcatgactgcaatgtaagggttttaactggcatagtggaagagaaggttataactttggtgccagatcacagaacactttgaatgccatatatatatttttctagtgttatgaagatgggcacttgtatctgtatgagatctaacccacataaatcatgatgtaggtttttgttaatgtctcatcagctgcctctcagaactttcctccagcttctttattccatagcaatgagaaacataatcatttgtcattcctgaatttgcagaggaacaacttgtatttgagaaaattatgaaaatatttatgttgttatgttctatctaaagtcttaaataaaagtacaaatattgtggctgacagtcttagcccaggtagtagttttactcctagttttaataaaataaaacctttaaaaggtaattgcagtcatggtttaaaagaaaaaagtagagtgaatttctccaaggcagattttattctattcttaggttttagacagcaggggtgatgattggctggtttcttagttctgtcgcctttggagagaagctactcattaaatgtttgtgaattttaaataagtgcttgcattttgagtttttctttcttgtgctgtttgttttgtagaaaatctatttataatatttgggctttgttagatagatttaagtgagaagcacataattctttttggtttgcttttttttttttttcttttttgagataggagtctgactctgttgcccaggctgaagtgcagtggcatgatcatggttcaccgcagccttgaactcctgggctcaggcaatcctcctacttcagcctcccaagtagctgggaccacaggggcacaccactatccctagctaattaaaaaaattgtttttgtagagatgaagtcttgctttgttgcccaggctggtctcagactcctggcttcaagcacttctcccacctgagcttcccaaaatgcagctgatagttctttctaatattaggaatatttaaaataatttctagaaacccaaaatttgtaatttagatttttttcgcataccatagatgtagctcaatctctttcagagaatgcttaaataatttttttgctgttttggcttccttcagacatgactctaaggatgcaggttgaaagtgaaatgattcatttaagaccacatatggtctctggcctgaatcttcaagccattttccgaagtgggaagtcacttcactgagaagtctacgtaactgtagctttttctagctttatttacttaataaatacatactaattcctaacttactttaagatcatttgctaatttcaggaggcataaaagattaaatgaaacagatttttaaagaggcaggtctcttagtctcatggttatctgtgaagatagtctgtataagaagttttaaaaaatgtaaatgtggatggatgcagggtcagcaggttctgtctggtgttgggaggttgggactgagaaaggtttcacagaagcagaagcacttgagctggttctttaaagacaagtatgatttagatggcagaggcaaagggaagggctttccaagccttagaatagcagtggcagaggcatggaagtgctgaggttttcttaatagatttagggactggccaggagactagcatgactgccatgtaggggttttgaccagcatagtcgaagagaaggttataaatttggtgccagattacagaacattctgaatgccatctgcattttttttcccctagcaacttctgctgatcgcttttatcgaatagacagatctcaggtaagtttttttccagcctgcttgtgaaagtgaaaaattcccaagttaatgtgctttattggtagctaatctcataaatttttctaacgaaaaccactgagacacaaattttggaatggtgttcataacttaagcttgaaccttttatttgtcttcacgtgttttatgatttatggactcaagatgatgtggcttaatcttgcaaatgagtacagaaaataagttgacttgtagacattatcaccagcctgtactccaaattttcattcacaaagatatttttactcctttttagccaaatttcatgtctttttaagctcatttctgtttagcaagtttgaggccccaggtgtataactagactacttagtttcagttcgccaatccctggaggtcagtgatgagaaaaaaaaaatggttttgcccaagttaagaattcctcccattatctgaattctcctaggagaaaaatgtacagtattgaacctaatgataaagttgttaaccatgctgcttagctttgaccagatgacggggtagaagtccacttatcatacactcctgctgggccaattgtatgtgggtgtcacttctctaatagtatttgggaagaagatgaggcaagaccatttctagatatatctaagaaaaagtcctggttaattggaaatcctgaaccaaggggattcatctctccctatctcccactgcctgcgttagcgcagctttggggaggatcaccaactgatcaagcttctgacaacacagtgtgatcctttgacacgttgcagaatttcattattcctcgagaccaagaatacttgttttgttattcttcatgcaacagacttcttgttcttctttaggaacatttgcactttgtgatggagatttcccaagatgagatttttattctggacccagatatggtggtgtcacagccggcggggacacctccgggcatgcctgacctggtggtggaacaagcctcggggtgagtgtgcttctcctggcctgtgaggctggccttagggtgacatccatgtctggttcgcctttgaacttgacatcgttctaatgacatcaaatgattttgaagtgtagattttcttgttgtgtttccttagagtggttattataagtctgtcttatgaatggccgtgaagaaacacaaaaccagatttacaccatgtccaagcctctttccccatcacagcaacccttcctaacaaacctagaaagcactagtacttgtgtttgtgcttgtacgtttgtagtaactctgttatctacattaaaaattgacacaggtgatttgacaaattttctcctcttcctcttctttgctatttccaggctgctggagacatgtagattatataataataactatgacataccaagccctttttaagagctctgtcctgtgtctctcttctgtttctaccaccgcttcatagtgacttaatcatcttaagtgctctgtgcttattttctcatctgtaaaatacaaataacaataatcctcactcagagaattgtttggcgattaaaagaattgatacaggtaaagcacttaaagtcattcctggcatttttaaaacatgcattaaacagaatgttattacaataataataatagtcatcaccatcattctagtgaccttgaaaatttggtacaattatccttaattcatagattaaaaaattgagacctaaagggttatgttacttgtctaatatttcacagaaaataagtagaaaaaatgagatatagtcctgggttacctgatgccagagcccatgcatttaactaccaccttctaccaccaaaacataattagtatttctaagttatttcaataattaaaaactatttatttagagaattttgtgtgccaggtcctagtgtaagcacttggggaataacagtacaaaaataaaaacagataagaatctttgtccttgtgaaatttagtgttttactggtctatggggcctgaattgttgaagtaagaattgctctagaaaccatacacaatgtgcccaaatagtaaatgcacatcgtgtacacagactcatacagtatgaataaacagtccactaggctagcacaactgcaatgtcatcttcattcctgttttccccttgtcacttgatttactttttttcactttttttggttcactgctgctatttgtgggtggtttcccactctgccaggggcagttgatgtccaatatgtaccaagtctaggtggagacaagagaggacacaagtggctgcatggcctgatagcaagctgttctcaggaagccagagctgcgatgtcagagcatgggggaaggccgacaggcacaaggggtaacctgatgcacccctgggagccccaaaggtggtggggaaggccaacttcgtggggcacatccatgcatcagacccatcagtagtggggaaagcaggtagagtgttttgtcctactgcagaagcagcaggtgctagagtctgggtgtcctcctaccccacctaacctgggctctgactcttgatctagtaaggagaaagtccattctgccaagttgccctggtctttgctcacttggtcattttctttttcttttccttttttttttttttttttttttgagatggagtctcgctctgtcacccagactggagtgcagtggtgcgatcttggctcactgcaagctccgcctcccgggttcatgccattgtcctgcctcagcctcatgggtagctgggactacaggcgcctgccaccacgcctggctaattttttgtatggtcgttttcttcatgtcaaataatggccaaatgctttggccttgctagacctctgttagctctagctccaaaaataaagtagcctgaaaatccaccaggacttgaatcagtgcctttcttatttctcaccagttgcctcccctgaactaaaccaggaacagggaagcagtgaaacaggatggactttgttattttctaatctgcatttctgccctaggtctattacttcttattcatgtcacatttaaaatgacttaatcttgaaaatcagttttctcatctgtgaaggggacagaatcatacaaatagttcatgattgttgagataaatgaatgaaataataaatgggtagtatctggtaaacacttcataaagatgaattttgcttctcacatttactggcaagattcatcttcagaaagtggaaacgaagtcacgtggctgactttgaatgtttaactgtctggtgcccttctttctctcaggatctcagactggtggaatcctgccctgcggaaacgcatgctgagtgacagtgggctggggatgatagctccctattatgaggactcagatctgaaagatctcagccactcccgcgtgctacagtaagagttctcttgctgttcttttcctctgtgccactgtgattgctgggagaggatgtactgtgggctgtgccccagtggtcaggattctcttttcaatggcgctcaggctgtctcatgcaggtgctactctgtgttttcattccatgcaccttgctcatatttatctaccccaaaccgttcatggaactccaccttccatttcttttgctcctgagccaccttgagccccttgcacgtggacctccacatactttaaacctcaccagtgtcttctttactggagtttagtgtttatcacacgtccctgtttgccacatcataaagacatgcatgagagtgatcatgagtagcttgaaagtgacacgtggtttttcatttgtgaacacattatcttgctgtttcagtggtcctcagtcctgagcctgtgcatgtgtgctgtacccaatattgccacgtgggtttgttggctaaagctgggtgctgcccatgttgtggttgcagtctctgtgggtaagcagtacagcatttgtttgtagatcagaacagtatgtgtgctttcttctgaggtctgatcatggtgagagtgtaggatgcatgctgaagtttcacagcagtgtcgatacctttgtgctcggtgaatccacctccctatcatctcctctggtgacagatacactcatgcgcacctactctttaatttcaggccaatcaatccatctcagaggttatgcaaatccagtgtgttcatgaaattaggctggtttccagtttacctggggtcttaatcaaataatgacaatggccttgtaaccacacagtcttagtcttttgacagaataacaagataactgaagattcttcgaatcctagggttaactaaagaggcaaaggaagtgctttgtttctggagaaagaccagaagcaatttcagtattacaaaggggaaaaaaatgagaaatttggagctaattatttcattggcaaagtttcgaggcacacaccctcagggcagaagacttcattttaattgcttctctgtattacctcttattttcttgtgtgaagacgggaaaggaacaacaatgaattactatggatttttctttttaattaaactgtgttgttagtttctgatggcattttgattgcttataattcaggatgttttccatttcctttttatacagaattgaggcttgtgaatcagggtgagtcagccacccacgaatggctaaaaaagtggccatttatctgttggcagacttattggaaaattagtgttttaattagctacagaaatagaaattaagcctggacaaaccagtatttgtttactgagtaaaaactcagtaaaccaatgagtattttagttgtatatatatatataatctgtttccacaaagcagaatatgagctcaatctagttttctaggtcctgatttttctatatataacatactgatgtacgtatcataataaataaaataattgtatataagatagtaaatattcttcccaagaatgacaaataaatttaccactttatataatagccaggttcttaaaaccagatgtcaaaatgaactctttctgtctgtttgcgttaaactatctttttagggatgtctcttaatttttggttgatcttcaatttacagctataagtttttgcagtcatttatactactttagttctaaaatgccctagagtagtagacactttttaaaaaaacctgaaaaattactttgaaaacaagcaaagtggcattcaaacattcatccccagcctttcagcttctccagctggatctccagacattgtggaacaaaggcaagtcatctctactaggctcagtctgaattcctgtctcatagaagacacagcataataaaattgttgtgttaaatcacttaaaaataaaactaaactaaaccagatgccttacctcaactttttaattaattctttaacttttaaaattattatgtccatttatttcttagaatatctttttatttccttcagacatcatctctgatacaaataggtataattgcagttgtggaaatatctaataatgttaataataactactattgatggactacttcccacttgctttgtatcataattaaatgatcttcattcaacaatttttaaatttagctgttgcttaacagataagtaaactgaggctcctagagggtaaaatatttatcttaggtcacttcaaatggcaagtgtagtttgacctgaggtcggtttggcttctgactccatgctttttccattgtcctacactatcttcccaaagggaccatacaaagtcagcgtaccagagccacagaagtttactttggtttctatttcttttttacatttgtacagtgaaaagtcctacaatataggggtactatgcatgcacattaaatatacaactgcaaacttacccagaagtaaatatggctgagaattaatttttaagcatttttttctttaaaagaagagattgaaacaaaatataatggtggtaaacttcagtttaaaattgctaaatatatataaactatgttctaatcaaaataagcgtaaaaattatatagaaggccatcatgtaccaaccaccttgatttattatgtcattgtttttctatatttgcattatatctttctttcaagccataaacaacacagagtagtgtaaaaaatattgttttatggttttgttttgtattgtacaagttggagtatctctaattggaaaatctgtaatctgaaatgctccaaaatccaaaacttttaaagtgctgacctgatgctcaaaggaagtgcttattggaacattttggatttcagatatttggatttgggatgctcaactggtaagtataatgcaaatattccaaaatcctaagaaaataaaaaatctgaggcacttctggtcccaagcattttggataagggatactcaacttgtatttttgtttttgcctgtgttatataatgcatatattttggaacttgccatttcactcagcattgtgtttttgaaattcattcatattgatatatgtgggtttttaataatttttgatatagaatattgcatcatacatatgctataaattgtttctctatttcgatagtgatttctaatattctattattttttaaaatgcagcaaacatcctgtgcccttctgtgttgcagaatatatatgcagtttcagcttactcgataatgcaaaatttaccttcccagttagagtactgatgaatcagtaactgaaaaggccctgaacacttattgtaataatctaggtatgatcagcatctgttgctttacactttaaagccccagtcaacttgggggataggaaaggttcaatttagcatcctgttgacagtgctaaataactcactatataaacagaaatcaaaagagaaactttcaattcttagaactgaaaatactacttatcagagttttcgagacactgctaacgtagtattcatagtacgttaggactgcagattcatttatcaagggaaaaatgattgtgtgcaaataagcaaagcattcaatttgataaattggaaaaagaatcccagtgtaaagaaatgagaggggagaaaaatgataaagataatgagagaaatcaatgacaaggagaataaaacagacagatgatgaacagaaaataaaatttttggccgggctcagtggctcacgcctgtaatcctagcactttgggaggctgaggcgggtggatcacgaggtcaggagatcaagaccatcctggctaacatggtgaaaccccgtctctactaaaaatacaaaaaattagccgggcgtggtggcgggcgcccgtagtcccagctactcgggaggctgaggcaggagaatggcgtgaacccgggaggcggagcttgcagtgagccaagaccgtgccactgcactccagcctgggcaacagcgagactccatctcaaaaaaaaaaaaaaaaaaaaaatttaaaaaattcgttgaaaagataaataaaacaaaattctgagaagtctgatttaaaagaaaaaagtactgaaaacagaaagaaatatacctgcaaggctttccccatatcattcttcctccaaggcacccagggcatttttgtgccaagcggccctttctcctccaaattgcaactgacccggctctgttggatcttctcagcattttcccatggttttaaaatttaaaatagtcccttagatccatcaacctccctttttctcaggcagagtgagaggcaattagtataaaaaggatgaattagatttctatcattactggaattggttgcatttattttaaatgtttccatttagaagcattataattttaaagaaagatatacacatacctacttatatgcagatcctataggaaagactgtaattccaaagtaggatacgcaatgtgtatagtgtctgcaaaacctgtgaacataataacaaatatttaagaaccaattttgaaatgaattggtgagaagtggttgactgacattattactgctgggaccataatgattttttctttaagttaaaaaaattttttttcagtgtccaaggaagttctatttaaaatgacatgattctggaaatgtatttgctcttatcattaattgtaccaccacgattagtgacaagactatatttcatttggcagaagattaatagagagggaatttacttaaattttagcagaccaaatctatttgagttgtaaggaagaattttgccacttgaggatctatgagaaaagaaaataggcatggaatgaaaactctgatatattcttcttaagttttctttgagaaaaggactgactcacctctgagtcaggtgggttaagagcaggcaggtaaagggtctaggagacactgcttttgtttctgaatcagagtaacctttttccggttcttagattttgtagttcgtaagaaacccccaaatgactgaaagagttgtactttttctcaatgtccccaagtcctagtcctgaaagaactaaaatggactgtcacacaaataatatcttgccactagactaagacacaggggaaacagtgtagtgaaccacaccgagggtagatattcaatccagataattgtgtctaggcaggtatctggtacccgatcagctgcacaaggctaatgggtttttatgattggcagaggatttctgtcttcaaggaaagataatgctatcaaatgtttaactataatgtgtgaggtctgatttgtgatttcattgtgattaccctaagaaatagggtaaacaattcagtcaatcgtgtattgaacaaatcagtattgggcaccttcagtgactgaagtcaggcactgaagatatacaactaaagaagaaataattattgcccttgaagagcttatatttaaaggggaaatattaaaccaattattaaagttccttctaataagtgctattatggatatatgcatagagtgttctggaaacaagaggaaatataatttgctgcttttttttttagatttaacttttttgaccctagaaatgatgaatatttaaagaattaacgaaaatgtcagcctcaaagaaaaaaaataggcttattaagtgttctatgtgtattttcttcattttttacatgtgaacagataagtatttgtccttcctcattgtgtaaaccagaaatatctctcaaataatggaaaacattcaatggtagttcaacctctccatatgctatgtgtgctcaaggaaatttggacaaccgagaaattatttggagataccaagatacctaataatactttaaactgaaaaactggcctttttagtatagtctgcaattgcaattctgaatcactatatcgagaagataaagcccggagacctcctgtgttctgaaaactcagatgttctaagctgattatgggagaaacaacatcattcccctctggtcctcaactattttctttattcagtttcttctgggaacattaggttatggcctgaacctaataaaaagggtaattgtgcttattgtgaaagtttcaggttctcaacaggaagacagactgttggacagcgattttgattttggaaatattctttcagcttcacaatcagataagcgggagaaaattaatcttcttagtgggatgcaggttttgctgaaatatatcttagagatgaaatcagtgctgtcaggataaagatggctcctggcatctgtttcactgagatagttgggtcccgtttctacctacctttgacatccctgcttacctttgactgggctcaatcttgctcaccccggatactcattccagctggaaaaatacaggatagctgacatatgtcttccttcttctttttcttcttgacttaccttgagtttgaaatgacttggtgaattactctatttggcaagcacataataacactctattcctatgggtgtgtgaaatatttaataagagatttgcctttgttatttttagaattgttcctcaatcagttatgcatatggaggccctaaaccactcggaggaaatggatttaaatttacctttccaagttcagttagtggaagagttagaacagagttccctgtgtaccagatcttattttgactgacattgaaagaaaaacaaacaaacttactttaatgttaaacatccattttatttgaaataatcccaggaaattctcgcccttcattgccatgagttccaagttttgccaatgattagagtatgaggaaatattagtgttaagtggctctctttttacatttgtaaaagctggcagccatatttattcacacttcaggaatactgtgaatgtgaggcagtattgattggatccctctttaaagcatgtgagttccttggatgaccaaactgtgcatttctccctctgtctccatagcactttgcaccatacctaaaatggtaggcatccaacaaggcaggcttttgggatgaatagaaggatgttccattcatagaacatcccttgatagaaaaggtgctttgtcaaaccaaaataaatacgtgtctatttatattgctatactaaacccagtacttatcaaattataacaaaataatagtgataacaaaataatatgtaaaatgttgaccatttttgttaggctgtgggttccatttatatatttcaaatttgaatataagtatgctggatccagggaattcacagatcaaaataataaagacacacctgaatgcctgacttggagaaatgttggtatttcacaagcgagaaagtaaaaggtaagtatggtcggtataggaagttgtaggcactgttggtgagcacagtggtaggtagagtggcaaggaagaattgtttcccaggcattcacctccaaaataaactgttggtccccggctgcattctccaacttccaccaacactcttgttttctcagtgtgtctgtcttaggtgaataatttgattaaacagatctaaagtgtgaaagagtgatcattttgaaatattttcaaaaaaattcgcttgcaaatctcaagttgctgggatgtggagcagtaatcacttaccatgttcagtgtggagttgaggaatgtgagagggatgtcatattatcactggaaatggtggtggctggggagtcatatcgggcatgggacttctctgcggtacttctggggccctctgaaccccctactctaagaagatcagaacaagagatatctccacaccatgctagcactacttatttggaattcagggagatggagaccacattccccgccccccccccttttttttttaacttttctggatgattgtgccaggcatcacacataagaacaacaatcctccaacagttttctccaatactctgtgagatgctggtcttactccatgactcccttacaagctccttaaaggtgggaatggaatgttttaagttaagtacctcccacagctcttggaatagagttaagtacatagcagttcttaatatctaacactggagtcactgaattattctcacagtctgtcgagcccattttaatttcttgttttcaatattactatgatttatctgcattcattatattttttttcacagagctcctcgaactgatctataactgagaaactctcttgtccttagacacattagagtcaggaggaagcagacaatgtttagattctgttcccaccctctcctgagaagggtggggtgggaggagatgttgtcagaaagctgctggggtatgttacagttatcttcagaggtgccaaaccagcttccaaccccgcctagttttgtctcccattttctaaaactgggatcagaagtccttatttggatttcctaaaaataagtagctgtggctgagcccttactcaattaccacagggagatattgcatatccgggatcacgagataagtgaggtgccttgcttataagccccacgtgctaagactaaacgtggctctcatgtgacttgccttcacaatccagagctccctcatgtttcaacttatgcttaaaaagaaaaaaaagaagtccacatttacaaaatccagatggattatgtctcaacagaagctgttggccggggttcccagagtcactaggataaagctggcagcttggcttttcctaaagggtccttcctcctggctctccgggtatgtctccgttgtctggattttagaataatgtgccttttctatttcttcacccttttttttagaaagtgggctggcaactatattgcagagactgatttctaaaggcaagccacccatcctttattgcttcacaactgtgctgggtttaattatttcttttttcattttgtctacagaatgctaaaatgtgatggctacatcgtcaggataaataagcttgtgaagtattattttctccaacttcatctctttattttatctatttcttttctgtgtccactgtcgcccattcttcctcaatctctcacatttcaaactgctttgccctcattttgttgcagttcttaaaagttaacagtaggtggcagtaaaattttatactcgaaagacattcaggcgactcagcaaactgaggagggtatacagaaagtatggaattgtaaatgctaaaggtaaaacagcgtttttttaaaattagtttttagactttttaattgactaattgcatatatttattgtgtacaacatgattttttgaagtacgtatacattgttgaatggctaaacctggctgatcaatgaatgcattacatcacacagttatttttgtggtgaggacacttaatatgcactctctgtgcattttttaagaatatattatatcatcattaaccaaagtcaccatgttgtacaatggatctcttgaacttagtctgctgaactgtaattatacgtcctttgaccaatatctccccaacctcaacagtgctattttctaaaagccaaatatatctaaatataggaatctatttaaaaaaaaaaaaaacaagatatttcaagcccagctcacatgggggtcatcaaggcatatatttgggtaggtgagtcttaaagactgggaaattatgataataaagggaattggtagaaatttgtatcaaatgaggaactcaccaagcagcctttattatttacatgctggaaatgatttccttccctccacacaaatgctcatctctgtcttcttcctttcattttgctctttctgcaccccttccctctgttggtcatgaatgttacctttgaggctgcttggcattccctgaatgggtttgtgaccacttgaatagagaatgtgtttgtctttctctcatttcaatgccactctgtgtgtttgctgtaactttcatctctcactctcattctcgcctgctctcttttactgtatgtgctttgttcactgttttaagagaaatattcacaattagaaggaccaaaagcaaacaaagagaggattatgtagtcgatggagatttgcagtgctgtgggatttctggtcctattttacctaattagagatgctttggggctagagtgataatggtgaagatgtcacacagatccatggtctcattctttctcccttgggtcctccaaatgatgtcataggcctggcaaactagttctccaggataggcaatgcacccttgagagatgctcaagggaagaaagctattgcacagagatgataatctgcagccatgctttcacagcacagtaaatcatacctttgctcacttgatttgaatgaagattcttgtctaccaacagttttaggaaatagatggaatttgtgtagcatcaccacttcacggtaaaacagaagaaaaagatgaggtttctgcagttgtgatgcagaccgttgaaatgtgcctggagagaatgcccaactgggaaatcggttttcattcgggactacgtaggagtgtaacagaggacaagcatcatggctcaagaagcagggaggaaagtggaacctggggaatgctgaccaggcatgaacattcttacatgttcaccataggaaaaaggtgtgagcacatgatgggaggctgttctatccaggaaagactggattccacccaactgtgacaaaggtaaatgagaaagtccaggaaactctcagggctgtggtcaggagaggggaaaagaaatacaagtaaatgactgaaacgacagagaaagaacattcagagctgacattaagagcttctctttcccttcctaagtaggatggatcatcacctgatgtttatagaaagtggtctttttgctgtggttctcatccccaaagctagacagtaaagaggaaagacaggcatgaaagggaaattgaataaaatacgcatatagtgagttgttttcagtgtgtggacatacgtgtgctgctttgttccccaacaagaacttcacaataaggagtggtgtacttatttgtagtgtgctgtgtagggtgtagaaggagcacggtgtctagcttgcccagcattcccgctttgtttccttttcttattgcaggatggtagccagaaaatgaaggggccttggctatttcagtcaggcccgtgaattggatgagtgtctcccacctcttctactccatccatagtctgtggtcctggggaatcccactgctgagtgttttcagaatatgaatctatgctcttgtgcctatttaaactctgctgtcacacctgtcctgcatgtttatcttaagcccatctctatgtggtggccccatcccttggccaactccccaccaggtgatggtttagcagtgctgagtagaaggtatatgtgttggggacacggaatagagatagacattcatttgtagatgtttctttacagaaagtaagagtcccatatagaggcatccccaatatttatctaatctatcctctgttctttaggaaagactaatggataatctattgacatcctatctccaaagaaggaaatgatgtagccattctgaggaagggccaagtaggaaggccatgggtgcttttaaattaaagccatgagatgatgaaaaaaaataaataaagcaaaatatgcatagagtctaaaaaaataaaaagaaagaaaactggacagtgttattgaaatgaaaaggatattgtattaggatcagcttgtaagttttgatcatttcatggagcttaccaagaaaatgcacatatctaaaacctattgtaaagtatattataccagatataaagactgaaatagtcgtgacacccattatttcatttccaggtttattgactaaaaacgataaaacatcataagaggtgcaatactttataaagtcctttgccttcccaaatataatactcatttgcttttatgtattgctcttttgctggtagaaaactgggcacatttttcagtgcccttaagccttgtaatcgatctactagaaagataaaaggctttgaaggaaaatttgtggattgaaggcaatctaaaaaaagtatctttgagtttcttagagatgcttgagtttagatagagtgctgtctgtaatgcagcagccactagccaatatgtgctgaatgtcttgttccctgatttgtgatatctctatatattaatctaataaaatgattcattccaagatattatagctgtgtttagttgggtaatttcatatattcagactgccatgacaacactccgttccagaggaacaaacttacttcttgggaacctggagacttgtctgaagctgactgcctcaaacacagatatctgttttgtcctgttttattttttgtttgtttgtttgttttcgaagtttgtgactttaaaaattcaagggacttttgcttttggatacataatatgactgtgctggtttcagtatgaaaatattttaatttttaccagttaaattacataatattctatctaaaatagcattttgttttccaagagcttccctttttttccaagtttctctgtgtatgctagtttgaaaagttgtctttattttagagacaatatggatattctcataagcagggttaatattgggaagggtactttcaccagcaaatattcagatcaagattcatggaagagtaaatccaaagtaaaatatatatatatgtgtatatataaagatatgtatataattaaaaatatgtaactatatattattttaattttttattttttcgagacagagtttcgctcttgttgtccaggcaggagtgcaacggtgcaatcttggctcactgcaacctctgcctcctgggttcaactgattctcctgccttagcctcccaagtagctgggattataggcgcgtgccaccacgcttggctaatttttgtatttttttaagtagagacagggtttcaccatgttggccaggctggtgtcaaactcctgatctcaggtgatctgcccgccttggcctcccaaagtgctgggattacaggggtgagccaccatgcccagctattattctagttctttaaaaataattttaaaattgacataaaattattatgtgttgtatacaacatgatgtgaaatatatataaccattaattatgtagctaattaacgtatgcattaccatgcatagttataaattttattgtgagagcacttagcatctactctcttagcattttttaagaatgcagtgtatcatccttaactatagtcagcatgctataccataaatctcctgaactattcttcctatctaactgtaactttgtctactttgaagagcatgtctcccatctccctcaccccgaaatgccccagcctctggtaacctccattctactctctacttctgtgaaatcaacattttagattccacatgagtgagacatgcagtatttgtctttctctacctggcttatttagcttaacataatatccttcaggttcattgatgttgttgcaaatgacaggatttccttttttttatggctgactagtatttcattgtgtatatataccacattttctttatccatttgtacgttgatggacacttaggttgattccatatcttggctattggtaattgtgctgtaataaatgtgggaatgcagctatcttttcagcatgctggtttcacattcttttaatacttacttttaatatttaccttatgattgctgaatcatatggtagttctatttttgttttgttttttgaggaaacttcatattatgtaggttgtttctttgctctggtgattgtttcctttgctgtgtagaagcttttgaatttgaggtaatcgcatttctctattttcgcttttgttgcctgtacttttgaggtcatgtccaaaataatcattgcccagaccgatgtcgtggagcttttctgttttcttctagcagtttcatgtttggggacttacatttaagtctttaatccactttgagttgatttttgcacatggtgtgcagtaagagtctaattatattcttctgcatttagatatatgcttttcccaacactatttattgaaaagactgtcctttccttattatgtattcttggagcttttgctgaaaatcagttggctataaacatgtagatttattttccggctctctatcctgttccattgttctatttgtctgtttttatgccagtgtcatgctgatttggttactgtagctttgtcaaatattttgaggttaggtagtgtgatggctccagctttgttcttttgctctagattgctttggctattcagggtcttctgtggtttcatacacgttttaggattgtttctactaatctgtgaagaatgtctttggtatttttataggaattacgtagaatctctaggttgcttaaaatacgaacattttagcaatattaattattttaattcatgagaaagagatgtctttccatttatttgtatctttttcaatttctttcatcaatgtttcatatcttaatagatttttaattattatttatcttctcttaatcttttttcctagtgcggtggtaccacagtggaaaaagccacaagtttctttaataacaactagttcaaagactctgggcagacttttgctctttttgcctccctgtaactatttcttgatcatttttcttctttaagtttacatttcacaaatgctgtatttacccctacctcccttccttccctccctcccttcctccctcccttcctccttcccttcctccctcccttccttccctccctcctccttcccttcctccctcccttccttccctccctcctccttcccttcctccctcccttccttccctccctcctccttcccttcctccctcccttccttccctccctcctccttctctccctcccttcttcccttccccttccctccctccctcactccttccctccctccctctctccttccctccttccttccctccatttctaaattacacgaagatttattaatcatttttatctgctttatgccatcatctttttagtgtgttctttgcctgtgttttgtgttctcctctggtatttttgcatagatgtcatgctggttcttttctgttattacttgtaatatttgcattgggtgagttttttttttttttttttgagcttctagtttgggatggatggtcggtcttagtgatttggtgtgctgctcttaagtttgactttgtctctgttatcttcaaacttttgcttatcagcatcctcttctaggtttgggtctacttctggctagcagaacaccctggctcaaagtggaaggctttctgccatagattttgttgtgtatgaaatagtttatatctctttagctgactaaaatcaaaattatctgtttccctaaaacttagctctatttttactgtacttggtagctcttcttcatgtatgatggtttgggcttataaatacctagtttaatcaaagagggtatttcctttaccatttctcatcctccctgtcattttccatgggtttcaaaaaaattgaagggcagaggaattttttttctgtgttactaacatggaagtttttcagtcatagtctttaacttgacctctgccttttaatttgtcttcttgttattttatggttcactctccactgcctgctcattgcagaatgtgtgacttctctgcctcacaagcttgctccatttagcttagaaggtaaattgcaagtacttcaccggggccccacacgccatgtatgaaatggcccttgccacttatttctcaagtccttgcttttgttactcctttacattctagcaatactgagttacttgtatatctggtaggattctatgcaatttcatatctgtactccttttcacacgcctattgctattctgcctggagttcttctccttcctaacttacctaataagctcctctttattcttcgaagccaagttcagatgattcttgtttttctaagccttctttcacacttttcatactgaatcaatctccctgttctctgtgctacctctttgcctcatatatattttgatcattatatattttttacattataatcatttatttacatatttttctttttcactagattatgagttccctgaaattgttctttgtgtttccttcccttggcacatggcctggtaataatagggtctcaagtaataaattgaatcaacataaatggagagagtcaaacctgaataataatgatttaggcttagtaggagaaatatttttaaatgcatggcttgaatttttgttttgtattattttgctgcatttaagcaaaataaaatgtaaaaagtaccaaaataaataaaaacaaagcacaaacaaatatgaatattctgtagctaaaggactcatgatcaggaaagaagtgaagaggacagctataagaatgctagtaatagtttacactataagggcagatgcttgctccaagataaagtatacatggaggaaaaataaacagtctgggatacaaccacatgtctttcaggtgtggtgaaaagaataaccagagggctttcctgcatgcctcagttgtcaggtttaagataattatctctttctgggattgaacctctgttgttaaaataactacttatattgctgatttcagaatatttcttctctcctgagctaacttctttcccctccctctctctctttctttctttcttttttgagacagagttttactcttgtcacccaggctggagtgcagtggcgcggtctcggctcactgcaacctctgcctcccaggttcaagtgattctcctgactcagtcccctgagtagctgggattacaggcacccaccaccatgcccagctactttttgtattttcagtagagacggggtttcaccatgttggccaggctggtttcaaaatcctgacctcaggtgatccacacatgagctaactttttatgccgatttccagcaataatggatgatgtgcatgtctcagtagtgcagtgcagtaacttgttgcagtgaaaggtgaaatactgagtgaggatggaaatactccatatgtcttaaaattccacaaagccaggcatatgggagacattcaacatggaaactcaacatgactaattttcacaaaacactctgaaattgatattttatccactgcctggacatactgcagaatgcgtccccttgggactctaacggagccatctggaatttttcagatttaatatcagggctttgcttttgcacaaagccagcaaagaccttgcttcacaagctctccacttgagacatttagttgtcctttggcatgaattttactttgttcctgtagctctgtgacaaattaattgcaaacaatccaagacacgttttcacttacttctcatcagcaaacaccaggaggaaagatatttccttgtggctgattctagtatgacctaagcacctgaagaaattagctcatcttacttaaaatataggttctcttttagattcagcttctaatttcatttcacctctcattcaatactcccctccccaactttatttttaataataatggaggcagaatatgggtgcctgtgtttctgggtgcttttgatgtcctttggctctgagagtgtccacattataaccaattggagcttcaggcactttcaagtctctaggacttttccttgcagctggcctaggagcaggcaagcttgtcttaaggatggttttacagtaacatgatgactttttgggaagctccagaatgtgtcagtctgaatatcagtgtgatggaactgagattaattcaattcaacacattttaattaagggctcatctgttctaaataagatacagccttagttttcaagggggttacaacccagtgagaaaggctggtatgtggatgataaaaaataagggaatccagtgggaggataaatcaaccctacccagggaggccaaatggtgcttctcaggcagtgttgactagggattgtggcaggtttccgctcaccacccccatgtccatctcccagaagccaattttctttccaccaaatcttgggactctgtagttttcatgaaaaagtctactttaagagatttgcacagttgaaataaattgatactttgccactcattgaggttcaaggccttttctcctttaccactgtgtctttattctttactgttcactcacataataaacagtaatcttactaaccagtagataaagtcatatcaagcatcccaaagtagctaaaaattattttcaaccatttttgtattgactgaatgattcttgtcctgaggtttatcttcatgtctcataaatattagttatagtaattggcagctctattgccaaactcctgagtttatctttggccatttccctgctatggatttgagtgagccaatcattcagagaagaggactccttcaaaataggggaagtatgtgatgtcttgtctttcccttcgaaatttcaacaactctgaatataatgttatatgtctctctctttctcctcagaaaagaataagtgtgagtcaaagccgtagtcttcaagctggaggtgaattcatctccaaacttaggtctatactactcaaagtatttcaactagtagtcaactggggggaagcaagccttttagggttgatatgatttttcatttgagatctgattatcataattaaagcagaactcacatatagtttgcaaaagttgttgataaagttctgaggaacctcagtgattgccttctggcctcatgctgtttctcccgggttctgagacataatgcagcgaatagagggtcagctcactcaaacattaaattccatgaagagtgaaaacaaaaactggtaatgataagggtgcatgctatttcttttacctctgtctcaatttatactgttcaagtagatctctttgtatctacagacacccaatctaatgctttttttatatccctggctggagccatgtccttgggcaatacacatcacaggatttcatctatactacatttctatgagttctctttttttgtgtggtaaatctagacttagctaagtttgttgcagtcctaggacaccatgcatagactgatattttagtaacctgtaacatccaaccaatccaggtaagagttgggaattgttgattgaaatataccatgcaatcaacacattaattacactgtctactatattgactttccatttaattcaatttgagggtaaaattactatgaaattattcttgattatcattataattatcatataaaatattgatcatgcttattatttccttttaggtcaccagtctcttcagaagatcatggtaagaatcatctgtcttatttataccaattcaggattgaaacttgacccctggtctttgcagttcattgtcagagcaaataattgtttaagcaaatgtctctaagatattggctttgtggtttttgaatgtgaaatgtcaaacacttttaaaaacttaaatcaccctagctgaatttgatatctttcaaatctgttccaacccgtctggttgacgaatattgtgaagccttaatttattctgcctgatttcagtcccatcagcagaaactttttgtggttttgtggttttggactagtcctgtgctttttatgactcagatttttatccttaaaatgataaaaatttttgtggtagtttgtggtagatattccctacagtcccttccagaatggacattgggatcatgttccaatcactcatttgtgaagagcactctaaatctgaaaggaaggcaagcagtcagtggtatttgttgttacccagttgagatgaattgtttgcattttaagagacagctaattcactcaaaagagaaaatatctcattttgttccatctcacctttggagttgttcatttatccaatcagtcacaaaagtgttaagtgtctacaatgatcagttatgctatgtagttatgttttacaaatatgctatatggaactttggtttggggcccctttgtatcttacttggactttggaaattctctcataattggtatccatacctctatatttcttttccctagtacactgtataccgggctagcaccaaaatgatcgttccatagtaaaaatctgctccgatggcctctagaatgaaatctttccagccgaccaataattgtgttcagcttttcaatattgtattttagcatggactagtaagcactaaatgatggaatctttgtcttcctccactgcttattgcttcatttaccatcttttcccttctcctacccatgatctgttttccagccatgtgacaatacatctaattctacatcaaatttctggagctcaccatcttttctgccatctccctgcttttctccatactgttctctctgacaggatgctacttcttttgccatatagatggtttctatgcacctcacctcatcctctgtaagggcttgctgatctgcttatcgttgtgcctaatatttttctacattctagggcttaatgcgcaaatttcatgctttatttacctgttttccctattagactatgagttctttgatatagtttccaacgaagagcaaacaaggaaaaagtgtttattaaatgaatgaattaagaaaagggagaaggagttttaggctggcctcttctactgccacattgtgaaatctgacttagtactggaatgaagttgtgttattctctatgaagaatcatagggaaaattatgttcaggcccattaagtcaggatcaggcaattgaccacctaatggtaacctgctattatgtgctattttgctgattgctgttggtattactaggtgtttgcccatttatataggcccttgggcttccatgttcacattataaactagaagcttgtgtttggtttttattttgaactaggattccctttaatgacttttggttgtctttgccttcctgtctatgagaatttattcctcattcagacaaaaatggtgggtgagggaaacttgtgaattataatttgataatccactaggacttcttaagtggttatgaaataatagggggcatatgtcagggtcctttgaagtcctaaagggtgactactgacagaaagacttgcttggaagattaagagcacttcagaattgattattttaagaaccttatatgtgattagttgaagaaacattattgaaattagagggccattataatttcatggcttcaaaaaatttcttacatgttcatacctcttagtttgtttctgtgacttccaaaaatagttcaagtacataatgcaaaattatagtgatgatttacctaatcctatgtaattgttcatcattttctagcccatatattcttgaaaaaaagcttttttctttattaccagaattttctatccaccactcaaaatatatttccttctttttatacatttttaagagctcatgtgtactatggctagtataaaacctcttgaatgttatagcatcaatcttacatattatttgtacacaataatggcattgcaacacacttgtaggagaggtgagaagtagcaatttgtctttctcaaatttattggtagaaaatttaaggcatgttggacacatggattgtgaaattggaatataaaaccttacgtctcttgattttctattttgtttgctttcctcaaatagtcctccctctgtaataactagtcactttggctctaagacaagaacttattcttggaaaaatctaattttgcaacgtccaataaccctggtatttttcattcccatggtactcttgcatagagagcttaaatacagtggctttgtcctttaccttatcttgtttgttttcttttccttgtctgtaaaatggagctaatcataaactgcgtacctcatgggattgtagcaagttcaattgagaaatcatttgtgaaatcactttctgatttttttttttttttttttttttgagacggagtctcactctgtcgcccaggctggagtgcagtggcacgatctcggctcactgcaagctctgcttcccgggttcacaccattctcctgcctcagcctcccaagtagctgggactacaggcggccgccaccatgcccggctaattttttgtattttttagtagagacggggtttcaccgtgttagccaggatggtctcgatctcctgacctctcgattcgcccacctcggcctcccaaagtactgggattacaggcatgagccaccgtgcccggcccactttctgatttgttaaaagcaccccaaacatagtattattcgctagcatccaggcagtagaagaggaagcacaagtttatctgtgatgtttgctcgggattatgttccgcccttgaaaagtttaaagaggacgggagagaataaccgtttttttcattatcattaaattttctctggaaaccttttattacatcagggtgaggaggagtaaaatgtttaatacaccatttagcttatagtgccagagtaaaggctcagttgatgattagatgtgtggtcatatagaattggcaacacaaggtctaaatgacacataaactgtttctatatttatataatagcgcatcagggtcactaagaataaaggctaaattgtattgagtgcttattatgcagaagcactgtgctcgcatgctccaactgccttatgtcctttcatctttcacaaataacactctgtagtcaatgtatcacccccagtttcacagctgcaaaagcaggctcagagtgcttaaataacttgcttaaggtcacatagctagtaggtgagagagttaattttcagacccaattctaacaatcaaactcttaactctcttttatcggccatgtccctggaaaaccaaagacatgattgaatggatagaactatggagataattcttccctcctctaacaagagtatatttactactgtgtaagttaatttctttttaatgacaaaacagagcagaacaaaaataacaacttctccctcctgctggtaatgatttgtccctgtagaaaaaggaaataccaatgtcacattttctcataattagttaactgagtgaaactgaagtttcagggaaacctgccatgctaaaccccagtggaaacattaagttttaatgttacatctggaaactggagccctactccttgttagaagataagcttggcagtgattgattgcactgtcctctgcatttcctctgtattgaatgcctatcacttcgtcatttaaattgctcctggagccatctcctgggcccaggctgcttccctggctctgagaactcatcttcctttctgtcaccttagcctgcttattttacaggctccttggaatgctgcgcttaccgctgcttcacttactgctgctacctgtgccagcacactcagggcaggtcatcttccaactaatgtctgttcatttacaaaataaaaggcattagtggcttctcaaagaaagtgccagcaatctgctgcatgccccactggaacatctgaggcaggcatccctctcctgtcctacctcttagacctgttgtcaactatggccgtcacattctagggcagcttttttgttgcagcagtaacatagtggacatgaattgcagtaatggctatttggaaataaaattgtcacaaccacaatcactagtgtaaagtgttcaataatgaatccactgtcaggcttggagacggctgtacttggcagtaggttactgatatggtttggctgtgtccccacctaaatctcaccttgaattgtaataatccccatgtgtcaaggatggggccaggtagagataattgaatcatggagcagtttcccccatactgttttcgtgatagtgaataagtctcatgagatctgatggttttgtaaatgggagttcccctgcacaagctctctcttgcctgccaccatgtaagacatccctttgttcttccttcgtcttccgccatgattgtgaggcctccccagccatatggaactgtgagtccattaaacctctttcctttataaattatgcagtcttgagtatgtctttattagcaacatgagaatggattaatacagttatgcagtgaaacacactgtggcgtggcccaaactctttgaggcatcaatggctgtacctcatcaattcacttttctttcatgtatattactgaaatagatactattcataaaatatataaaatgttatctgctcagtttaaataataagcaaaacgaactactgtgtacttggccctcagactaagaagtaaaacatttgtaggaatttgggagcttcatgtcatttgcttccctaattatgtccccttccctctccttcagaaataactactattctgcctttttgttaatcatgtccttgtttcttcttgttttactacatatatgcatatcttacatatgaatggatacgtggatatataactcatatatgtattcctatatgtgtgtatatgtgtgtgtgtacatagttttatgtattttgaatttgtacaaattgaatcatgttgttatttgtttcttttgttcaaaagaataatttttgtgattcatccttatggatgagtgccatatgcatttcatcaatagttcatgttgtatactactctattgtatgagtatataccaatttatatatccaatctgctaatgaatatttacataaataacaggtttcttgggggtttgtttttgttttgctcttgcaaacaatattactatgaacattctcttttttgtaactcttcctcgtatccatgcgcttaaacctgggaatagcttaagttaggtggtagattatacacatatttaacttatagcattataacatgttgttttccagagtgatcattttaatatacactcccaacttcagtggataagagttcccattgatctacatcctcaccaacacttgatattaactaatttaaaaatgtttgctagtcttgtgaaagtatgaaatggcatctcaatgtgattttaatttgtagtcaatgattacacatgagatcaaacatcttttcatatacttatgggccatttgtgtttactcttctatgaaaggtctttttatttcttttactcacttttccccacctggttggttgtgttcttcttaatgatttatgaactttttaatgtattctatgtaaaaattattttgtttcctatgtgtgttgcaaattttctccagtttgtggcttatctgttcgagctctttttgatgtcatctgatgaatagatggatattctttattttactgcagtaaaatcattaatgttttctctatggtttatgcctttggtattttttaaagaaatctttcaaagcataatcataaagatattgtcttgtaaaatttttagaatgctttctttaatatttgataacttggaattgatttttgtggtttggtaagagataaaggtcaaatttaattttgattctgttcatatacataactagctatttcattttcattcattttcttcactgacttacaaagtctgtcgtctccctgtaaatgtgagtctctaggttctattttctgttatattgatgaatatatctatccctgtgctattgttttagttgttataactttggtatgagtccagatatctgttggaggatatatcctgtaatttgtcctttgggagtgacttggttataattgagttttgcctgtttcatataaattataaaattagcgtatcaaattttgtggtgaaattttttatgaaaattgcatgaatctataaatttgtataaagaaaattgatatttctatgataatgcatcattctattccaagccacatctcttgacatttaattggctttttcaaatggctatgaatagagttttataatttccttcatgaaggatttggtcatttttgtgttaaatatattcctaggtactttatatttttagtgacaatttgtatgttgtatttttaaaattatgttttctaagtagtctttgctggcatattgaaatgcagttgaattttaaaatcttgtttctttatcaatattcctgctaaagttttaaattcataaatcttatctgaagcgtctttttgtgggaagagaattctatataggcaatctcatctacaaagaattttgtttcgtcctttccaatcattatgctttgtatacatatttctggtgctttctgcactggttaaaaccttcagtgcagtattgactagtaacagagatagtcagcatcattgacttgttcctgatcccaaagtgagtgccatccacaagtcacaattaagtaagaagttcactgccaggtggtcatgatgcaggtgacagtacttgttttgtggatatttcttataaggatcttttccttcgctctaatttgttaaattcaacagatgttgaattttatttaatactcttttcttcatcttgagagatgacaatttttttccccttggtctgttaatatggtgcattttactaattgatttttaaatagaaatcaatatcgtatttatgagaagaactcagattggttcttatatttaccgcctttatacattgctagatttgatttgctaatattttgtttagatatttacatccatgttcataagtgtgattagtctttaattttgctttctattatgtagtatgtatatgatattcatagcttaaaatgaattaggaagggtttcctcttttataatctctggaaggctttgtacaatacttgagctacctatttctggaatatcttgtatatactactattattttcattttacagatgagaaaacatgcctattgagtaaaaggtagaactaggatgtgaactcaggtgatctggatccagatccttttcttaaccatttctctgtactgtctgtcaatagcattgctgaaatttgagctggtgtaataggaaatcatgatattatttgttaaataaagacctcataattgtatgaggtctttttattgggtagaaagtgattattaaagatgggaattttttattcatgtaagtaagaaaaacccttgacacagaaaaacattcaaagatatattttggatccacttcttgtagccccatacttcataatcaagaaaatagggttccaatctcctgtcaataacattcatttttttaaatagtagagttctcaaaaggtagctattcccttaaagagatatcacaagtaggaagataattattatgaccatgatgactacgagtaaagaagattaagaaagttagatactggctgggtgctgtggcctacacctgtaatcttagcactttgggaggccgaggcgatcacctgaggtgaggagtttgagaccagcctagccaacatcgtgaaacctcgcctctgctaaaaatacaaaaataagcctgacatgatggtgcatgcctgtaatcccagctgcttggaaggctgagggaagagaagcatttgaacccaggaggcagaggttgcagagagccgagatcgtgccactgtactctagcctgggctacagagcaagactctgtctcaaaaaagtaaacttgactgatgttacagatggaaatatgtgcagatctttaattgcattgctaggtagagcctactgtactgagcgtcacagtacatcactttgcaatgactttgggctatcataaatataaagttgctagagtgtccttttttttgccccatatcagatttttcctatagaatccccgttgtaaaaaacagtgctcatttttgaggctctttctcttcccgctttagctcatgttgctttcgagctttagagagttacttctactctgcttgcgggaccctctctagacctcgcctttcttgtctttatttagccataagctttctgtcacctcctaccatctctctggcaggcaccttcattgtccttcatgcaggtctcacctcaatgctcattaatttccgtgtcttggaaccacctctatagacgctaaggacaaacaaagatgaattttcctgacaacttaaatgcccatgatttctccttccttattgcctgttttgtttttttgagtgtgttccaattttctttcctcatgggtaatgttgctcttcttatttgactataaactcagtgaatagagacattgccctattctgtgctgtgccctggcacagaactgattctctctatacaagtcttactgttaaatttgctgcagtatgtggtgttggcaaacagaaactttcattacacatctttgaatcccattgcagcctcattaatattcttccctgttgtagaagataggtcactcctggtctttttccagagattcagttactatgtgctgaaaagatggccttttgtggtagtctcagtgggtgttccctatagactgtgttttgaaaggaaaagaataaaaatgatagcatattttttcttagttagccttctttcacaaatcctaggaaaatagataattcactgctgattaaaaaacagaacaaaacaaaacaaaacaaacccccctgggctttccaaaatctggttatattgctttctatgtgtcctgaccctactattatctgtcatttacctttactaaatctcactattgattgtaaccatgtaatccttttgattgttctggtttttctggaatgctttgttggtgataattatctagttgtcttttgaaggttgattgtaagtggctggagaagatgagggaatactcttttttgtttgtttttgttttgttttgagatgaagtcttgctctgtcacccaggctggagtgcagtggcacaatctcggctcactgcaacctccgtctcccaggttcaagcaattctcctgtctcagccttccgagtagctgggattacaggcgtgcaccaccacgcccaggtaatattttgtctttttagtggagacagggtttcaccatgttggtcagcctggtctcaaactcctgacctcaggcaatctgcctgccttggcctcccaaagtgctgggattacaggcatgagccaccatgcccagctgcgggaatactctttattaaaatttacctacagcattgcattgggttgcttttggggttatagaatatttaagttaaaatattaacacattgtaaaataaaaaagtaacgggaaaaaaggagttagaaaaaggaagagagctggtgtccaagtcctagtttacttttttttttttttttgagatggagtttcactgtgccacccaagctgtagtgcagtggcatgatctcagctcactgcaacctctgcctcccaggttcaagcgcttctcctgcctcagcctactgagcagctggaattacaggtgtgtgctaccatggccggctaatttttgtgttttttactagagatgatgtttcaccatgttggccaggctggtctcgaactcctgacctcatgtgatccacccgcctcagcctcccaaagttctggcattacaggcgtgagccaccacgcccggcccctagtttacttttaagtggaaagatgagaaggggccatcagacaaggtgatgtgtctggcaacaagtgaagagatcatagatttcatttccacagataagtcaatacagttatttaggaaatgagaaatctctgactctggtctttgtgtaatattctatgatagcagaaacaaaaaattgaattgtgcctattgttaaaagtttactttgtttatgatttctactgtatgaaattatatgatctgggttatattaacacccagtgaaaccaaggggctgggttggtacactgaaagttattataatataattctcatgtgaggctaattgttactatatttgtttttaatttgactagaaatcccaatatttaatcaaaagtcttctcctctacctagagcttgttttatcgttttggtggcctcctcttgcaaaggactggctggtgaatggtttccctgaattatggacttaccctaaacatatcttatcatcattaccagttgcaaaatattagaatgtgttgtcactgtttcatttgattcctagaaggttagtcttagatatgttactttaacctgtatgctgtagtgctttgaatgcattttttgtttgcatttttgtttgcccaacctgtcaattatagctgcttaggtctggactgtcctggataaagctgttaaaatattcaccagtccagccatcttacaagctaattaagtcaactaaatgcttccttgttttgccagacttgttatgtcaatcctcaatttctgggttcattttgggtgccctaaatcttagggtgtgactttcttagcatcctgtaacatccattcccaagcaagcacaacttcacataatactttccagaagttcattgctgaagcctttccttcacccagcagagcaacttgattttctacaacttccctcatcagagccacaagagtatgggatatggagaccactaaaactacatccctttggccttaccagggaaatattgggaaggaaggaccttgtattactacctaatgaccccatagtattgtttgacagtctatacaaccagatgagcaggcaaggtagtaccctgctaaagagacaggctttctcatatctcataaatatttcacatcctggttctacatgctggttttattccatattagccatgaggtcttcagcaaattacttaatgtcattaaacctcaatttcttcatcctgaaaatgaggatgataataataagagtatatatctaataggcttattgtgaggattaaattaggtaatataggcaaagacctagcatacagtttgcttacaaacatcaacaaaagaaagagacaggaagagatgaagtgtgcaagagagagtgagagcaaccatcaatgtcagacagccaaaaaatgggcatatagatttttttataaatagacctcatatgtctcatttgcatgggcttttgggatgattaaagcctattgttctctaggattacttgaaatacacatttcctgcaggttacagcccaatggacacagaatgacttgtgtattagtccatccattctcacattgctatacagaattacctgagactgggtaatttgtaaagaaaagaggtttcattggctcatggttccacaggctatacaggacgcatcgatggggaggcctcaggaaacttacaatcatggcagaaggcgaaggggaagcaggcacatcctacatggctggagcaggaggaagagaaagcaaagggggaggtgccccacatacttttaaacaaccagatctcgtgaagactcactcactatcgtgagaacaccgcaggggaaatccacacccatgatccaatcacctcccatcagacccctcctccatcactggggattacaattcaacatgagatttggtggggacacggatccaaaccgtatcaacttgtatcattctgagtaattgcaactttcgaatgggtggtagggttggcaattgccaaaagccatggtttggagtcacttgcatcaggcctgggtttccccctggagcaggctgagcttggctgccttctaaggcctcttctgctctggacatttacaggcttctgagccaggagagaacactaagcaatgaaacacaggaggaaaaattaaaaacaccacctttaaattttggaaagtattttggagatacctgtgccctgctctctaaggagttcctgtagggatttctgcttatgaattccagtatattgtttctctttgggatgacaaatggagtttctgttgccacaccttgccacagacccactttttgaaaaacactaaaatccactttgcaagtgtataaatattgcaggcaggcagcttccacattctttggcaagggaacaaaatactatttaataatgcaggttccagcttttctcctgacaatgcaaagtgccaatgattattgaaaagggaatttgaaatctgccagaatccactcagttttccttgtgtggttacatttccatcctgtcaccctcgctagtgaagacaattgtttcagccattgagaaaaaaaaaaaaaaggtattttataagattgcaagaaagtgatttaaaccatgactatgtctgttaactgtttgctttgtttctctgactgtgtgcctctctagtcacccaatcttctttagctatcctgtgggctttttcctgttgtcaaaaagcatggtctacccaaagccattcttcaagcatctgatttcccagctgtctttctgctatatatttaaacttctagttctctttggggaagagggtggtagacttgtgtgaggatatagtctgaatgaagtctccgagtgattttttgttgatgttataggggtgggagttcggggagaggagggagagtctttggcctcacactcccctctgagtcctgaatggggttctctcagcatctcattttcccgctactcctgacacactcctccctgaccctattttagaggtccctgttatcaaatggaagtgcttcttatgtcttccttcattctgctaagctgactgttctctatagaaatctgtacccccagcttttctaccaatgcgaatcttcgtttttggaaaatttcttttaccttctctaggaaatcattctctacatcactctatttctttagcaatcagggactacatttggatgtataagtatatacatattaagtttctagatattctttttctttttttaaaattattttttattttattattattatactttaagttttagggtacatgtgcacaatgtgcaggttagttacatatgtatacatgtgccatgctggtgtgctgcacccattaacacgtcatttagcattaggtatatctcctaatgccatccctcccccctccccccacgccacaatagtccccagagtgtgatgttccccttcctgtgtccatgtgttctcattgttcagttcccacctatgagtgagaacatgcggtgtttggttttttgtccttgtgatagtttactgagaatgatgatttccaatttcatccatgttcctacaaaggacatgaacttatcattttttatggctgcatagtattccatggtgtgtatgtgccacattttcttaacccagtctatcattgttggacatttgggttgcttccaagtctttgctattgtgaatagtgccacaataaatatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttattttcttgtaaatttgtttgagttcattgtagattctggatattagccctttgtcagatgagtaggttgtgaaaattttctcccattttgtaggttacctgttcactctgatggtagttttttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccactttcagctttctgcatatggctagccagttttcccagcaccatttattaaatagggaatcctttccccattgcttgtttttctcaggtttgtcaaagatcagatagttgtagatatgtggtgttatttctgagggccctgttctgttccattgatctatatctctgttttggtaccagtaccatgctgttttggttactgtaggcttgtagtatagtttgaagtcaggtagtgtgattcctccagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttcctactcatgagcatggaatgttgttccatttctttgtgtcctcttttatttcattgagcagttgtttgtagttctccttgaagaggtccttcgcatcccttgtaagttggattcctaggtattttattctctttgaagcaattgtgactgggagttcactcatgatttggctctctgtttgtctgtcattggtgtataagaatgcttgtgatttttgtacattgattttgtatcctgagactttgctgaagttgcttatcagcttaaggagattttgggctgagacaatggggttttctagatatacaatcatgtcatctgcaaaaagggacaatttgaattcctcttttcctaattgaataccctttatttccttctcctgcctaattgccctggccagaacttccaacactatgtcaaataggagtggtgagagagggcatccctgtcttgtgccagttttcaaagggaatgcttccagtttttgcccattcagtatgatattggctgtgggtttgtcatagatagctcttattattttgagatatgccccatgaatacctaatttattgagagtttttagcatgaagcgttgttgaattttgtcaaaggccttttctgcatctattgagataatcatgtggtttttgtctttggttctgtttatatgctggattccacttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagctcctgttattggtctattcagagattcaacttcttcctggtttagtcttgggagggtgtatgtgtcgaggaatttgtccatttcttctaggtattctagttgatttgcgtagaggtgtttgtagtattctctgatggtagtttgtatttctgtgggatcagtggtgatatcccctttatcattttttattgcatctatttgattcttctctctttttttctttattagtcttgctagtggtctatcaattttgttgatcctttcaaaaaaccagctcctggattctttaattttttgaagggttttttgtgtcactatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatgtccctctacacactgctttgaatgtgtcccagagattctggtatgttgtgtctttgttctcgttgctttcatagaacatctttatttctgccttcgtttccttatgtacccagtagtcattcaggagcaggttgttcagtttccatgtagttgagtggttttgagtgagtttcttaatcctgagttctagtttgattgcactgtggtctgagagacagttttttataatttctgttcttttacatttgctgaggagagctttacttccaactatgtggtcaattttggaataggtgtggggtggtgctgaaaaaaatgtatattctgttgatttgggttggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatgcatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtcactgcacatgagatgggtttcctgaatacagcacactgatgggtcttgagtctttatccagtttgccagtctgtgtcttttaattggagcatttagtccatttacatttaaagttaatgttgttatgtgtgaagttgatcctgtcattatgatgttagctggttattttgcttgttagttgatgcagtttcttcctagcctcgatggtctttacaatttggcatgattttgtagtggctggtaccggttgttcctttctatgtttagtgcttccttcaggagctcttttagggcaggcctgctggtgacaaaatctctcagcatttgcttgtctgtaaagtattttatttctccttcacttatgaagcttagtttggctggatatgaaattctgggttggaaattcttgtctttaagaatgttgaatatcggcccccactctcttctggcttgtagagtttctgcccagagatccgctgttagtctgatgggcttccctttgtgggtaacccaacctgcctctctggctgcccttaacattttttccttcatttcaacttcggtgaatctgacaattatgtgccttggagttgctcttctcgaggagtatctttgtggcgttctctgtatttcctgagtctgaatgttggcctgcctttttagattggggaagttctcctggataatatcctgcagagtgttttccaacttggttccattctccccgtcactttcagatacaccaatcagacgtagatttggtcttttcacatagtcccatatttcttggagtctttgttcatttctttttattcttttttctctaaacttcccttctcgcttcatttcattcacttcatcttccatcactgataccctttcttccagttgatcgcatcggctcccgaggcttctggattcttcacgtagttctcaagccttggctttcagctccatcagctcctttaagcacttctctgtattggttattctagttatacattcttctaaatttttttcaaagtttttaacttgtttgcctttggtttgaatttcctcctgtagctcagagtaatttgatcgtctgaagccttcttctctcaactcgtcaaagtcattctccgtccatctttgttctgttgctggtgaggaactgcattcctttggaggaggagaggcgctctgctttttagagtttccagtctttctgctctgttttttccccatctttgtggttttatgtacttttggtctttgatgatggtgatgtacagatgggtttttggtgtggatgtcctttctgtttgttagttttccttctaacagacaggacccttagctgcaggtctgttggagtttgctagaggtccactccagaccctgtttgcctgggtatcagcagcagtcgctgcagaacagcagattttcgtgaaccacaaatgctgctgtctgatctttcctctggaagttttgtctcagaggagtacccggcagtgtgaggtgtcagtctgcccctactggggggtgcctcccagctaggctgctcaggggtcaggggtcaggggtcagggacccatttgaggaggaagtctgcccattctcagatctccagctgcatgctggggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctccacccagttcgagcttcctggctgctttgtttacctaagcaagcctgggcaatggcgggtgcccctcccccagtctcgctcccaccttgcagtttgatctcagactgctgtgctagcaatcagcgagattccgtgggcgtaggaccctccaatccaggtgcgagatataatctcctggtgtgccgttttttaagcccgttggaaaagcacagtattagggtgggagtgacctgattttccaggtgccgtctgtcacccctttctctgactagcaaagggaactccctgaccccttgtgcttcccaagtgaggcaatgcctcaccctgctttggctcgcgcacggtgcactgcatccactgtcctgtgcccactgtctggcattccctagtgagatgaacccggtacctcagatggaaatgcagaaatcacccgtcttctgcgtcactcacgctgggagctgtagaccggagctgttcatattcggccaccttggctcgacccctctctttttcttaagaatatatgaattcctatgaagaatgaaggtttagtcttgatttcatttcccttcctatcaactggacaataaaaatttgatctttaataaatataattgaagacttactgatacactgaagcctattctatttcaaattaatgttttatgtcttgggcatgcttcagaagtaaccatttacataacaattcttctaaggcataatgttgcttaatcaatttagcatgatatagtgaaagttaagatttatttttacttttctgaaataaaatgcttaatttttatattcttccaagtaataactgtcatatgcttatatggggaagattcaaaattaatgttttattataacccagtaggggtgggtctaggggagggatagcattaggagaaatacctaaagtagatgatgggttggtgggtgcagcaaaccaccacggcaagtgtatacctatgtaaagctgcacattctgcacgtgtatcccagaacttaaagtataataaaaaattgataaataaataatgcaaataatctatatttacaataataagtgagggtatgctcttgacattttatttattttttaattgtacacttttgccgtatgtgcattttgctggtatgtctctgaacatgacctttgctaaattaactccttcctgactttacttttgttccagtgaggggtgtttggctgttcttctttttggtttaaaaagcctttatattacagagtggtcagtttgctgctagtcactgagaagaaatgtaatgtgtatcctgatgactggatgacttataagcttataatctttttgagctctagtacatacttaactgtacttggcttctgaccttaaacatcattttccaaacagtcttgatgtttggtaaaaccagtaaccatccattactctcaggccacatcagacctgcttacagatatcactgggtgaaacatgagtacacttgttcaccccaagttcctttcagaggccttgaaggacactgctaaaacacatccagtgagttcagggaccctgatcacaggaagaatgcctgcctgatgttggaggaaggggtaaagccaacgcctgaagctttctctgtgcttctctgtaacagtcaccagagctacaggccagcagcacttttcttttacatggcaccttcctctcatttgtggggaaaataaggactttattagttcttccatttctcttaccctctcaggattatagctttatcatccaaatgccaggaaagtaaaacaaaacaaagttagacaatctaaattaaactctctcaacattatagggatgaaggaccttcagagtactagaacttcttaaaaaaaatctcttgcattgctacatcagtttccaacacacatattatttcattcaaatgttaagaaggggaaaagaatgttacagtgtactgtaattattttaggttcatgatgaaaatgctttacaagggtgggcgcggtggctcacgcctgtaatcccagcactttgggaggctgaggcgggtggatcactaggtcaggagatcgagaccatcctggctaacatggttaaaacccgtctctactaaaaatacaaaaaattagccgggtgtggtggcgggcgcctgtagtcccagctactcgagaggctgaggcaggagaattgcgtgaacccgggaggcagagcttgcagtgagctgagatggcgccactgcactccagtctgggtgagagtgcaagactccatctcaaaaaaaaaaaaaaaaaaaaaaaaaaagaaaagaaaaagaaaatgctttacaaatatgaaaactcctccctggttttttttgaaagcttaatgtttgcctaacaaaaccgtaaataggattctataatattgatgttagaaatgaatttatatttttctagttttaagggaatagctgtatattactttagatggtggtactatataaaaatatgttttcccattacatccaaaggtgacgatattaatttattgctagagaaagaattgatattgagttatagagattttccagaaggtattttaagaccctttgctggtcctttgtgactggcgtcatgtatgttacacagcaggttgaaagtgacatgctgtgattctggaagagtgtgagtctattggccctgtaacccatgagcttgttttcactaacccagtgctcaaagcaaattaattcacccacgaagtttgctttaacacttatctaagcgttactatcaatgttctaggaagtaacaagtatcattgctgatatacagctctgagttgactcataaacatttctgatctcatgagatagttgcagtggtgttttgctgtgtttactagatgcaactaacaaacaccatgagatttacaaagagatttgaagatatctgtgtctccaaaattgattgcaaggtgtagcaggggccagtaaggtgagctttcttccactccctagaatgtcttcctcaatccagattttaaagtgtattgaaatgatagccggctgaatcaccaggtcgaaaggatcaaccaactatttattaagcacttcatgtattttctgtcccatagagatttcagtgaaagatatagtgtggataaaacaaagagaaaaaagtgtcctcatgcttatgacttaatcgcagaagtggaacttagacatgtgaaacaattaaacaatttcacaacaacagataagcaaatgggatgctttggagagacatctggtccctgtgctgtttatagccaattccagtggtgaataaaagaagtggaacgaactgcttttgaagggagtgcatcctgatcctctggcagcaaggtagaggttttctgccaggagggaacactagacggaggctgtttgttttttctccaaacagaaatctcttccatgctaataggagcttcaaaaggattgccacagcagatggaaagaaccaatatatattcatgcatttaattagcaggaattaattgaattgggggattaattctgtcattagagagaaacaaaacctatttttgtctcccatctatggttacacaatctaagatggatttggcacaggtggtgtttgaatataaagccaccgtagtatctaatggccttttgatgccactgatggattaatcccagggatgatgagaaggtagccatgtgagatgtgtgctctgcaccatgtttcagcagtggaggagaagctggtaggtggagtgtgaggggtataaacctagaattcagtgagtgtttgaaggaggaaaaaggggaggagattgggagagtctcttctcttacatctgatttttttttctttttctttttcttttttattgagacggaatctcactctgtcactcaggctggagtgcagtggcgtgatctcggctcactgcaacctccgcctcctgggttcaagcaattctcttgtcttagcctcccaagtagctgggactacaggcttccaccgtcatgcccagctaatttttgtatttttagcagagacaagtttgtaccacgttggccaggctgatctcaaactcctgacctcaggtgattcacctgcctcggcctcccaaagtgctgggattacaggcgtgggccacagtgctcggtcacatctgattattaatgagagattaaggacagacacacctaagacagaatttttaattcaatctaacaagcacccattgcctggtcttccccctgcttttctttttttttttcttctccaaaaatctgttcctccagaaaagcagttttcatcctttttaatttttaggccaagatactcatgacataaaccagatgacattgtatgcataacacattcccataagtgacataggtaaaaagactgttgattatacccctttcccaacactgacaagtcaacaccagccctccgactcaaagcacatcacaattcaagtatatgatgtgacagtttgtacttttcaaaaatagccatggcattttctcccacctacacactcatcttgcaatgtgactttgatgctctttccattgaaatgtgggatctacgctctctctccttgtatatgcgcaaacgtggacttcagcaggaatgataccttgggatttccaaggcgaggtgagttgatcactgggctctcttgggatggttgcttttggaacccagccaccatcttataagaaagcccaagaagcacacgggaagcccaggaatcccacatgagaggatccaaggctcctagccgataccagtacccagttactagccatgtgtctgatcatatttgaactggatctttcagctcttagtggagcagctccaactgctgccaggtataacaaagacaaactatctctgcagaacgctgccccaaatgcagatttttgagcaaaagaaataattgggttttaagtcatatactttaccatgcaataatagatagttgatacagagttgcatgtcattagaagaataatcttaaatctgttctaatatgttaaaaaccttcagtagtttaacttttattataacaaataatttgtcacatgtctttttactgattgtgaaaaagtcctctaggcctagataaaaatgcagaggtctttagaaatttatataattcattctttttctcacctcatcttggacttattcagtatgcctatgtagaataatattaattacagtcatttttcttgagctgcttcccatttatgcctcattagcataattcacagcggtcatccatacctgtgaattcgtgttagattacctttgctgtgtttgatgattatactaaatttcatttttttgcgagctaagccttcacagtttgttgctcatgtaccatggctggctgctcacaaaatagaaaaattggacagaatgtttctgataaggtaaatacagcaaaggctatgcagaaatatgtatctcagagagtgagctattgggcagctatggtataagttatctggtagccacgcaagaagtaacggattgaataaaggcaaactatgaagacttcagtcatgataagatcaagagaattatttgtgtcacatttgcgatggattttgtctctgttggcacacacaaaaagttgggccttaaaactgtaaatttactttaacttcattttgtatgtcatgcattcatgaaactttttccgggggttattttcatttttggctgtcctgctccaagttaaacagaggagaaacagcatcatatagtggaagaaactcagacctggggaaggggggaggcaagtaaatgaaacaagagtcctttgtctctcagctggattgctaagtaatctgtgtgatcctgcaaaggtcagttcagatctcaagccctactttcctcatctatgaaatgaaaggttagactaagaccaaatacacgctagaaagtagagtattattactcctcaagaaatagtttagggttgtgactcttgctttgcacatgaaaatatttaggagtaaaagttcacagaacttggcaaagctagatgcatttatgattcccagtgaatcaactgatgtttttccctatgtcttttcaagccattctttgtttagcagtttttatatttacttttatttttttcttctataattttggaaaaaaagagttagctgactgctactatgggcagacaacaatgtggtaataggatattatttttaaaactaaaaaaataactgaatatgaaagatcaaacttttaaaaaatagacataagtgttcagagttgtgattctattttgcatgtaacaatgtagttatttcagttgctttattgagaatcacaaacatatatatatggctttgccaagttctgtatactttttattccccaatattgtcttctgtacagcaataattacaaccttaagccatcccttcagaagtagtcatatgccaaattctaccttagtctaaaataattctttttctgtgtgatggggctaaaaacatcagttctccctgctgctctccacagatgtccaggtaccttaatggttaggttctctgtaccttgagcttatttgcaaggcagagcctcaaaagaactgcttttttaatttttccactgatagaactggagcttggtaaactaacttgcccaaggtcatagcagttagtgatactcacaggacttaaacccaggaggtctgaatgtagactcaattatggcatatcccttcctaataataagccagattttgttttgtacttcttgccaaaatgtaactccatgatgacatttgttttgtacattgctgccttcttactgcctcaaacggggcctggcatggtgggaacaggtggggatcttagtctgttcctgctgctaggacaaaatatcttagactggatcatgtttaagtaatagaaatttattgctcatggttctggattctgggaagaccaagatcaaggtgctagcaaattactctctgcttcaaagatggaaagctcttgctgcatcctcacataatgggaaagcaaaaagaaatgaaaactgtgtcctcacatggtggaaaagatagaaaggacaggcagctttctcaaggctcttttagaagggcactgatttccttcatgagggtggagccttcgtgacttaatcacttcctaaaaggccccacctcttaataccacactggggattaagtttcaacatgaattttggagggtttatacaaacatacaaatcacagcagctgtcttctccctttcctgattccacatgacagaagccatctcttccttccgcacgtggatgtctgagcacatccagactcttgagagcccagacttaagagagagaggctgtgagaaggaagatggcagttctctcctggaagtcttgacttctcagtcccagctttgtgtgttggtatgtgtactgaaaaacaatttatttgaagatacagcatagaaggaaaaataaaccatttcctatgaagtaatgattcaacttctaacctgtaaaaatgaaaaatttctcagttccctacgcccttgcattcctgtcttcataagtttgtgatttaattttccaagaaacttaatattcatatacttaaaaacttttatatccattaacaacttgactttccctgcttctttgaattttggagcattgtttccttagtatgaaggagttttgagaaaggcaagaagacaagctcagagcttaagaaactatgaagaataatattgtaatcataacaactcattatttgtttttaagctcaatccttcagaaggttattatctggagttgaataataatagattcaggctctttttatgtggaggaaatcttaaacaacagtgttcatagggaaggacattaatcaggagagagaagtgagccttgtttctaataatgtttgcataatagctacccttgggtgtattgcttgacttaaaataaatattcatgcttttcacatccagtacaattggaaactactcgtggttatgattctgtcatatgatcttctacctattcaaggggacttcaaactgggaagctgttggaaaccaacaaacataaataacaacgcttgggagcgatatggggtacaagctgaaagatgctataatgttggctatggggagaaaaggagcgaagagtaggaacttaactgtttccagagggggggaagcagactcacactgacatgcttaaggacatttatatgctctcctggtttgcttttagctcttcaatagcttctcatcaccaggagaataaaatttaagtgccttatcttggtgtcagactcactccttggagtggttcctgtgaaaccttggatcgcgttacctgagactactctccacctcagatgtgacaacacaaagctctttgcagattccctcagacaccatgacttacttttatctctttgttcacatccttccttcatcttgcgaggatttttcaaagcttctttgttaattaatctatgtatcattgaagagtcagcttaaacttcacctgcttcaggaagccttctatgaactccacacctagtcaagagttttacccagactgtcctatttttattaacttatatatttagtgatccttaaatagcctttgtcctggggagttttttcatcatcttgctttattgcttacatgtacctaattttattacataaatgctttcagttagttaattcatttttctttccttttctgtctcctttctcctttctttatctgtttctctctctccctttttattaacttttaaattctgagaaatgtttcaatacagtcttgagaacataggctattttgttgttgtttttttgtttgttggttggttttgagacagagtctcgctctgtggctcaggctggagtgcagtggcatgatctcggctcactgcaacctctgcctcccaagggttcaagcagttctctgcctcagcctcctgagtagctgggattacgggcgcccaccaccacacctggccaattttttatatttttttatttttagtagagacagggtttcaccatcttggccaggctggtcttgaactcctgacctcgtgatccacctgccttggcctcccaaagtgctgggattacagatgtgagccaccatgcctggctgagaacataggctatgttttgaacttctgtgtgtgttacaaggctttgcattaactgctccctcatgcaactttcctaaccttctttctctcctattagagacattctgcttcagtcaggagaacatcctatagtattaaagtccaaactgatttgttctcttggacctgtgattgctaatacagctgttactcagtatctgtgggggattagttccaggaccccttgcagataccaaaatctacagatgttcaagtccctgatctaaaatagctcagtatttgcatatagcctttgcacatcctcccgtacacttcaagtcgtctttagattacttataatacctaatctaatacaaatgctatataaatagttgttatactgtatttttaaaatttattgtaatttttactgttgtatcattattattattttttgaatgttttcgatgtgaggttggttgaatctgcagatttggaacctgcagatacggagggccggctttactttccccagcctctccttccttgtccttcaacgcagggtttttgataaacaccatatccttggctcattatctgtgcttctaatccgatgggttctatattaacagagatatgtctgcccagcttcacatgccaattttacccttattggtaggctccttctgaaggtccatatgtctttttcatgtacttatgtgcagtcacaaaatactgaaaactgtgccttctgtttatataacatacctatttataaaacactttaaaaattttatcctaactaccgagaggtgagcagtgcagctgttaacctcatttgcaaatggagaattggttcaaaacgattgaataacttccaaaatttatgtgtccaataaattgtagcgattagaattagactccagttgagagcattgttcacattacaaacctgacaacagtgtttttttcactgtctgtaggccttgcagagcctagtagagttctgtgcatgatgaactcaatgggggcactggacacaggctcacacagggtctgtattatggtgctgatttgggcctctatacctccagagaattaagttactttaaactccactatggacatttataaaaggaagagtgagacactgtgttttcatagggttttttttttttttacacataacactttgttaattccctttctcttattttcatctctcttttcttctctttttctgttttcttttcagtcagttcaacaattaattggtgtgcacctacaatgtgcaaagcattatgctagggttcacaggggaatgcaaagaggatgctgcttatagcttgttatggcgaggcacttttcttctctccatttttctccattcttctcttcttcctaccttctttttcctctgatgttcaagtagccctcatcatttctataaatttccaaggcttcagcgttggtcaaagggaaggcactcagcccaggggcagtgagtaagtttaacattcttatggtcctttgcatctgctcacccaggactcatacatactcaatataaaagctttgggggttttgctcagtgacagctggggactctatgtaatttaatgcatgatacagcacttttggctaactctgtatgagagactactcaaataggaataaaatatcactttgcaaaatacatttaaattatttttcttctaaaactttgtgactttaaagccttaaaatctattttttgaaagccaaaaaataacagatgttggtgaggctgtggggaaaagggaatgcttatacactgttgttagaaatttaaattagtttagccactgtggaaagcagtttggagatttctcaaagaacttaaagcagaactaccattcgacccagcaatcccattactgggcatatacataaaggaaaagtaatcatcctaccaaaaacacatatgtactcactgttcatcttagtactatttacaatagtaaagacctggaatcaacataggtgcctatcagcagtggagcagataaagaaaatgtggtatatatacaccatggaatactacacagtcataaaaaagaatgaaatcatgtcctttgtaacaacatgggtgcagctgaagaccattatcctaagtgaattaatgcagaaacagaaaaccaaatattgcatcttcttacttgtaagtgggagctaaatcttgggtactcatggacacaaagatgggaacaatagacactgggaactctagaaggagacagggagggggacaaaggctgaaaaacctcttgttgagtactatgttcactgtctgggtgacaggatcaatagaagctcaaacctcagcgtcatgcaatatatccttgtaacaaacctgcacatgcatcccctgaatctaaaataaaaatgaatttttttttttttttttttttgagatggagtctcactctgtcgcctgggcaggagggcagtggcgcgatctccgctcactgcaactccacctctcgaattcaagcaattctcctgcctcagcctcccgagtagctgggattacaggtgtgccaccactctggctaatttctgtatttttggtagagacggggtctcaccatgttggccaagctggtcttgaactcctgacctcaaatgatccacccaccttggcttcccaaagtactgggattacaggcatgagccaccatgcctagcctctcattcctcttctacaccccacataaggtgcatgaatcattagacacatatatttttttttccctaaggctacgtattcctaaaagtagtttaagttacctattacctctaggcttttttttccataagaatcatcaataaattaaatgccaaacacgtggttgttttctcaagcacacaattaaaatagacttgattcctctttgctgtctccagtcctcttaatattcatagcaataggtatttatctatcatcacaaaacacacaaaaagactggtgattgcttaaatcccaagagggcaaagtagaaggaactagaaagaaggaagcaagtgcaatcatgattaggcagttactccgcatctgtggctgggttaggaacattcataggacttcatgaaccctactaagttacaacctgctcttttacaaatgtggaaactgaggctcagaggggttaaatgatttgcccagtgtcctactgcttaaagtatcagagttgagatttgaacccaatttgcgtgactccagtttttaaaatatttactgtaccaaggctggagggggcacgcatgggccctagaagggtgcgtggaatgggtacctgggtggggaagggttaaagagggggcctcggtctgcttgaccaagatattttccttccctgattcctgccccaaatgtagactacttatccaaaatatggatccaactttgtgtaatattttaataagagggtcttctactaatgggacatctctcttttgtctttcacagcaattttgcaggcagtaatagctggtgatcttatgaaggtaagatatcttcctaccaaatctttggcgatgctttaagaactttaaatcaacatcattcctcatcaaaactctatgttcccatctatcatttatcatcccctgcttgcactggctgggtagaagaggcaggatgttcttttgagaactgagcagagatggtgttcaagagcaccggggtacttgtctcagttacttaaaatgaactgcatgtccccaggatgcaatgtgcacagtgtgcctgccctctagaagctgacatttgaagaatttaaagatttcctttcaggcaggtattgaaatgaatgtatctgtaagaattacctgggcaacactcagaaatgcatccttcaggccagagattaatctttccttgtcgtggttttatactttggggatcatagttagtcaaacaaggactctcatagttagtcaaacaagaaccctgatccccttggaatagtttaatttgtgtttgtgttttctggtgagttttgttcagaaggaaggaagcggtcaccactgccctgagggtgaatgtaaaatctgaagtcagactttctaagtttggatctcggctctaccattcactgtctgtgtgattttgtgtaattatttgattctctctgtgccttagttttttcatcagtaaaatggagtaatattacctctctctttggcttgtcatgaggaattaatgtaataatacatataaagctctcaagactgttcctatttcatggaaggggctctaaaatgttagctattttattaatattctgatagtgtagatctgtgttttttaatagctaaacatggtggaaatacaaatatttgttatataatataacatcatctatgaatattctaaagctatatttggttttcaggcatcaggctgatgactgcccatatgcccctgcaaaccccctgctggaactgatctgctctgtattaatgacagctgcctgaaggcagaggctacgcctgactcctcagcctgtggagtgaggtgccattgcagatcaaggaaccaatagccctaagagaaagctgaacagtcctaccctcagacataactttttttaggcgcatctgttggacaaactgaaggacacctgtgctgcatttttcaacaggttactagaggaaaacaaatggtgaaaatgtttgcaaacatcttgatcaactgccccctttaggcacataatcctgaaaacggtgcctgtgccactgcacagatcatagtgtcaatagaaattgttacccagaagagaagagtgctctccaagcagtatattgatgagttcagtgccgtttcttaccagtggattaagcccataccatcctgtactctgtgcaaggccttccattaggttttgtgggaaacaaaggcatgaataaaattgattcctgcccttggtggatttctacaccagaaaattttgcaaagcactgtacatttgaaacccttccattttattttctatatgcttttagttcaggcaactgatttcccaagatcctgagtttattatcacacttttttttgtacttttaaataaagaatcatttgcaatgtgggaaatcactatatccagctggttgtcttattataggttggtgcaaaagtaatttggtttttgtcatttcagtgacaaaacctgcaatcatttttgcaccaacctaatgcattctctgttataattctttcctaaatgactaaaacatgacttaataacaccttattttgtttttgtttttggagatggagtctcgctctgtcacccaggctggagtgcagtggcacgatctcggctcactgcaagctccgcctcccgggttcacgccattctcctgccttagcctccctagtagctgggactacaggtgcctgccaccacacccagctaattttttgtatttttacttgagacggggtttcaccgtgttagccaggatgatctcgatctcctgaccttgtgatccgcttgccttggcctcctgaagtactgggattacagatgtgagccaccgcacctggccaataacaccttatttactgagagatggaatatttactgagggcttaaggttttactttttctctcttacatattttcttattttccttctcaaatattcatgccctcttcctcttctccaatatcttttgtttctttcttctgagcagaaagtgcaatatatataaaatattaaatgggatacatgtgtatatgtttgtatgagagagagggagagaaagagagagagagagagagacaaagagagcgagagatagagactagcgaagagaacatctctggagccacccctgtgtgaaggctgtcacaaatagctcctggacaactgggctgcagaaagtgtccgtggactaactgaatgttcatggtgtctagaaacagcacaggaaggcaggatcaaggcagttgaccctgaacaggtcccatgctgctatcctttgtcgatctccccacaaagaaagggagtgtcattttaagacaacgcagttgaatggaacaggatatccttttagagttttgtggaaaattgctagctacttcttcctgccctcttgccccccagtttagggatgttccttacctccattgtccttacctccattcagctactgctttggatccatgtcctgggaggtcttccgtggctgtttccatcccctgcttcatgcttccctagtgcttctctgagacctttgtgatgttcctgtccattactgtgtgattctttacctatccgtctccaccatgggctgtgagggctttgagcacagtgactgaattgtattcacatttatcttcctggcatctagcacatgacaattctatggatgtatttgagtgaagacgtgaactctgaatttaggttctttttttaagaaagtatttttaattgacaaatgattatacatattaatagagtacatagtgatgttttgatacgtatacagtgatcagatcagggtaattagcatatccaccacctcacacatttatcatttctttatgttgggaatgttcaacatcctccttctagctatttaaaactatttaatatattattaactatagtcatcctacaatggtatggaacactaggacttattctttgcatttaggtcatttatgctctttcaccttatgggatgtttgattatctataatgtgtgccatctaacttcttgagagataatgtgttccttttgcttattacctgctgggttatttaattctcatttgtcctaaaattacctgttagaagcttcatgcaggcactcttgtcatgaaatactgtagtttggagatgagggactcattcacattttctgtaatgttcaatattttataaacttagaccatatcctcatgtagccaccttatcctcaggctacaaaattctgttttgttttttttttccagtcttctctcatatagaaactactacattttctgaatcattttgggtctcactctgtggattatctctagcctattaggtatgtgttggatgattaacagaaggtttgcaggctgggctgcatatctggatgaagaaggaagccagatgtgtgttcgtgtgtgtgcatgcatgcatgcgtgtgtatgtgtctatacttgtattcagtgatcttacatgggagaaaaagaagcagctttgatatttggtatataggttcataagactgaagaaaaactgaaggacacaggcaagaagcttagctacagtcaccaagctatttctgcttatagccataattactctttcactcaggagaatgctaagccaacatagagatgcttttgttctccactccacccctcactactccttcgagagagagaccatagagaccagtgctcagaaaataaatgaaaaaagtaattcagcatgattcagtttccctagcctgttcaatacccacagactctctccagagttagaagagacactggtcatctctgtgagtgataacacagtccaggaatgttacttcacctttttgacttttctctatgtcctctaaggctggaaacattgtggtctgctacatgactctcattttattaccggttagctgttatccttgttccggattctgcctgagcttctttttgtatgtctctcttgcagctaatagaaagctataaaaatggaggcagtctgctaattcagggaccagaccactgttcactccttcactacgcagctaaaaccggcaacggggagattgtgaaatatatccttgaccacggtaagtaggcatagtgaacttaccaaggatcacttacctgtgaaatccattgcattttgcattttctaagttacccttcatccaggcagttttcagaatggcagaaatactctcgaacttttagcagactctgcccctgcttatttgaggcagtcgtggttgcagaccactgacacatacgggccatcctatccaagcaattagtagaaacagtgttcataccaagctctttacaggctatttttcagactaattagtttttttttttaaatagaggacaaaaataaatgcagcctggcatcgtgtgctttatttttttctagagctcttctgtaaattaatgggttgggattccctacctcacctgtatttgcggttcatcgttgtgaagattcatgaggataattgttttgcatctttccagtttctcatttttttttctgtttgatctcatttatcttttccacccaagttacgctttattctctttgaaaatgtctggtactattgtgttgtctgtggcagatcatactaaccttccagactgctttctaactggatttctaatagttggtgccagatcgtttgcaggaagtagcatgcgctatagcatctgcctctaaaaaccctttggaagcataaacatatttaatgaataccaaatctaaactgttacattgaatttatcatgttttgtagtatttctaggaataaagaacaggaataaaggggaaaaatactgcctagctagtctgttttaaatgagaaggaatgaaagagtctaattctgctggatcttggtatacagagagattggaaaagtttctttgagccctgacagtcagcctgtggctgactccttttgtacccaaattcagcctgtagatagtaagcatactcataaacattcacatcctttttgctcctttttttttttttttttttttttgcaattcagcaagtatgtcttattccattcattgattcattcatttaacaaatatttgtgtagtgcctaacaggagctgcctgttatagatggtacacagacaaaaataaaatacagtcactgttttcaagcaattgcaggctaaagaaaaaaataagatcatgtgtataattaaatttaaaaccgatatatggagctgttttaagtcctatggtaaagccacagatagataacatagctaccatttatcaagcacatatttgccaattgtttatagtaaacacatcccgtcatttgacaaggtccttgcaaggtaggtactaaactatcaatcacgttagacaccccttgctttgtcttcaacaccttctcactgtgaagattctgcttgaacccttggtctgaaatacggtagaaagggtgggttagaaaaaggaaagaccatgaaaacaggagggctgcgatgacagcatttctttactccttgtaggctgggttggataatcccaaacctgtctgccctggaaagcctaggtagataggatgtatttttggtgctaagtctggggcttgtatcattccatctcctatttccctggctattcagtctcttgcagttaaaagcgttcctttctgggcaagagtgaagccacactaatatctcaggatttctactgcacaaagctcaggtgagggttagatgtatactgtcactttatttttgtttagctcaggtttaaagttctcctatttgctgtcttcttgatcacttccaatctactctctttagtttaccctttacccaagagattgaatgcttgcttggataccttaagccatttggtgcccacctaccctctctctggagttaggtgagacactggccatctatttgagtgacaacacaatccaggaatctctctctccacacccccccacccatcttttcacctttcctggagaagcagtatttcctcccctagtcctaggatcctctctgtatccaccgtctcacttggtctcatttaggaggctgcagtcagctcctttttttgatgaggctttgttgaagatggactctcacatgtttggggctttcagctgggagggctgtggaaggccaggacacctaagcctttctcaacacctcgtctttttttcccaagatccttcacagcatggtagtgctggggttcccaggggtgagagtggaagctcccagatgtcctgaagctaagctgggaagttctggatgatctctactgcattctattggctaaaacaagtcacagggccagcccagatttaaaaggttgggaaacagattccactgtttgatggcacgagctgtgaaaaattcatggagatatttaatctaccacactcccttatgtcccggtctctgcagtttaaagtgaacaatgtcctaaacttctgactcacctggaatcccttagagcttcgtttttctatttgactttggttctgggtcttaagaacccaagtttcacaaataaaaatacaagatggccgggcatggtgggcccatagtcccagctacttgaggctgaggcagaaggattgcttgagcccaggaggtgtaagctgagtgagctagaattgcaccactgcactccagcctgggcagctgagccagactctgtctcttgaagaaaaaaaaatgataacaataatgaaggttttaacataagtatagcccatgcaatatttgaaatatgattatactaaaaatgaaaacagcagaactcctcatctgagttgccccagggacatgaatgatgagtcctgtgccccagggacatgaatgatgagtcctgggatgatatcaccttaacacagtagcttttcactttctctacttcctctcttcccctgcgtccaaaaatagggcctttaaaagcaccgttcatccaagctcacaggccttggagtttctaaccccaaatatagatcagtacacacctactttgcctggcatcaattcatctggcacattagtctctgagggccttgatcaaaacctaacattccaatacaaatcagtttctcatcaccccgcattgactcttgcaaagactgagtcacacaataccactccgcccaaatggaaggacacaaaggaattcagtcttttttaggggggtgggggtgcttatttttccagtgctttggttagatgttataaattaatcagcttaatatttatgctcacgagaagaaacacaatgttcacagtaatcatcctaacttcacttccaggcaaacaatttctgaggtctcagaaggcatcctatacctttcctgcctcaccaggatctctaatagcacaggaagaaagactgtggagatgggagagcacaatccatctcttttgtttgtaaagaaaatgttattatgatgttcagtccaaggatcaccgcatttttgatggatggcaatttttaacactttactactatagctgaatatggagacttaaatgcaattgattcttactgaaattagtttttatcaacattgatagacattgtcaatttcatttttgatgtctatcttatcttttttatttattcagaaatacggatgtaaaatcatttgatatagcctaattcacctcattccacaagagctaaacacttcagctcaactgtcgttttgttttttaatatctttagttgctgattcagtttatattaacctttgcattttattgaaaactatcatagcaaaaccattcctctcttttagatgatagaaactcctttaaattatagtgttcttgaagtcagagacaagtacacagaaaacattaccctttttcaatactgtaatcaccttcttaaggtgatctctcttgattgaaatactctctcctaacttagtaatgatgataactctggaatatcctgacctgacaaagaaatcagcctttccaagaggcctcagtaagtctgggatttagggatgtataccagactatggcattgtatttttaaattagcatcagatttgcagtaggtaagtctgatcagtttgaattcatgtaaatgaaaaaaaaaataacaaataaaaattttacactatgccgaagatcaagaaagacattcctcctggttattgaatattgcaaatctcttaaagcctttgttgtttatttacttattttttacaatttggtttatgtctgtcccatggtttcatatgacataaatctgaaaaattgttcaaagacttgactgtaaggatgcctttagtaatagcaattctgaaggattcacaggctctttgccaggtgcacagctgatgttgtttgtggctcttgagttgacacttcctttgcttcctgcagccttactcctgagcccctctcccctctgctctgccctcttcttcattggctctggtcaggagtgtgggccgccaccatcaagaggacacctgaacaagagtcctgagattagttattctcccagacacaacaagcagcaactgatttctcttctatgggctcttttaaagcaggctgggggctgtgccacatgagatctgcggtatgttctgaaagcgccatgggaggcttgaatttttttcggcttgcatcttcttcctttggatgtcttctctcatctatacagcatgctgctttcctttatgaaaaactggaatttggacatttagagagttgaaaagagactcggggaggaagagttaataattccacagagactgggagagagactaaggatgcagggattccagctgagattcctctcagtgcttcccgcttttcagctcctttcaaccatattttctgcccgctccctcccccctcgtttgcccctccaaccctccaagggacttttgtgttgtttctttccttcgccaccctgcacactctgctcttttgtttttattctccccacgcctaccccattgcctcctactggttttcctgatagaaatctcactcatgcatttcctttttgatttcaatgggttattttgtcttccctctttttctgtcttcagtctttcttttctctttttttaacccccctttttctgcctctggtcccagagagaactgaccaccatcctgctgggacaggatgacagtactgttagcattcccagtgccagctctccccacatctgtgcagcttttgtcctgtggcaggggaggatttggaatggtctgctggcagcgtcagggagactaatgggaaatgagggcccagagagaggccatgggaagtggaaggaatagcaaaggggatttggaggcattggtgtgggaagcaaattaaaggatgcatgtgacaaaaggcacgtcatatataatacaaatataatattgatgacaaagtcacatcagcgggagctggggtatccaacagaagagcctatggaatgagtactgggcagcaacattgtaatttggaaggcctggctgcttaacacgatgttcactttctcattttgaaagatttgtgaagttttgcttcctttcgcattccctgggtgtctcctgaatactgatgtgtatgtccacttaacagaattttctttcccttagctttcagaccatttcccatatagcacagtcttttgaatccatatttcaattgtgaatctttctcttaaagtgatattggctgggatccaaaatggctttaaaatgtcgtttattcattcattcattaaaacattttaattccgtcccaggcacttttgaggaaaaaaaagtttctgtaacaatcactgctaacctctttgttctaaatgttctaaatgcattatcatatttaatttttacaaccctatacagtaggctctcatctccgtttgacaggtgttgaaaactgaagtatggtgaagttaggttccttgccaaaactcatccatacgtgagagatggtctgtgtcctccatattcctaataccagcaagggaaatgaaacatggataaataaccacaatgcagggtggcaccacgtgaatgtcgtaagcagagttcaaatgacaactgatctagggttctggaagagcagaggccgttttcatctgaaattttcatggagaaatctgcacccatatctcctcaatagggattttatagtattttttctggttcaggtcagccaaaggatgaagggtggacatttcagtaaaccctggaagagacagagacctgagatttccttttctattgaggaaacaacagtgaattctctgctgacaatttgatgatctccctcgaaattccttaggggagatggcatagtgtctgcaatcagaacgtatgtgtatataaaacaagccccaaactcaaatgttacccattcatatatgttgaaggaattcaattatctttatttttatttttttgagacagaatctcactctgtcacccaggctagagtgcagtcatggctcactgtaactttgatctcctgggctcaagcaatcttccctccttagcctccctagtagctgggactacaggcatgtaccaccacgcccagctaatttttttttttttgtagagttggggtcttgctatgttacccaggctgctcttgaattcctgggctcaaacagtcctcccacctggctgtcccaaagtgctgggattacagacgtgaaccaccgtgcctgactagtctttatttttttctctcttgtttttctccttttgtctcgtttcctttattagtgagactcaaattaacttttcaaaaatcacaggtgttattgtttctacactaaaagtcacagggtacagttaaactccacattgtacagttaaagcatagctccccattgggcagtgcaggttcaaataaggagaagaacagccttgtcttaggcttctcctggcatccactctctgtaactccttccttgctagcattatgcaaacagttatcctaaagcaggccaaaaatgattagaaaatgtacctgtgcttttaaaaatagctgcccattcccatctgtagtcagctggctgctacttttgcctcttcttggccagtgttcagaacattctgctattttgtgattatctatgttgatgggagaataaggaaagttgaagttaattaaattgattatttcagagccattccccaaaccttttaatgggcattttttttttagatattaattatgagcaaaagtttcttgccttgttattagtgcctctgcctctcacctctgtcagctgcagaggatgaaagggcgtggagggaaggagagtgatgggtagccgcgggcatgcctgactcacagactggataatcagctctggaataattctgggtagtgactctggtcagaaattgtgaagaacagctttcttccttgtccccaccttcatattgtcaaattattgctgtgctagcccaattaaaagccttgaggatcccctcacttgcatagaggcttagaccctggataactgtggactcaccgtggcatggctctgagaacaccgaatgacagagctgaatgaaggagaaaagtaaacaaggcccctgttgcctaaatagttgtgcaattagcagtaccaatgggaacagagctactaatgagtgtaggctgctcatgttcatggaatttcttccaaaaggagtggcttagaatgttcactgaaggtgacaggcactctttaagaggaccattgggtacttaagccccttgctgacgtgaagagtgccctgttggcagctaaataggcctcaggtgcttgtttctcaggacatagaatttgagtcaacaagtgtcttcacatgtaagtgggagtaaagtgaccctttcataccacattccttcactgatgatcccatatcttgatgtagtgtgacctgctgtatcaggacagagaataggacacttcatgctatctaaagttgaagcagtacctgtggtgtgccaggcactgttttaagcacactatgtgtattgactcttttctttctttctttttttttttttgagaagtcttgctctgtcacccaggctgtcacccaggcagtgagcacaatctcggctcactgcaacctctgcctcctggattcaagcgattttcctgcctcagcctcctgagtagatgggattacaggcacacaccaccacgctgggctaattattgtatttttagtagagacggggttccaccatgttggtcaggctggtctcgaattcctgacctcaaatgatccacccgccttggcctcccaaagtgctgggataacaggcgtgagccaccatgcccagccctcttgaactctcacaacaaccctgtgagataaatattattattaatttgactttacatgggtgataaacaaggagctgagagattaattagacttggccaagacctagtctatatagagctgggatttttaaccaagaagggacagctccagaaacctcgcccctggtcactgtcctgtgctgctctgcacttttgtatgtgtgtgggaggataaggatcattattcatgttttcatagaatcacaggaccaaggaacaaagaggtatgagttaaatctttgttgtttccttaatatagggtaggtgctagaaggatacaaaaaataactgaggtgttcttatattcaacaaatatagaataatttatttatggaaggcatgcattcaaaaagcaaatacatagtatgaggatagaaccaaataagtgctttgggagctgagagaaagaatacattccttctgtcaaaggtcatcttttgagaggaccttgtcacagactagcctttgaagaacatgtcagatttagataggtggctgttctggatagggagagctgggaaagcctgagaaatatgtggttgagtgtgcaattaccactttagcttttgtgaaaaaaaaaaaaatggaaccctgggaacaaattgaggaaatgtagttccagatgaaagactgtgagctccagtgtttaaatacttgcaagtaagcagtagatatgatgtattggaaacctagaaatctagatgatataagaccttcttatctttcttggtaactacttctgcatgctaataatgttccaggcagatactggttaggaagtctatttgtcaaataggacaagcagaaaagacaaataggagagactttgcaagagaagattcacctggtcccagtgaatagcaggtgtgaaagagaagaggtcaagatgatttggatgaccaggagaattatgaaatcccataacatctctgttatgttgtccttggccaatgactttcatggtaagagtgataacctcttccaccccttcttactatgcacaataagttaatttttaataataatgatatccaccaataaagagagcaaattcccaggatcgtctttctaaagacaaaaatactcagtaccttgaactgtgtttggcacttacaagcatatttattcatccattcaatcaaatgtttaagcatctacttatctccaggctctacactagacaccaaggaatgacacaatgctagacaaagcatgggccaaaactttaaggggttttctggagtctagttatagggagagataaatcagtaggttattttaaaacggtttgttacgtgtcatgatcagtatcatgatcatatatccccccttgcctggggtggtcccaacttggatgataaatcccattacccattcaactataggaaatagggtcagtacataaagtgagggattgtataggcaggtgtttaataagctgcttgaagtgggatcatgaagggctttatggggaaaaaaagtctcattggatacccataggctgaagagggcaagagatggcagggagagaagcagtggtacagagctagaaaggaagacattccaagcagtgtttgtagattgaatggattaattcatgaatacacaaaacattgtgaaagggaaaattcacagaatatttccattcctaaggatgcatctatagtcatttgatgtatatgcatagtatttctttctggtctgagaagggaaattttataaaaactggaattgtaccctagatgatacgtatagtatcttacagccttaatattttgcttcataagacgccatcccaagcaactcgtttgagaatgagaaattgccctgattcctaaagcccacctaatcttcccctttctccctagttagccacttaattatttttcagttattctattccagttttatttcataaacttgatcgaaagctgcttgacagcagagaccataccattcttttttatctaccattctgtacatattggttcatggagattgggagtttggtgatgaggaggtagaggaatccttttatttttctttctgtcttattattcctatccccaaatttagctttccaaggcattttaattctgtgactatagattttctgttaatgtttagtttttgagcttatttttgacggtcatcttgctttcttcttatttaggaccttccgagttattggatatggcagacagtgaaacgtgagtgttgccttttattacatagtctaggttattttcttcagaacatatctgggagaagaatgtaatctatagagcatatcataggtaattttaacttaattaattcaaagtccactttcaactttgttcataaatgtgcagggctaatagcctaaataaaaaattacggaatagaaattgatgacaattgtcataatgcttgcctccatagtcagcgctaatcatcatttagagcttgcttcaaacaatgtacttctgcactggtgcatcttggaatgttgagaagtctaaataattacacttaccttttaatatacccatcacatttattctttctcaactggagtttctgaaaaaatggggccctactgccctaaggcattattcacatgtagtgacataacttctctctgttagtctagaacaggacaagttatgaaccaccactgaagaactgagaacatagtcactctattttctgtcttctgtggttcagagaagggatcctgattgaaaaagtcatcagctctgggatggtgcctaaactgatgataatgtttgttttcaaccttatttctaaagtagcgaaatagccactgctccccaaacaggaacaaagataggctgtacaactaatcctgaaagccatatttgaaaaggtataaagatgagttggtgtggagaggaatgaggtggtgagtagctaagcatgtgggaaggaggagaagtagaaatgaatagaatggaggacgaagagaagcagtagagctgtggaagaagctgtctatcactccatagagctggtccacatgccagcacatcctattggcaagattataagtggtgccatcacttaccccattttgccttctctaaaggctgctattgatttttcctgaaacactttggcgttaagcatcttggtgcctttgggctcaggataggaataccctcctccctatagagcctgtcagtgatggggaaatggccagtttcccttgctccttcccacactgagtggctggcctcaagcctgctgcctcctggggagagccctggctctcaaactctcccagggtctcactgtgcctctcagatatcctctgtggctgccccctccttccacctgccactcacacagaatctaaagtggatagagcagagtgggtgttggcctggttctttgaacttgggttctcaggagatactccactgcaggccgagtggccatcaaccaagggctgcgtgctgtgcctgaagggccagaggcgctccacactgctccctgttctttcacccagtgcctttctcgctctgctcaaatgtatgcacagaagagaatggcttcagtattcagatacatctagacaattagtctgtttaatactgcattgactatcacctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaaggtaactcgatgagtgagtgcaaacatcctcccgctgggcgagatcgcaggcgctgttgcctttgcttgtgaccatagcacggacatcctttctgtgcttatggaagtgcctggggctttggaaaaaggaggaaaaaatagagtgcttcatttagagaaactgtgatttaaatgtataagcacaaagggagggcgtgtgcttgcctatggggctttataaacctctgaacacgttgaccttgggactttggggttgtcctgctgagcgctagcagccaagtcatgggagttgaggtccaaagcccaaggagaggggtcaggaccattttcaaagactttggcctgactactgagaagcccctttggggttttccttcagtacttactccaacgtgttttaaattctatgatttatatggccccttatatgggtgccaaagggattctttcccagctcccaggatggtaggatctggctttgagatggtcatagtcttaaatctggtgtgtttatgtagttcttcatttttaaaaaattctttccatttgttttctaatattattctctaaaagttaacctcaggtactagatagcatgggaattactgtcatttataggtataggagctaaaagcctagagaaagttacacatacccttggaccagtagctgaggcttaaattaaattgagctcttttgacgtccagcccagtgttgtatcagcaggttggtggttctcatttggtgccagaacaccccagccacataacaaaatcggtttgtttatggagtctgttttgttgaggtacagtgatacctgtggcacttggcttgaaatgtggttggtttctccacagcaaaagttatgtaaatctgaacttaaagtgtccactttcttaggactatcttaataagagggcagtgaggccagatattgtactgtgacatgtatgccaaccttgatagcatcagctggcggaggtgaggccttaggggaaactctgtttaggagaactgagaacaagctgcaccacgagttgtttaagtttatagagagcacccaagagaaagggttgaaagatagagggaaggaggagttgtagcttagtagagttgacccagggctcagcctataagaaagaagagagagaaagaggagttagtttacatagaagatcaacaccatagagcaggggtgtccaatcttttggcttccctgggccacattggacgaagaagaattgtcttgggccacacatgaaatacactaacactaacaatagctgatgaactgaaaaaataaaaatcacacacacacacaaatcttacgatgttttaagaaagtttacgaatttccgttgagcctcattcgcatccatcctgggtcgcatatggcttgcgggctgtgggttggacaagcttgccatagaggattctgataagctctgagagttttagaacactctcggtagactccaggaaagaatgaaccacttacctatagacacttacagagaagaatcttgatatatagttgaggccttcattaagcaggtaccgagtagctcaggttttgggccaatggttgtaaccatgacacatacatagattacttagaagcctaattaatggcttaagctccattagatttatttaagtgataagaatctgcctatgtgcaatttttttccctggggcctcctcaaactgcagtccactttatgaaataactttgccttcctagtggactttctttcctttctgagccagttgtattacatagaactctccactttcctggcaacccatgagcacccttgctctctgaagtccctggctgcctaggtatatcaaacacacttgagctgtgtcctggtttctagtggtctgttacctgtctggctagctaattgggtacactatttcaaatggcagataattaggttggtgtaaaagtaattgtggtttttgccattaaaagtaataatttctcaatgtgatgttcttcccagatgttatttgcactcagatgttttgatgtttagcctgattgagaaacacacaacttatattcaggattaatggagccaggttatggggtagggttggtcttgccagggccactcagaccacagcagcacaactgcctctttaccacacaaaggctggtcctacactcaactcagatcattttaaaaacagagagaagccatgaaaaagagggacaaaccaaacaggaatcaggagacctggctcttgagcaggtctgcttttttatctttctaagtttctgaatcagataaaagactcaatgttcatggaaacttctttctgttttgtgttgtgtatgtgtctgctttttttaaaaaaaaaatggaaatagcttgtttttataattataaacccctcacatagaaaactagtaatgtaggaagatatgctccaaaaagcaaaaaattgctggaaacctcacaacctagacctagatatcattaaacttgtaatgatcccccttcacatgtagatatgcctgtttttctctcttgttgtttttaactagatgaagtcatacatacatgatatcgtataacttttcactcaacgttatattctagaggtcttaccacatgaaataatatagctatacttcattactttttaaggatttttaaattttgccattctgtaacttgatgctagtttaaagttgaatgtgatcattacaactgaatcttctcctggaattttttggagagaagcagcatcctgagaatttctcctattagagatcagttcctcagaaatcacctcaaaggcccacctcagcaacctctctgaatatttggaacctggaaattccaacctcattattatggaagtaaagacacaattatctactaaggctgcaaacaagttgaataaaaattattcaaggaacttcaaactagtggttaacggctaaatcccaagtgaataagtaacattttagaaagattctagagccattgttacttcccttttgtcctctccccagtaggctatgtagagcaggttggattgaggtcgccagtatctgttgggatagccgagatgaaagctgagaagtctctgataatatttataacacttgtgtgcatttgtacatggagctatttatttggtacaatgatcatgcctctacccttcctttggaacttaacataactttttaaatagttaaaactttatcattcaacaaaaattagaaattttgagcgatgccaagtaatatatacaggcattcaaaagaatggacactctttctccctttactgctgacttcttattcagtggcctcatttaaaaaatagcaatatatatatacaaatatatgtgtatatgtgtgtatataagtgtacaaaaggcattatagtagtctgtaagaaattatatgatcatttaacatgttgatgtaaaaaattaatgacaaatttatgatatattactaagaaaggttgtaaaacagtatgtaaatgaattgtggttttgtttttataaaaatacgtatagaggcatataaaagacaaaatctagttatcaatggaaggttagtagtggttatcttagtttggtggaatgattagggatattccttttcttctttgtgcttttcaagctttccaagatttctttaatcaatatctaccacttttgtattgagaaactagcttagtttttagagagatgaaatagcccaagtctgaaaccaataaagaaaacctttcaatttttttatgactatcccttccttttagtttctgtatgttgatttcccaagtttagaataatagaaagagtcctaaactagaaatctaaatgcctgcctccctattttttaaattcagtaatttctacctccccatcttccagaaaggctctgggtttcaaaactcgctttaccccactgtttccttctgtatactgttaacctctgtgaacttctgtttccctagtataaaccccacccgtcaaaagtgataaactctttccctttcatttaccaatcgcacatgttcaatttaatgctcatataagacaatagatttgaaagtgtcttgtaaactctaaaacaccaaatgtgaaaggatccttactagcaggtatccttgcgtagttctgtttctgtgatttttgttttgttttgttttttgtttttgtatttcacgactagcgcttgtgtctatctctctctctctttttttttttctcactattttcgtatagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttgataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggtaagtcaaaaataaaagtaggtgtccaaggattttacttttggcgaaatctgacgtctcctgagcttattttcattttgtccttggacatagcatagtgcttccctaatgtttctacatatgaccatgaatgatagtgtctctacatttaatttaaaagtctaatggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaaccaaaaaaaaaaaaggcattagagtcctgtgttattcatggagaccaatatttgatatatcgctttgaaaaaagcaagtaccactaggacttgggatttccaaaataaagtgagcagaataaccacatgtttaatggcttcaacattaaaccacctcctgtagcatgttttaaaaattggtcctgggctttggaaagagctaaggccttatggtctaggagtttccatctcagcttaagtatattgtatccctactattaggacatcaggaaagcaagtgatctagtcctggtctgaagagccatgtaactttaacagacataaaaatatgtacctatagaaatatcatttctacaaagcctactgagacagcactgaagaggcagctagcttggctgactcctctgtgtttgtttctttgtgtcatggcactgactgctttgagattccatttttagatgtggttgatagaggaatggaaaatgaagagttattaaaagacaacattctgtaacctgaaaggtagtcatttttgcaagcttatattttaatattgtgcatttaacaaaatagaacacagttaaactgtgctttatcgtattcaaggacttcataaagaataagagagaagattagtaagccaagaatggaataaataccatgactaggaattttgctttcagagcttatgtttcctctgtagatgtgataaccaaaaaccagtgcaagttttgaaacataatttagctggcaaatgcacagtgatggaaattagtaatgactgatggagagccgtacatacctgttgctccttatcctttcagaatggctgctttggcagatctgcctgtgctgggagctactcaacatcacttcattttcatctggacctagtgagagtccctttgcctaacgaatttctgaaatttatttatttactagaccccttataatattcatggctttaaaaaatgacacagcatctttattttattacatgtcaattttattaataatatttaggggtttttttaaattataaaaatggcacatgctttttataaaatgttttaataccacagatgagtatcacatccacagtcaaggcatccctttgttctggtgttgtgtcccacttcccaaaaataaatacggttaacactgatgaacactgttgcttg

SEQ ID NO: 12901 - DNA, 64923 bp, Human
agaaattaggtccctagtgttctattcctgacttggccactgatttactacatgaccttaggaaaatatttctagacctcagttttcttacctgagagggtgagatgaaatgatcttgcaagtctttacacaaaatcaaaagagtaaaaccaaattcatccttctaattgatttgcaggagctctttgtgtattataaatgttaaccctttcccataatattgtaagtttccttaactgagagttttctgtatggtcagcattatattagaagtttcagattagtcaaggaggtgtctgatcatttacctcccaaagggagtaacagtgttagataatatatttttaacatttcacagattgctttacattttttaacacattgaatcttcaacagtcctaaggagggtaggtactcctatcattcccatgttccagataagaaaactgaagcactgaaaagtttagtcttctgctcattgcctcatagccaacaaggggcagaggtaggattccactcaagaaatattgctccagagcctattgctcttaaccatcatgatctgctatctcagttgattcatttagataggtgggctctggaatgtattaaaaatttggtatgatttatacacaacaactggagggaatctgacccttgtgtagactacggcttgcaaatgtattttagggaacttcttaaaaggcaaagtggaactgagagcatttgagggcagggattggaaatttctgtccccaagagattgcccttgtgtagcccagctcagtggaagaaagttgagcttcttcatagccaatcgttggaggttcattgggggtgggaaggttgcaaaagagtgaagtaagaggacacttgtgcatcttcgaggcaagctgtgcagttctatgagttatacacataaaagcctcaaaacaacgggtcaggggagcgggagagggcaggtgagagtgagtcatctgggctggatgactctggcctatggacttgtcctactttgaggccattgctctctgttccctgctgcagcctccaccctcctaaatctccatcctaatagcttggcatgaggaactttagtgaaattttctatcagttcatgatgccagtgtcattctccttagggcatctgatggtggctaacagccatgtgggcagagcttaccattcccccacctccagccccaggcaatggctgcactcttccaaaggtgtcagtttactcctatttatttagcccttggctggagagagtagaaagatgatcggatagtgcccatctcttcaagagtgctccaggcagcacatttcaggtgggagaggccctgtggcaaggaaggcagcagaatccagagaagacaagggatgcaatgccattttgggtcggggaagcagagaagtagtggaccttccatgtccagtttgggcctctaattgccagctcaaaacactgcattccccagtagggactttgtgtttgtgtttttgtccttgggaaccttgcatttctgatgtgaatcttggtttctgggttggagcttgacattctacttgggcccatttttttatttcaaagctgggaaagccgctgagacctacctccatcacctttgcctctataccccacacaggctgtaagcacatgatctttggtcttttatttgcatactctattagtcttgtcttcattggagggaagtgactggtcagacctgggctgtgttgctggctgccttccttgttgggctccaacttacctcctatgtacacagcccttggagttcagaggcctctcctgacctctgcccaacctctcgccctctgcacccaataccccactagtacatacaggagcagaggcaggctaggaccagaggaaagaagagaggggactgaagacagactttgagagggctcagaaacccagtacaccccctgtcccagccctgtccacctgctgctgtggccacagcgagagaaaagacagctagtaagataggaagtgaggccaggtaccttgtgggcagtgatgtcattcggtgcgactcctaagatgtctccagagatgggagagctcacccaaaccaggttgcagaagatctggattccacacagcagcggcagcagcaggctgcaacggagaaggggctgtaagtggggtttgcttccgtgggtttaaaggtggtggtggtagagtgggtgtagaagagcaaaggatgcacctccccttgccatccactcctacctcaacctaaaagttggaatagatgaacaactggatgaaatagaggctagtgtcaaaaacgtgaggaaaagaatgagagagaagacaggcggaaagagagatgaagacaaaggaggattaggttaagaccatcttaatcagagggatctttaggaacttttcctttcttatgcagagcttgtttggaatgcttcttgtttggaatttaagatttctagtttaggactgttcagtgatagcctagtatgtttcattttggtgacttctgtgaagtgtctgggagttggtcttgcctgactgatagtgcctgggtgaaataaggtgatggctcctggcatcatctttcaggggacaggtgctgggtacacaacagtgccatgtcactggtcagtattgctcctctcctttctcaggccttttctgagtctatacctgcctaggttgggaaacacttaatgtcctgtctccagtgttgccttcctggcacatatggacttccttgctgctctggaaatttgagagaggcagtctctcagggccagcccactggtgtggtgctcactttggaaatttaagaaagatcaagggcaaaacaaaacctgtacatatttaaaacaaaatctggagtgtaccatttcccatagataacaggcgacagtggtggaccaaggtgcatccagcccagggattgtggcctgagtggccataaggtgggttaagataaggcagctgtggactgtgggactcagacaccccaaaggccagctaaccaagtttccagtctgctaatgctagaggaggcccaggcttagggatattgggggtagcagtagttgcttagaggatctaggagcatataggatgttaaatatagttataatatacaggaggtagggtgtgggtggaggaagagagagaaaaaagactaggctcctattctctctctttcttatctccaccagctctctcactcactcatctggagatctaggagcctggagactgagaggtaccctcgcccagccagccactcttggccttttccaaggggctgtttagttgacaaacaagcaagccattctctgcatacacgggtcctccagagctagaatgcttatagtcctgggaactgtgtctttcaagttggagagataatatacataaatcacctaatatagtctctatcaaatagaaggtgaaaaataaatatgtgcttacttttgtttggagtgtcactttcctcagctataaaacaggattaatgcctgcaacccagtgttattgggagtaattcactgattcagaggttctggatccagactgcctaggtttgagttccagctctatctccccctgtgtctgtgaccttggacaactctcttaacctctcttggcttctgtttcctcacttgtaaaaggaagttaataacagtgtagttgtgaagattaaatgaactggagcatgggatgtgcttagaagagtgtccagcacatagtacatacgcagtaattgttaattatcctaattattattgttcttgttatataaacaagaaagcgggtgtgtggtcttatttaccatcatatcctcaacatcaggccctgatcctggctcatagtagatgctcagtaaatggtcactctgtgctacttccactctaccactcaccatagccaagaatggggctctgtgtgtacaagacagtcactcattaatatttgactaaattttatcagaccatagatgcaaaaaacttagatagtggttgccaagtctggacaatgtctggttcacttcttgctagggaggccagtctattggtccctgtaaggtctgaatcacctttttcttggagcatcctctctagcagacacacagttacttaatgttattttgaagattaaatacattaacatgtaaagtacttgaacagctgtgcatattcttttctcatccaacattatgtttatgcgaaccacccattttatcgttgcaagcagttgtagtttgtttattccccttgtgaatatcccacagtttatccatcttactattgttgagcatttggttagtttctaatttttgattatgaagaataatccaatgggcattcttgtacctttatcctggtagagcaagtcccttcatcttgtccttcttatggagtgtcttggctattcttggtccaatgcccttctccataaattttggaatcagctttccaagttacacacatatacaaacacacacacacacacacacacacacacacagagagagagagggagagagagagagagaacttttgggattttgatggaaattacattcaatctgtaaatcagtcaatttgaggagagttgccatctttgtgacattgagtcttccctaaacacggtatatcactccatatattcagactttttcatgttgagtgaagttttataatttaatctataaaaggtttgcatgccattgtaagatttttttggcttattttttgttgctatcttaaacagtacctttttagaaaattaaattttatagcagtatgttgctaatgtatacaactgtatttgtttttcatgtaatgaatttgtaactagcaaacctgctaaactttcttatgagttttgataatttgtatgtaaatgacagctttcattttccccacaaccctcatttttatctttcttatattattacactgctaagacctcccgcctttaatatacacacacgagatgtgcagtacacgttgaaaagaaatgttaataatgtatattcttatgctgatcccgattttaagtttcaccattgagcaaatttgctgtagtttttttggtagatatcatttaataggttaaagacgttcctgtttattctgagtttgccaatacaatttttaaaagatgaatgaatattgaattttattaaacatgttttctgtattcactgaaatgacattaattttctattttaacccattaatgtggtacaatacattagagtttttcttgtgttgaaataatcttgcagtcctgggataaataaaaacttctgaatttctttcactaattttttgtttaggattttagcattttgctcaggaaagagattggcctgtgatttttccaagagtgtcaagattacactaacctcataaaatcaggtgggaactatttcctttcattctgtcctctgacagaggttgtctgcagaactagccattcctcaaatattttacctggcagcatttccaggtaaaatatctggacctggtgtctcctttaacattttaactgatacaatctcttttatcagttatagagtcctttcagtttgctatttccactaaagttagctttcttaagctttcctaagttatggttttctatgaatttttctacttcacatagttttcaaatttattttgtgtaaagttcttatctttgtatcttttttatctctgttgcatttgtagttatagcttctctttcattataatattatttatttgcaccttttttctcttgatcaatcttgctataagtttgacacttttataattctaaaataatcaacttttgactttttgatccttttttatctttattttctatttaactattttttcatcattattctgtttctcctactttctttggatttattctgttgttcttttttaactcatagagttgcctgctgctcagctcattcattttcagactttcttcttttctaatttaagtgtccaatgagataattggcctactaaacagggctgatattccacagattcacaatcgtatggccatatgaattttcagaatatttctagtccattttataaataggcactctcccaggcttttttagtctctccaacacttacccagttaccctggccacctcaattcctttcccaggatagccaggacctactgattatcatctagcaactaaaggattaatgcctaccacagcaggaggcctccagtacttggtgccagcccttggaccagcttctgttttgatagatcagtgctcttgtcatttctattttaattccattctggtcagagaacaaactttgtattatttcagttctttgaaatctgttgagacttgctttatggaccaacttatggacaatctggtaaatgttccaagagcacttgaaaagaatgtgcgttttacagttgtgtttagtgtactatatacctcgattaagttgtgtttgttaatctggctcaaatgttctatattcttctggggttttggctgcctgttgatatggaaaatttgttaatgtttccttgtaattctgtcaatcttgaaagttcgtagttacaaacaaatttagaattgctatatcttccttgtgaattgaatattttatcaccatgtaaggaaattattaactctggtaatacctggtaatttggtatcattgatgtttttgccctataatcaatcttttttctcatattaatatacctacattagctttatttagcttaatatttgcctggtatgtgttttcctacatttaaaaaattgtttttgatagagatataattcacataccataaaattcaccattttgaagtatacagtggttttgagtatattcacatagttgtgtaaccatcaccactaattccaggacattttctttatgccaaaaaggaattccatactctagactcactccagatgaccctctccccttagcccctggcaaccactaatctactttcagtctcaatgaatttgcctattctggacattttatataaggggaatcatacaatatgtggccttttgtatctggctcgtttctttgggcatgttttcaaggttaatccatgttgtagcatgcaaagtcacaaagatatatgcctaggcttttttctaagagttttatagtcttggctcttacatttaggtttttcaatttattctgagttaatatttgcatgtggtgtgagatgggaatccagcttcgttcttttgcatgtggctatccagttgtcctagcagcattttttgaaaagactcttctttcccctacttaattgtcttggcacccttgatgaaaatcaggtgactataagttgaagggtttacttctgggctctcagttctattccatttgtttatatgtatctctacccttataccagtaccacacattcttgattattgtagtttaattgtaattttgaaattgggaagtatgtcttctaattttggtctttttcagattgtttttatgattgttttggctattctaggtcctttgcatttccatataaattttaagaccaatttattaatttctgcaaagaattaagctgaaactttgacagaagctgcatttaatctatagattagttagggaatattaccatcttaacaataataagttttaggtccctgaacatgagatgttgttgcatttacttaggtctttaattatattcaccaatgttttgcagttttcagagtgttttacattttttaaagtgttcttttaagcattttattgttttgatgctattgtaaataaaattgttttacttaatttcattttgtttgctcatggctactttatagaaatgtaattgatttttatatattgatcttatattctgcaacattgctggactcatttattaggtccaatggtgttttttagtgcattccttgggattttctatatacaagattatgttatctgcaaatagaaataatttcatctcttcctttccaatccagatgccttttattttctttttcttacctaattaccttggctataacctctactagaatgttgaaaagatgagatgaaaacagacatccttctgttgttactgatcttggcaggcggcatgggagaaactattcaatctttcaccattaagtgtgatattcactgtgggtttttcattggtgtcttttattaggtttagggcctttccttctagttttaatttgttgttggttttatcatgaaggggtatttaatttcccaaatgctttatctgtgcctattatgatgatcatttggtttttttgtccttaattctattgatgtgatctgttgcattaattgattttcaaaggttaaatcaagcttgcattcctataataaatctaacttgattgtgatgtaaaaagtataagtataatatatacatatatataatgtatacatataaatccttttatacattcctgggttcagtttgctagtgttttgtggggatttttacatccatattcacaacagctattggtctataattttcttttcttctaatatatgtgcctaactttggtagcacggaaatactggcctcatagaatgagttgggaagtgcttcttcctcttctactttttgaaagagcttttgaagaatcgtattattctttaaatgtttgtagaattcaccagtgaaaccatctaatcctggacttttctttctggcaaggtttttcattacttattcaaccccttgttatagatctatttagatttcatttcttttttagtcagttttgagagtttgtatcattctaataatttatctatttcacctaaggcatttattgtgttggcatacagtttatgattgttcataatattcccttataattctttttattttcataaagtcagtagtaatgtctcctctttttttcctgaatttattaatttgagttttctcttttttttcttggtcagtctcactaaaggtttgtcaagtttattaattttttcaaataaccaacttttgattttgttgatttttttctaatgttttcctagtctctgttttattattttcacctctaatccttattatatccttcttctgtttcctttaggttcccatatttgtgaatttcccaaagttctctctgttattaattttttattttactccattatgattggagaacatactttatatgatttccattcttccaaatttattgaagcttcttttatggcctagaatattgtctctcttggagcatgtttgatgtacactttggaaaaatgtatagtctgctgtttggagatggagtgttttacagatgtttgttattactactttgtgttgaagtcctctatttccctgttgttgatcttctatgtagttgttctatccattattgaaagagtggtcttgaagtttccaactattgtcagtggattgtctatttctcccttcaattctgccagttttgcttcatgtatttggcagctctgttgtttaggcatatacgtttatacttgtgatatattcattatggattgacccttttgtcattattgaatgtccctatatatctctagtaatgtttttgaacatccattttgtctcatattagtatggtcactccaaatttcttgtggttgttgtttgcatgatgtattacttacgttattttacttttaatctatttgcttctttctcttttttcttctttcttttttagaatagagatggagtctcactatgttgcccaggctggtctcaaacttctggactcaagggatcctcccaccttggtttcccaaagtgctcggattataggcgtgagccaccaggcctgccttgtatctttcagtctaaaacctatcttctgtaggcagcatgcagttggatcttgtttgtttgtattcagttagatattctctaccttttgattgggttgattaatctgttctgatttaaaatcattattgatatagttggtttaaatatgcagttttatttttccatagagctcatgtctttttctctctattcttcctttactgctttcttttgcattaaatgaattattctagtttaactttttaattcatttgatcattttttattatatattttttaggtatattcttcgtggttgttctagggcttttcacatacatcatacatcagtgtgcttcagatttgtactaatttaatttcaatgagatataaaaattttactcatatatagctctctttcaccttcctttttgagctattataatatatatattatatctgtatatgctaaaaactaaataatacatcattataagtattattttatataattttatgttttaaggaagctgagaaaattaaggagaacatgtatgtatttattattttctattattttcatttgttcctgtgggtttgaattaccttctggtatcatttccttatttctatataactctttgctttgtgacttggctaggctatttttaaagtatgtttccctgcagtgtgaacccttcagtgttgcttcttggagtgcatagtttttggcttgcaggtaatttgggctttctttgactttttcccagtctctctattaagctgtcagcccacatgggggtattacactctaggctccactaattactagctgaatgctgtattttgtttttgttttttgtttgtttgtttgtttggcagtgtcctgaagcatgcattgcccagcagccttatctaattaaactctagcaggagtagtttgtgaagtaagtcttggaggtttcttcataccccagaagggctcttcttacctgtccctctctctcttgttctctctgatgaacaagctggcctatgttgctgttagttaagtgaacttgtagtttttgagaacatccttgggcttgagcttctttgtactatgttaaaaataaagttagttttggggggagagtttcagagctctctcatcttatgaatttcttctctccatgggtatactgtctgagcactgttctgggtgctgggcgagacagcagcttctggtcttagtttgcctatcctggtgtggaacctaccctgtgagcaagatggaatgagggtaatcaggacctcagtattcttagcctattgcacctggtatatagcctccattctatgagtaaaaactgggaggaggaagggatcctccaacctcttaaccacacttgccaggaatttagcctctgcaattctgagctgaagggaatgctaaatgctagctctctgctccttccagtaagatgccaaagtattgatgggacattctctccaagacgaaagggagcttcatcttggctatacacaccttaagtggagcttctatcaagctaagcttggagccagtagtgaggggacagtagtaaggtcgggaacagtagcatggcacatgtatcaaagactgtgttcttaccacatttcagtagattttcttgaataaaaatatcttcatgtactgtattccattaagacaatttccagagattttaaaaggttgttgtgttgtaattttgccagctgagcttgttttattagagaatgggtctttagagctcctcatgctgtcatgccagaaatgaaagtctcaagattgtctttgtgtgttgatcttgtatcttgcagccttgatgaactcacttgttagttcgaggaatttctgtagtttagggggatatttctatgtagacaatcatgacatttgcaaatagggattttttaaaaattattttccaaaccgtatgccttttatttccttttattgccttattgcagtggttagaacttctagtactatgtcaaaagagtggagaaggtggaaatccttacattagtcctgatgttagggggaaagcatttagtctttcacttttaagtataatgttggtgatagtttttgtttgctttatagaagtttcttatcaagttgaacttaaacaaatttacaagaaaaaaacaaccctattaaaaagtgggcaaaggacatgaacagacacttttcaaaagaagacacacatacagccaacaagcatatgaaaaaatgctcaacatcactgatcattagggaaatgcaaatcaaagccacagtgagataccatctcacaccagtcagaatggctatcataaaaaagtcaaaaaataacagatactggtgagattgcagaagaaagtgaatgtttatacactgctggtgggaatgtaaattagctcaaccatgtggaaagcagtgtagtgattcatcaaagagctaaaaacagaactaccattcaacccagcaatcccattactgggtatatacccaaggggatataaatcgttctattataaagacacatgcagacatatgttcattgcagcactattcacaataccaaagacatggaatcaacctaaatgtccatcagtgatagactggataaagaaaatgtagtatgtgtatgccgtggaatactatgcagccataaaaaagaatgacatcatgtcctttgcagggacatggatgctggaggccattatacttagcaacctaaaaggaacagaaaaccaaatactgcatgttctcccttgtaagtgggagctaaatgatgagaacacatggacatagaggggaacaacacacatttgagacctacctgagggtggagggtgggagaagggaaaagatcaggaagaataactaatgggtgctagttaataggtaataggtacacctgggtgacaaaataatctgtacaacaaactcttgtgacattaatttatctcactaagaaacttgcacatgtacctctgaacttaaaataaaaaataaaaatataaaatcttaagcttaaccattcagaaaccaccaactaacctctaactatggactttctactttaagcaatcaaatatttatttcgtctttcttctgagaacaccttataaaagttttctcttgatccccctcagtggagccctgaactgcttgtgtattgtgcttcccaattcacaaattgctgaatgctcaaactcattaaaattatttaaagaaaggagtgcctatcaagtttaggtaattcatctctattcctaacttgctgaaagtttttatcattaataggttttatgaagtgctttgtcagtatgtatttatttttcttctttagtttgttgatagggtggattacattaattgattttttgaattttattctagtcttgcatacctgtactaaatcccacttaatcattgcatatacagtcatccctcagtatctgcagaggattggttctaggaacccctgcagataccaaaatccatgaatgctcaagtcccttttataaaatggcctagtgtttgcatataacttacacatatcctctcatttactttaaatcatctgtagattatacctaacacaatgtaaatgctatgtaaatggttgttatactgtattgctttttatttgtagtgttttattcttgttatttttattgtttttaaaagtattttctatctgctgttggttgaatctgcagatgtggaacccacagatatggaggactgactgtaattattttcatgtaatgttggattctgtctgccaatattttgttgaggattttttcatctaagtttatgacagagtggactatagagtttttgggtttttggtaattcatttgtctggttttgatatcagggtaattctggcctcataaaattagttgaaaatattccctcctcttcttatttctttgaaaatgttgtttaaaatttgcattaattcttctttaaaagtgttacagacttttgaagtaaacacatttgggtctggagatttctatttctggagattttatgttgaactaaattattttaatgtttataggattattcgagtgcctgttttatttttggttgacttgtgagaggctgtggttttcaaggaattgatccatatattctaaatagataaatttacaagtgtaaagttgtttgtagtagttaagtattaaatagcttctggcatccagtgctttccgcacgagataagcaaatttcagatgctttctctctctctgaaagtgcctgactcttcagatttcaaggtagtagttttctctatggcctcagttctctaatgggtcccagaaaagtcattgattttcagtgtgacccaatttttcttattgtaaagatgagaataagaactcccaagctcttggaactgaaactagaagttccttgcttagttgttttataaacccatgaaatagacatttttattgttgtttctcaagtcagtgttggcttagtttgacacacatgtttaccattttacttgctcaccatttcttcttgtctcttagccctttcttttggtactatttttcttctgtctgaggtacattccatagaacccttattgagggtctgttggtgataaattctcttagagttgtttgcatgaaaatgtgtttatggcatcctcattcttgaagagacttatttctgagtatacaattctgggttaaaagttattttctcatagaacttcagtaatattatttcactatctctggttttcattattgttgttgagaagtcaactgcgaatctaattgttactcattaggtaaactgtcttttatctttgattgctttttaagatctattcagctttagtgttctgaaattttattatgatttttctaaatgttgcttgtttttttttgtttgtttgttttgtttaaagttgggcttccctaacttgaggactggtatctttcatcaattcttttctttctggaactgtaattaaacccatggtagactttatcattctagccatgtgttttaatctctattttatatttccatatcttgttattcctacagtactttctatataatttcttcagatttattttccagttcattaattatctcatcacctctgtttaatttgctgtttaaccctcatacattgagtttttaattttaatgctctcatttctaatttctagaagctgtatttgattcttttaaaaattcatgtagtctttctttgatagtctcacatttcgttgacatactgttgataccttcttcatttctttaaacatacaaccaatgcttatttcacagtataaatcagataattccaattatagcttttgcaattctgattctttggtttgtttctgtggattcttattcatacaggtttttcgtgtgtgtgtgtgtgtgtgtgtgtgtgtgtgtgtgtgtgtgtgtgttggctttttttcttcctacacgggtaatgtacatcccagccccaaacccacataaatgcaggactgggctaggaaatctcaggaactgttcactcttttgtttccctccacgattgagccaaggttgagacagtctcagttaggtgcttcttcttcacccgctgattacgtcacctttgtctggtccacactttagtcaggctctcagatccaacttcctactttgagcccaaagagttttgtttactatcttctatacgtgctatctcttaaagcccaagttttaagccagaaatgtgtcaatcctttgacaatggcccagagaagaaacattgttttttactttgccactcaataaacacacacgtttgtgtgtgtgtgtgtgtgtgtgtatgttaaatcaaaaaatatgctttttatgatccactgtattattgtgtcaactactgtgtaataaattaacctcaaaacgtagtggcttaaaacagcaaacatctattttgtctgtttctgtgggtcagagatcagtgcacagctcagctgggtcctctggctcagtatctctaataaggctacaatcaaggtattggctgaagctttggtcatctcaaggttctactgggtaggagtgagtggatagggatccacttccaacttactcacaaggttgttggcaagattcagttcctcataacatattggaatgaggtccttagtttctcactagctcttgaccagagatcatcctcaacttcttgccatgtgggtctctccctagggaagctcacaacatgacagctggcttccaacagagcaagtcaatgagagagccaaagaggaccaacaaaatggacggccagtctttttgtgataaaatctcaggagtgatatcccatcacttttgccttattttatgggttaaaaacaagtcactagattcagcccacactcaaaagtaggtgactacacaatgtcatgaataacaagaggtatggatcattaagggtgatattgtatgctgcctattgcacccactgaattgatttcatgtttgtgaaacactgctccaggctaccagggtaaacatggattttagtgcttttttatctctttagatcagtaattattttctcattcctggcctctgaggatttctgttggtttcacaccagctcagccatgctttatttgttttaaatccattatttttaggtgttttgtatttggaaggactctttacaaatatagcctaaaatatcaccagaaatagaaatctctcttctatattctaccatatacaacttgagtaagataccgtactacttaaaattacctgaaagtttacagaagagcttgaggaaaatgtgaccagctgtcataagatccttttctaaaaacatgattaggtgataggataaataagagttttatccacctgaagtgtctagataggaagggaaagcattcaggaagtgaatggctactacctaagtctgtcctgggagtaagcttttttattttttagctttttatttttaaataattttagatttacagaacaattgtagaattgctgtatacctttcattcagcttccaccaatgttatcactttacataagcatggtatatttgtcaaaactaataaattaacatgggtaagttactattaactaaactacataatttattcagacttcttcagttttttcactaacgtcctttatatgttccaggatccaatccagcataccacgttgggattaattgtcttatttccttagaatcatccaatctgtgacagcttttcagtctttccttgtttttcataactttgacaattttggtcaagtgttttgtgaaatgaccttcaatttgagattttctgatattttctcatgtttagactggggctgtgggttttaaggagaataccatagaggtgaggtatccttctcatcacatcacatcagagggaagatgatatcaacatgacttattgctgatgatattaaccttgaactgttagattagttgtggtctgccaggttactatttgtctttcccatactgtattctttggaagtgaatcattatgtccagcccacactcaaggggaaggaaattaaatgccaccccctagagggagaagtatcaactaatttgtggaaatttattaaaaacactgtaataatttgggtaaaattatttgagcctatgcaactcttcagattctccttaaagtttcactcactaattttagcatgaatcagtggattgtgcctgtggcaattattacagtagtgttctaatgatgattttctgcttcccttatttattctacatttattatttggaatccctctataaagatttttcctttctcccctacttatttattcaacaatgtatatatataagtgtgtactcataaatatttaattatttgggttataatactcaacttatttattttgttggtcaccttgtcccagctttgcccattaggaactctttcatattggcttctgcgttctgttctatttttagtagactttatattttacagtagttttaggtttgcagcaaaattgagcagaaggtaccaagatttcccatattctcccttcctcccctccacatgcatagcctctcccattatcaatagccactgccacaggggtatttgttacaaatgatgaacctacattgacacattgctatcacccagagtccatagtttactttagggttcactcttggagttgcacattctataggcttgagcaaatttataatgacatgtatgcagtattaaagtagtttccctgccctaagaatcctctttgctccacttattcatccctgtcttttcccctcctgtgtccctttgatatacttctattctccttatttttctagcacttcgttacttttttacaagataacaccagcctcttctccaagaaaccatggttcctgtaattgaaaattggtatttggaaaccaagatctggatgcttttgttacttttagggtatcattaattctagcccgctcagcagacagagctaagaaatatttgtgtgcatgctaacccgtctgtattttgatgtctatttatatatacgttaaaaataaacatgagttaataccatttctgaccctaaattgcactataaggcatcattctagaccttctcccttgtttactatgagcttctttcttagactgtgaaatacctgactctcattatctacaagttatttatttatttatttatttgtttgtttgtttgtttatttatttattccaccctactacactggtagtttcagaattgttaactcatacccctgggagaaacaattttatcaattagagtacagtgtctacacacaattactttctgtcattagtcttaaaatattcagcaaaacactattttcgtggttatttatttcaggttttctttctccaccccatttagtgagattatgatatatatacttgtaatatagttagaaccatttgttgcaaactgcattcaatattgagttgctcagacattttggttgatttataaaaacttgaatgcaataaaattcagttttgtgagttttgacaaacgtataaagtcagatatcctcttccatagtaccgtatagaacaattccatcaccctaaaaattctcctgtacagcccattatagtcaacccttcagacctcccccaacccctggcaactactgagcagttctctgttcctataattttgccttgtccaggatgtcatataaatggaattatatcacatgtcagcttttggatatggcttctttctcttagcataatgcatttaagattcatcctagctgtatgaatatcaacagttatcttaattgccgtatggtattctagtttatgattgtaccacaatttgtttatccattcaccaactgaagagcatcttggttgtttccagtttttagtgatttttagtaaggctccataaatattctcatatacatttttgtgtaaacttgatttttcaattcccttccaaaggtatctatgagtgaaaatgctgggtcatatgtcaagtgtatgttaaattttaaaagtaactgccaaactgttttccaaaatgcctgaaccattttgcatttccactagcaatgagtgagagttccttttgtaatacatccttgccagcatttcatattgtcatgtaaatttatatgtgtatttaattctagccattttaatagctgtatcttgaagtgtttctcattacacatttaattttcattttcccaatgattgatattatcttttaatacacttgtttgccatctgtacatttgggttggtgaaatgtttgttcagatgctttgctaatttttaaaactaaattttatcttttattgttcagttttaagtgttatttatatattttggatataccagatatataatgtacaagtatattctttcattctgtggcatttttcattcctttgtgtctttcacagataaaaaaatgttaatatgtaaatatttaacaatttttattttaaaatttttcgtaaataaaaatgtttaaatttttatagttcaatttatctatttttttcttgtgtggataatgctttttgtgatgtaactaaaaactaattggcatatccaatattttacattctctcccaagtcctttttttagaagttttatagttttacattttatatttagacctatgatccactttgaattattttttgggtaaggtttaagtattcaagttcattttttgcagtggacttccaatcgttctagcaccatttgttgaaaagactctattttctctattgaattgactttgtacctttgtccaaaattagttgactttgtccaaaatttgagtgggtctatttctgggctctttattctatttcattgatctagattgctatcctttttccaataccacactgtcctgagtattgtggctttataataagtctcaaaatcatgtagtaaagttcagtccaccaacattgttttatttatttatttattttcaatagtttttagggtacagatggtttttggttacatgggtaagttgtttagtgatggtttctgagattttggtgcatccgtcacctgagcagtgtacactggccccaatgtgcagtcttttatcactcaccctccttccatccttccccgcaagtccccagagtccattatatcattcttacccctttgcatcttcataacttagctcccacttataagtgagaacataacaatatttggtttttcattcctaagcgacttcacttaaaaaaatggccaccatctccatccaagttgctgcaaaggccattatttcattctgttttatggctgagtagtattccatggtgtatatataccatggtatatgatataaagaaaatggatacattttctttatccactcgttggatgatgagcatttaagttgattccatagttttgcaattgtgaagtgtgctgctataaacatgcgtgtgcacatgtctttttcatataatcacttcctttcctctgggtagatacctagtagtgggattgctggatcaaatggtagttctacttttagttctttaaggaatctccatactgttttccacagtggttgtactagtttacattcctaccagcactataaaagtgtttccttttcaccacatccatgccaagatgtatttttttttatttttaaattatggccattcttgcaggagtaaggtggtatctcattgtggttttaatttgcatttccctgaaagatagtgatgttgagcattttttcatgtgtttgttcgctgtttatatatcttcttttgagaattctatattcatgtcctttgcccactttttgatgggattatttgttttttcttgctgagttgttttgagtttcttgtatattctggatgttagtcctttatcaaatgcatagtttgcgaatattttctcccactctgttggttgtctgtttactctgctgattatttcttctactgcacagaagcattttagtttaattatgtcccatttatttatttttatttttgttgcatttgcttttgggctcttagtcatgaattctttgcctaagccaatgtctagaagagttttcccaatgttatcttgtaaaatttttatgatttcaggtctgaggtataggtctttgatccatcttgagttgatttttgtataaagtgagagaggagggtccagttttattcttctatatgtggcttgccaattatcccagcatcattaattgaatagggtatcatttccctactttatgttattgcatgctttgttaaagatcagttagctgtaagtatttggctttatttctgggttccgaattttgttccattgctctatgtgcctgtttttataccagtaccatgctgttttggtaactatagccttgcagtataatttgaagtttcagcaacattgtttttattttgcaaattgttttggccattgtagtttcttagcccttccatatgagtttcaggatcagcttgtctatatctaaaatatcctgatagggtttttattggtattgtgttacgtatataggtcactttggggagaatagacatctttaccatattgagtattccagtccatgaacacagtatgtctatttatgtagctctttgattttttaacaacattttgtaatttccagcatacagatcttttatacatgttttattggtgttatacctaaagattttgtcttattagaactattgtaaattttttttaactttgattttgaattgcttacagaactctccaccccaaatcaacagaatatacattttttccagcaccacaccacacctattccaaaattgaccacatagttggaagtaaagctgtcctcggcaaatgtaaaagaacagaaattataacaaactgtctctcagaccacagtgcaatcaaactagaactcaggattaagaaactcactcaaaactgctcacctacatggaaactgaacaacctgctcctgaatgactactgggtacataacgaaatgaaggcagaaataaagatgttctttgaaaccaacgagaacaagacacaacataacagaatctctgggacgcattcaaagcagtgtgtagagggaaatttatagcactaaatgcccacaagagaaagcagggaaagatccaaaatggacaccctaacatcacaattaaaagaactaggaaaagcaaggagcaaacacattcaaaagctagcagaaggcaagaaataactaagatcagagcagaactgaagaaaatagagacacaaaaaacccttcaaaaaattaatgaatccaggagctggttttttgaaaggatcaacaaaattgatagaccgctagcaagactaataaagaggaaaagggagaagaagcaaatagacgcaataaaaaatgataaaggggatatcaccaccgatcccacagaaatacaaactaccgtcagagaatactacgaacacctctatgcaaataaactagaaaatctagaagaaatggatacattcctcgacacataaacaccctcccaagactaaaccaggaagaagttgaatctctgaatagaccaataacaggctctgaaattgtagcaataatcaatagcttaccaaccaaaaagagtccaggaccagatggattcacagccgaattctaccagaggtacaaggaggaactggtaccattccgtctgaaactattccaatcaatagaaaaagagggaatcctctttaactcatttgatgagacgagcatcatcctgataccaaagccgagcagagacacaaccaaaaaagagaattttagatcaatatccttgatgaacattgatgcaaaaatcctcaataaaatactggcaaaccaaatccagcagcacatcaaaaagcttatccaccatgctcaagtgggcttcatccctgggatgcaaggccagttcaatatatggaaatcaataaatgtaatccagcatataaacagaaccaaagacaaaaaccacatgattatctcaatagatgcagaaaaggcctttgacaaaattcaacagcccttcatgctaaaaactctcaataaattaggtattggtgggacgtatctcaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcatcccaaaatctccttaagctgataagcaacttcagcaaagtgtcaggatacaaaatcaatgtacaaaaatcaccagcattcttatacaccaataacagacaaacagagagccaaatcatgagtgaactcccattcacaattgcttcaaagagaataaaatacctaggaatccaacttacaagggatgtgaaggacttcttcaaggagaactacaaaccactgctcaatgaaataaaagaggacacaaacaaatggaagaacattccatgctcatgggtaggaagaatcaatatcatgaagatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgctacctgacttcaaactatactacaagcctacagtaaccaaaacagcatggtactggtaccaaaacagagatatagatcaatggaacagaacagagccctcagaaataatgccgcatatctacaactatctgatctttgacaaacctgagaaaaataagcaatggggaaaggattccctatttaataaatgatgctgggaaaactggctagccatatgtagaaagctgaaactggatcccttccttacaccttatacaaaaattaattcaagatggatgaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagactgaacaggcaacctacaaaatgggagaaaattttcacaacctactcatctgacaaagggctaatatccagaatctacaatgaactcaaacaaatcgacaagaaaaaaacaaacaaccccatcaaaaagtgggtgaaggacatcaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactggaaactagttcaaccattgtggaattcagtgtggcgattcctcagggatctagaactagaaatgccatttgacccagccatcccattactgggtatatacccaaaggactataaatcatgctgctataaagacacatggacacgtctgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatctcaagaacaaaaaaccaaacaccgcatattctcactcataggtgcaaattgaacaatgagaacacatggacacaggaaggggaacatcacactctggggcctgttgtggggtggggggaggggggagggatagcattaggagatatacctaatgatagatgacgagttaatgggtgcagcacaccagcatgcacatgtatacatatgtaactaacctgcacattgtgcacatgtaccctaaaacttaaagtataataataataaaactaaaaaaataaaaaaatgaattattgattgtatataatattatgattgacttttatgtgttgacattgtatcctgtgaacttgataaacttgcttattggtactagaaaggtttttaaaaatagattttgggccggctgcagtggctcatgcctataatcccagcactttgggagactgaggtgggcagatcacttgaggccaagagttcgagaccagcctggccaacatggtgaaaccccatctctactaaaaatacaaaaattagccaagtgtggtggcacatgcctgtaatcccagctactatgaaggctgagtcataagaagcccttgaacctcggaagcagaggttgcagtgagccgtgatcatggcactgcactccagcctgggtgacagagcaagactgtgtctcaaaaaataaaacataaaataaattatagatttcctgggattttctacacagacaatcatattatggatgaacagggacagatttatttcttcctttacaatttgcatgccttatattacctttcttgccttataatattgactgggagttacaatactatgttgaatgggagtcgtgagagtggacatccttgccttgttcctgatattagagagaaagcatttagtctgtcaacataaagtatgacattagctgtagattttttgtaaatattctttatctggttaaggaagctcccttctattccaaattgctaagagttttattacgaatggatattgtattttgtaaaaagtttttttcatctgctgatataatttggggcatcttaatctattttgtgctgctaaaacagaataccacagactggctaatttataaagaacagagatttatttcttacagttctggaggctgggaagtccaagatcacgtggccacatctggtgagggccttcttgctgcatcatcccattgtggaaggtgaaagggcaagagagagtgtgcttatgtgcgtgcctgtgcatgcgagtgtgggggccaaacttatccttttatcaggaactgttttctgagttaactaaaccattccattattaatgccattaattcattcatgagggaagaagcctctattcatgaaggtagagccctcatgacctaatcacttcttaaaggtcccacctctcaatactgttgcattggagattaagttccaacacatgaactttggaggatgtattcaaaccataccatggggttttacatctttagaatggattgctttgattgattttcatatattgaaccagccttgtattcctgggaaaaaccgtgctttcttgtggtatattaattatctattttatatatagccaaatttcatttgcatttttttaggattcttatgttcatgagggatattgacttggagttttctttttttgtatcacttatttttctggtttttatatcagggtaatgctggcctcacagagtaagttgatatgtattttcctgtcttctagtttcatagagagattgtatagaattgatgctatttcttctttaaatgaatggtaaaatttgccagtgaaaccgtctggacctgggtattttgggggaagatttttaattacaaattcaatttcagtaatatttatagaaggatttagattatttagattatttgttacattttggataaggtttgccagtttgttctttttgaggaatttgtttcatctatgttgtcgaatttatgtgtttagaattgctattatatactcttgtcattgtaatacctatgaaatttctatctactctttcattcctaagtttttatttcagctattatatttttagtccaaaatatccatttgattctttttttttattatactttaagttttagggtacatgtgcacaatgtgcaggttagttacatatgtatacatgtgccatgctggtgtgctgcacccactaactcgtcatctatcattaggtatatctcccattgctatccctcccccctccccccaccccacaacaggccccagagtgtgatgttccccttcctgtgtccatgtgttctcattgttcaatttgcacctatgagtgagaatatgcggtgtttggttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacagacgtgtccatgtgtctttatagcagcatgatttatagtcctttgggtatatacccagtaatgggatggctgggtcaaatggcatttctagttctagatccctgaggaatcgccacactgaattccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttgatgtccttcacccactttttgatggggttgtttgtttttttcttgtcgatttgtttgagttcattgtagattctggatattagccctttgtcagatgagtaggttgtgaaaattttctcccattttgtaggttgcctgttcagtctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctatttatatcttctgtttcttcactgagtgcttctgttttaaatatttgttccaaaatcgcttgttattgttcattcaagcatttttattatagctaatttaagataatttaatgtaatctcatcattcatgtctgttgtctttttccatgttaattgaaatttttatggttatttgcatgctgattaattgtagtttgtatcctggacattgtgagtattgtgttgagattctgtatcttgtttatatcctatggagaaggtctatatttttgttttagccttttatatattttggttcccacatcaattcaattttccagcctttctcagtactatataggtctgtcctgcatgtgtaccatctagtggttagtctgagacttgggtggaggtgtaatttgtagttgagtttccaaatctttggtatgctaatgaagatcaaaggagtcacaagtcagaggtaagcccaggggttcaaatcaactttacactgttgctttttcaaaactcttccctttcctttatcttttcagtactttccagttccctgggctctcatttctgttttctcttcaaaaactacccactgtcatggttgtagcatttccagaaacaagtagcaggaggagagagtgaggatgagagagggagagggagagtgagaacgagagggagagggagaggaaaaactggtataaaggtgtcttcttgacatcgtggcttcacctagaggaaggaccttatcccacagttttgattcctggaggctcccattctgggccactattgcttctgagccacctttgcttttactacctccactgtggaaccaaagaaggagtaaataaaaacccaatggatttcccccactctccgaattttagttctcttttacattccttgagccaaaactccaagacttctcctgcatctctgtctgctaaacaatgctcattttggattgcacaccatgttgaattcaggctcaggatactgaatgggggaaaagtaatgttgaatttgcaattgtttagttggtacttcaaactctggtgtcttctctgatctacctacttagattttcctttcaattttcatatagttgtccatgcattctctcagagttttatatttgagttagtgagagataaaaggtctgagaattggacccaactatatatgttttgtaaatggcatgtagttggatcctactttttaatctaatctgaccatctcggtctttaattggaatgtttagtcgattcacatttaaagtgattgtcaatatacttagattaaaatctaccatctttctgttttcttttcattatatttgttcttgatgttttctatttactgtatttggctttcgtttcctttttccctctttttttctgcctttcattattttatttgttcattttgtgtgatcccattttgtctcatgtatttatttattatttagatatcttataaagaaacttttttagtcatttccattaagtttgtaatgtacatttttatataatttggttcacctttaaataatactatactgcttcatgtgtagtacaagactatccccaattccttccttccattctttgtttcattgttgtattccattattttttttacaaatgcaataaacatataatacattggtactattattgctttaaaagatcagttatattttagaacaattaagaatatgatagttatatttttcttcatttattccttttgcaacactcttcctttaattatgtacacccaattttctgacctatatcataaccctctttctgaagaatttcctttaatatttagactgtaagacagtctgctgatgttgagtttcctcagtttttgtttgtctgaaaaagtattttatcttaatttttgaaggatatttttgcagaacttggaattctggattggcatttttttcttacaatactttaaaggtttcatttcactgtctttttgcttatgtggtttctgacaagaagtctggtataattcttctctttgttcttctgtgggtaagatgttccccacctaccgccttcttcctggcaatcttcaagattttatttctgtcttgattttctgcaatttgaatttgatattgtctgggtgtggtttttggtttggttttggtatttaccctggttggtgttctctgagcttcttgaatctgtggtttggtgtcagtcattaatttggaaaattttggccattatgtcttcaaatatttcttctgccttattctttcttccccttcttgtgttctaaatacgtatatgttatactgtttgatattgtcccacagttcttggatgttttgttctggtttctttttttgctctttttttctctttgcatttcagtttgtgtgatctctattgacctatcttcaagttcactgatgcctcagctgtgcggagtctactgatgagcacatcaaagatagtcttcagatctgttactgtgtttttttctctcccatttatatttgattctttcttatacttttcacctccctgccgaaattacctatctgatcttgcatgataaacttttccaatagagcctttaacatactaatcatagctattttaagtttcctatctgataaagatggaaacagtagacaaaggggactccaaaagggggaacagtgggagggagcaagagttgaaaaactacctagtgagtactatgttcgctatttgggtgatgggttcactagaagcccaaaccccaccattacacaatatacccaggtaacaaacctgaacatataacccctgaatctataatgtaaaaaaagaaagtaaaataatccaaataaataaacaaattccttgtctgatatttccaacatctgtgtcataacttactctggtcctaatgattgcttttctcttcagacattgtttttattccttgctttgttcgccctttgtgctacaccctggagataatatatctcttaaatctcttatagatgtattccactgttatttttactgatgctttttagcctggtagtgggggaatggggacctgggacattctatgctatgctgattaagtctcagtcttaggcaggcttaccctgggtgttggaggtatgaccttcacaagtgttcctgcccctcctcctatgttctaacccaagtgggcttagcacattttcctgcccctcctgggttaggacttttttttttttcaattttctcccccagctgtagtgagttttcaccagtgccctcagtttctgttgccctttcttctgaggactaagacttttttccctttgggaagataaggtagattggtatgggcagagtttcagtgatgttggccattctgctctgccagctgcagtgagtttctcccagtactttcaagctggtttttgttgccttttccctgaatagtaaggcttttgctccatagagaatatagggaaactagtctgtgcagaatttcagcaacagctattatactgttctgcccgagcagaactacaggatatctttctcaggattcttctcagtctttcttgtcagcacctggggcagttcctggaggaaaactctgcaaaggggtgcaaaattgcctatgtctgcagcccctacaggcttcacattctcacactagcccataaccagcctttagcaattcattataatttttagctgaatcctcttataaagtttgtatgttgttcagtggtatctgcaccaggtaagcaaatgcctgttcctgtggctcccttgaagatggttgtttctacaggtttgtggtactgcaacctcagttttctgatgagtctgagagaagttcttaattttcactttcccggttttttcgttactgtaatggtgggagacatgttctttacaactctacatttctggcctaataccagaagagcctatgaatctgaggataagcttttgagggtctgtttatttttcagcatccataccccagtttaccaattcccccacaatggtgatcatggtgggtttaccagctcgaggcaagacctatatctccacaaagctcacacgatatctcaactggataggaacaccaactaaaggtatgtctctgaaagcctttgttcaacaaccccataaaagctactggctgaaaaccttacttaggtagaaggccaaagtcctcaataccagaaatgccccatcattattattaccagcattaggactactgctaccactattactacattcttatacattttataacttcttgagcacatactttgtgcccaacaccactctaggtgctaagcataggaaaactagtattaagattaaatgtcttctctcaagaagttccatgacctcaaaacaatcctgtgagtaacatattatttttattgccattactattattgccataccaatattactacttttattagcattaccacttcttcaccatttcatagctgaggaaattaaggcccaaggagtgaagtgccttgtctaaaggcatatatccagttacagaaccaagatatgaacccaggtctatttgattctaagcctgatattcactgtgccaagtctaatgcatgattctactgattggaagagaaaagaatcccatgttagccctatagtctccttttcttcattctttttgtctccttcttttccttgttaatctcaacatcctgtctctctgccccacttcactctatctctccccctcttccttcctctccccaatttttgtttctttttcccatttcttctttctgttcatctatgttctctttatctaattcactggtgaggagtttcccgatggtttaccatgtgcccaaactcctgctaggcagtggggatacaaaactggttgagactcacaccctgtccttgaggagttctgagtctagctgggatgtataagaatacctcatatcatctaggaattctagagcaggagcagggcgctgtatgaaatcacaaagggatatgccaactggaaggcaaggaaagcttcctacataggatatgtttgagctgagtcttgtgggaggaataagacattggcagaagggaaggagagaaggagcagctctcatggaggactgcaagctctcaggaaaatctgctgagtgtagaggcacatgggacactggcagacgggtttctgccttaagggccccatcatgggttctgattcccctgctttctatcttcttcactcaattctctcaaaggcctccagagtcatatttcaaagcacaaagctgaacatgcctgtggcctccaaaggtccccttggcctgcaggtttaaatccaagctccttaccctgttgttcaaggccctccacaattggccccttccagcatctcaggcctcagctatagtggatgactcaccatcctccaaacatgctcttccttctgccaatgccatactcttgctcaagctgttcctctacctggaatgcctttgttcctgactcccgctgcccatatctgcctgtaaaaggtgcctaccctaaaaagcctggttcaagtggtgaaaccttctcagatcattccaagtacaattagtctttccttctctctcactgtcttccgtggcttaatattgtctttgtcagagcattgaacaaactctgtgggagctctccatttactggtttactcactgtcttacctgttggactgtgagtgccttaaaggccccatcatgaagatcgggctaatccctgagacccagagctcatatcctgattcacagagtaggagtcaaaaagtatttgttagatgagtgaatgaaatattaactctttggctgcttatcttctttctcctcctttccttccctcctctctagtttttcatcattgcaagtgggaaagtatggcctagagatttagatttagaatcttcctcataatatagaaaaataaaataactttggactagaagtcaggaggtccagtctatatctgtcaccagctcactcactgtttgacccttggtgattaattttactccctagatctccatttcttcatctttccactggagtagggcattttaaggattggcatttatgataaagtagaataatggaaagaccaccagctatggagctaaatagacctgggtttgatctcagatatccacagataggaaataacttacactgtgtaagttatttcctatctctgaactttcagtttcctcatttataaaatggtaatagtgatctctactttgcagggctgttgtgaggaataaataaactggtagccataatttgaagttttaaaagcacattttgtagctacaaattataccttcttctacctctgaggtccctcccagcaaggacatttttttggccactgggatcttcccaacctcttcactggcactccctgctttcagtgtttaatttaggccagtatcgacgagaggcagtgagctacaagaactatgaattctttcttccagacaacatggaagccctgcaaatcaggaagtaagtacccaatattttaggaacctgtgctgtctcatggctgaaaggcccttgttcagatattgggggagtagggcagaataatctggaccagaaaggaggccctctagactctcaaacagtagttggaacagcccttccattttcctgcccaaatcctgtttctggtcaagaataatctggaccagaaaggaggccctctagactctcaaacagtagttggaacagcccttccattttcctgcccaaatcctgtttctggtcataaccatccacttatcaagaacctttaatggtcttctacttctgacaggagagagtagaaacttctcagcttagcatttgaggcatgaatctcaataccttggcctactctagtttctgtagtctcatcagttcaacctcaaggtctctctgcactacaagactctgagtacttgcagaatagagcctgtgccttatgccttcattatagaacctggcagtgagtaatcactaaagagatttttgctgaaagcataaatacattgccactgtcatgcctgtgtgttacccatgccaggaatgccttttacttcacagaccacatgctctacttgggtccataaaacagttcagcttgagttccattagctcaagggttggagcccttaatattatggcttctgtcattgctcagcttttcctgattgtgtcactttatacctgcccgtaaaccgtgtaagctgtgcacacatagccactttcaactgtttgacccctctgtgcttagcacggtgcctaaagcgtagggcaccctgtgtagatgttcaatacatgataagttagtctaagacatgagagatggtacagaagatactgcagacaatgagagagaaatccatcctgggggataagggttgcctctttttctttcctggtctatttcaggcagtgcgccctggcagccctgaaggatgttcacaactatctcagccatgaggaaggtcatgttgcggtaaagaaattttttattttttccttgggtaactactgggaagggaattagctaatatgtactgaacatttaccaatgtgtacagaacattatgttctgagtatttgcatatattaataatttaattttatgctccccccttgagataggtgttgttattatgccccaattcagagcccagaagaatggttcacagagacattaaataatttcccaaggtggtacaacgtatacctggcagggccagaagtggaatccaggttgcatagcttcagaatccccgctcttaaccactatacactaccagtctacccccaataattcagcaggactatattagaatttaaaactgcagtacaaacagttttgagttatagagacttacctaaatatctagtcaatattttggctaggatttgcaaattataaaaggggaggagattctcaaatatgcaaatggtccaatctcaggtgctgaggttagggaattgtttcctgttttagaggacttctaaagtgataaggaaggaagaagcttcagctaggaattgagagaaccagttctagctctgctctgtcagcaactctcggtgactttggtcaagccaacttcttctaggcctcagttacctcacctataaaatgaccctaataaaaacccacaatttcctcttgccttattacactcacagggtagcatacatttctggacagaccataagggcccaatatgtgcttgtgaaattgtcataagccaatcatgaatccttcctatccttcaagaccttgttcaagttctacctccatatggaagccctccacttagcacagggatgggcaaagagtaggtgttctgttagcaccagattcagagtaagccaatctcattacctgcctctaggtttttgatgccaccaacactaccagagaacgacggtcactgatcctgcagtttgcaaaagaacatggttacaaggtatggtaacactccaactcttatctagagcctatttctccagcacaaaccccaaagaaaggcaaaccaggggactcagagcggccaaatccgcaaccataagctcaacattttaatttggttctctaactttccaggatatagtcagaagcagcaaagcagaacaagaaaggaggggtgccacattaggcaatggaagttgactgcagacaggctggctatggggaaagagtggagagagtcactacaaaaaacttatataagacctaaacccagtaaagatataaaacaacagtctggggtcattcagtttagagccaatttgcctcatgaaactcagaagcctggaagtaccactgtatgagagcattatgttgtcagagatgcccctggagatgacttagagccattgaaaaggagtaaagctatgttcagctcctaccaaacataatttcctgctggaaatctcttttctgtttcttttataggtgtttttcattgagtccatttgtaatgaccctggcataattgcagaaaacatcagggtaaggaccaccagttacttttccactttgctctgccttaggcttagatcatgcctaaggcagaggtgagattatgcctaaggcaactccatgagattaaagaaagtattcctccctgatcttctctgagttttcataggaagcattccctaaccatcctggcttacaatgactctattaattttaatgaagccaacatatatagtgccctttgtatgctccagatatcaaacttgactgtcattaattttcacaacaaaactgcatattagagattatttccatgttagagagaggaaactgaggttccaaaagcataaatgaattgtcaaaaattcatacaaagggatggaagtgggactggacctcaggcttggctgtctgcctcaaaagcctacattttttattctgccccaaaattcataccagaactatcactgctcttagattctagacatgtggtctagaactaggtcatttaccacattttgttgttccctacttcatcaaattactggagctcaagaacagaagagaccttaagggtaattttcttctaccctccatcagatacttgaaatcttacctaaatgtatatctatattttctttttatacctgcaatgacaaggggcccattgctttcaacaaatgcggtccagtcaagctggaatctgcctccctgtaatttttattaataggtcatttttttaactttttgggacatacagcatgtccatttcctcccttccttcttcatcctcccatctatctatctatctattgattcaatagaaattgactatatacctggtcttggccattctgggcattagagacatatatatggatagtggagagtccttcccttgagcgcacagtctagtaaggaagactggcaagtatatatacagaactctgagaactgaggtgagatgagggaacagaggaactttgggaagacagtgctgagggcctaactttgcatgggggcagaaatcagggaagccttcctaatggaggtaaaattaaaatgaatggtaccttgaagaacacataagaatttggtgggtgaagaatggaaaataaggatataagcatatactaagtatggcatctccggagaactataagtagcttaaattggctaaagccaaatgtgtggaggaataagggagccatgggagataaggatgaagaaataatttggggcccaatcatgacaagccatgagccacctgctaaaataattcacacttttttctaaaaggtatgacaaaatgtagaagggctttaggcaggagaatactttggccagatgttcatattagaaatacccttctggctgccagtatggtgaatacattagaactaaaaagaatatagacaaagtaattgggcacaaagctatagtgagcacaagcaagaaagaatggatatttagaggagatgatagagtggagaggatttggtacctgctaagaggtgagggatgatagaaagacagacatctaggatgactcccaggttccatttaggatcatatgactgggtaggtgatagtgccagtacctgagatgaggactgtgggaggagacgtgggtattggtggattaggagaggccagtcttcagaaatccaaagacagcacatcataatctcccggtaaacacttgatacatgtaagtcataatgacccctggccaagatctctagttcctcttcttcagccatttctcatatcacaatttctggtcctcttataaatgttcttcttttataaggagtgtattctctgggactgagtataatgtaacaggccttgtttgagattaggaatgaggagtcacacaaccagcttcttttcaattggctgatttttgtaaacttgggcaagatgtgttctccaggtctcaatttcctcatctttataatgaggcatcttgtactcaatggtctctaagggaacttccaaagaaaaccatctgtctcccaatgtctcccttgatacctctgttctccctgctcccagcaagtgaaacttggcagccctgattatatagactgtgaccgggaaaaggttctggaagactttctaaagagaattgagtgctatgaggtcaactaccaacccttggatgaggaactggacaggtaagagccagcaccccaaagtcaaggtctagatctttcacccagttttgatatcctgtagaacctagagtaaatatcctcccttgctgggcctcaacttctctatctgtaatatcaggaaactgaacttgatgatctttcttcaaggatcctttcagctctgattccttgatgtgtaaggtgttcctaagatgactaaaatagtgctttcctgagcaatatgaacagttcaggaccctgggaacaaatgcccccctcctgtgggtgttgcgattattattacaaaagtgttcttcacacgtgaatgacacttcagtttccaaacatgtataccttctttcttacatttaatcctctaggactcctgtaaaggaggctgagataagtcttatggtcataaaatttcaagaaaaagaaattgagtcttagagagttgaaattactttcccaagctcccaccacaaggggtagagctaggattctaattacatgttctgtctcctagtcatgtctcttttcacaacactcccatgtctcatcaatcaacaagtatttggaccctttgggctgtggtatatgtagggggtataaataggggcaaaagaggtgggttctatcctcgggtagcttctatagtgctttgacatatgagaagacccataaaaaaaaacaagaaatgttctgtcatcataccaactaaagataggagagagcagatgtgagttttagatatagaatgttcccagaaccctactctctttgaaaatgtattatgatgagaagagaccccaagtgagaagtataaagaggcttcaaatggtcatcaccactctaagaaatctaaagagtggccttacccaactgaagtaccaagaaatgagcactgttactgccccactctttagatggaggaactgagacccagatcaagtcaaagtcttaccttgggctacacaatgaatgagtcagtagcacaatatatactcgaacccatatcccagttgtgcagattgttcattgtacaggcaccctggtcaagggtacactcgcttctctcaccaagatgtgtgctgaagtagggctgtgtgaccctgaggaaagtacggctttttaaaattatcacaaaggcacaatatgggctaacagcatatggtgaaaggagcctgaaggccggggtgaaggatgtaagtgaaagaacggcattgacaaagccccagccctgggcctagaccctgcagttgctaggttgctgtttgatgaattagtttgggccagaagaagacagatctagaaggtcagctttatgtcatcatttctccatcaacagacatttacagtctatgcatcaggtcccagccctgaacgtggaatcaaaagaggaaagggctgtccctgatttgacagaatgtccagttagttggagaagacaatgagtacacagttggtcacaactctggtgacagtaaaccaactgggctgtaggaacataggacccagtccagcttagaggaagaaggtctaaacgagctggattacccaataggcagactacactgaggttaccagcaagataagggctaccaaactaagaaaaaaaactatcttaaaaacttttatttatttatttatttttaatttttgagacagagtcccgctctgtcacccaggctggggtgcagttgcgtgatctcagctcactgcaacctctgcctcctgggttcaagcaattctcctgtctcagcctcctgagtagctgggactacaggtgcccgccaccgtgcctggctaatttttgtatttttattagagatagggtttcccatgttggccaggctgttctcgaactcctgacctcaaatgatctgcccgccttggcctcccaaagtgctgggattacaggcatgagccaccgcacccagctggcttaaaggcttttataatattgactatttcaaaaacagcatcaaggtagtcaaagtggaaaaatataaaaccagaacttgggaggacctccccatattctgtagtttataatttttattttaaataaaaatttaaaaattttttaaaaaatttttaaataaaattaaaagtttggatgagggtaggcattagctactctgctatttttggtgtggaacacctctaaatgacttcacatgatcctggtctcaaaaaagagagtgaatatgccggctcttgaggtataaatgcatagcagctcaactttggaaatcgggcaaagagaatagcactttgtaagtgcctagttaaatctgaacaagagtagagaaatacagaaaatattccaagagtaatagcaaaggtatgaagacaagaatgaaacagagaagatatgggtatgggcatgggaccataaagtgaggccaactgggctcagtgtgagaaggcaaaaccagaagatcagactaagctgaggaatttggaagctcctagagcctcaaaggacctagtgttaggaacagacagtagccaggcaacaagtttacatcagatattttctatccctaggctctgagggttctagaagaaatgattggagaggggagcattctggggttcttcttcccgagaaggtggccttggagaaatcactttctctctctatgcctcagtttcttcatctttgaaacagaggtgataatctctgctctgtagcaatattatgaggattcatgcgcttaaaagttcccactccctgccagatgcacagaaagtgttcaacaaatacaagtgccctgtggaagccattaggcacagatgggcatgatgagtgtggtgcagccataaagggcttctctaggaagaactagggagaggctttctgaaaccaaacctatcagcaaccttacctgcctggagttagtgcagtgcagctctttccattcactcggttttgttaccatgcaaccagggctgctggtgtcaccccattgccccagccttccactcctcttcccagggatttctctgaactctgtacaggccaacaactaaaggatttaatgcctggtacagcgtaggcctcagaagtcttgctccatgtttctagtcttctgattagtcagtgcctatactccacccttcagcttctacacaaacaggtggttgaacagtttaaatatcattcagtatataggtattagttcatgacagagcacagaattgaggatacagtaaggaacttgggacaaggaccacaagttccccaataatgttgtggaccacctctgtatccccatgccccactgcttggcacaccttagagggagtgactatttatggaatgaatgttgagcactgatcatgtgtttccaagtatttgttcctgactggccagagagctcccaaagcacagacagtgggtctccatgccaagcacaatgcctagaacagaggagtatgtttggagtatgtttgttgactgcatagcaaataggaaaataacccaggccaaccccacttctgagtgaggagagaaacacacacatgcacagacacacatatgcacacagaggcaatctggtagctgtgtgtagagtataaaagacaatatgtagcagaggctaaaaaaaaaaaaaagaggagtgaagagctcaactcaggatcagaaagggtagaggagtgaacaagtcaggagctgccagtaagacattggagctagccagggatgcaaaggatactgcttctctctgactatgttaggggtgtgaaccacagaagagagaacccagctgcctgtaacaggatgagtgaaggtgaaaaggcagtttggctcaagttgaggctgaaggaaggagacagggggaaatggtagcatgcaatgagctcctttgggtggccaataaccaagtctctaggacaggtactcggtacagggcaaggcattgcatcacattaggtgacagctgggttgtggaagaggtttgaaagggtgtgtggttcggggtttctctcggggtcaaccctaccaccattagcccctgagctgcccttgctcctgcttgggtctggcccagccacctgtcctacatcaagatcttcgacgtgggcacacgctacatggtgaaccgagtgcaggatcacatccagagccgcacagtctactacctcatgaatatccatgtcacacctcgctccatctacctttgccgacatggcgagagtgaactcaacatcagaggccgcatcggaggtgactctggcctctcagttcgcggcaagcaggtagggtgggccacacacacccagatgggttggctgggctgtcctaggtgggctgcaggtgtagtggtggccacattctgggtcctgaggtggaatgacccagggatgggggagaagcagattccatcactcctgctcttccacccatcagctgctcagtctggacccagccgccgaatggctcccaatgccacctgttctgcaggtctaagagcttggccctggcacccaaggcctgcccaaagccagctgctccatgacagtgactcccttggccctgcctgactggttccctcatctttctcacgagtttgtgcctttgctagtgcagcttccccacctggtctaccctcttctgtctcctctgtcagtgggtgactgtcagtggcacatacagctgccctgagagacccacccttgaatcactcttcttcccaattctgccctcccgaccttatcccaacgcaggtgtcacactggcagcccctgtccccactcatgacagtgtccttcctgccctccccactcccttccaaggcccagcacctgctccaggaagccctccccatcctctcctccctcccaggcaggttgccatgccctgggctccagctctcccagttctggcctatgtgtggctctcctggcctgagtatcttctccccagcccggcacagtgacctactggctggttgctggctgaatacagggatccatttccacagcatttggccctgtgcctgggcttattagcacaggtattgttcctgctggcaggaccgcttggggatggaacaggtgggaaatgaagtgcaggaaggacagttgttgtcataattgtcatttattggacacctatgcacagtcacggtgccatctgcttccgcatgtgtggctcatttcatcttcaccacaggtctgtggggtgggcattcctgccacaagtttatggatgaagaagcagagagcagccccagggcaggcggccaggatgagacagagccaggactgaaagccgggcctactggcctgccctcagctcccccactggagatggggggaggtgccccaggcaaggcactatcctggatggccacaccctggtgtctccctttctgttacctccagactgacagcctcccctcgaggtagacgctgacctgtgactccctcatgtcccactcctcagagcagagtcagaggctgctcgaggtgtgaccccagcccatggcagcccctgcagccagggccctcttgggtggagccagcccggccctgcccacacagctcggagcccagctggacatgtggctgtctccacagggcacgcctccctgcacacaaacctgtgtgtgtgcatgcacacagctggcgccaccttgacgcttctcacagagcaccaggcccagtttacaaagcacctccccgtcgaggtagctctcacttgcgcagcacccactgtgtaccaggctgtggtctgggtgctccccatccactatctaaagtgcagcccccagacagcaggccagatgagacaatgctctttggatatgaggccagagaggggcagggatgtgtccgagggcacaagggaccatgtaagggagctgagggagtttaacctatggctcatacctccctgtcaagggctccttccaccagagcacgctgactcctgactcaggtccataatgaaatgtatgtatgaaacgcctatagctgcatatagaaatgtgtgcctggaactttgcacctgtgcagatgttcctaacacatgccgtcagcagttaacgacacacctatacacagaggaggaaatcactagctcctctgggctcccacagccctttatggttcccctcggtgctgccagtgtttccctcactggactggccatgtcttgagaacaagaacaccccagcacccagcacagggccacgaacactcaatacatgtgtgaatgcccttagaacctgggtaccaggaaccctgcttaagcaataagtgttcacagtgtcaaaaagtaatgtctcccaaatcccacaacccctacttccagtccatactctgggtaaccccaaacctagaattctttgccctttttgtctagagtccgctttcagtgcctacatgggcctatcagtgcctacatggcctgtccacttgaggtcaggccatatcacacgaccaaggggttgctgtttgtggagcatggggatcagtggaggtggaaatgtggacagaacttggtcatgtgacttggttatccacaagcatgtactaaaggcacgtagaagtgcaggatagagccagaaatggagagatagactgtgcatggagtgcctccattggtactcttgtcccaggctccacaaatgttagaggtgggcctgtttgaatgaatgaataaccaagtaggggcttcggtgagcaatcgtcaaataagcgctctctctctctctctctctctctctctctctgtcatgctcttttctattcccttggcccaccatcacattggaaagagtatggctttttataagtttggaacatttaaactctttgctctgcttgttcatcaccactcaatttgtggcagatctgagcttgttctgatggccaccctgctctctctcacctctccttttccccttctctcctcctctgcatccccacatcctagtatgcctatgccctggccaacttcattcagtcccagggcatcagctccctgaaggtgtggaccagtcacatgaagaggaccatccagacagctgaggccctgggtgtcccctatgagcagtggaaggccctgaatgagattgatgcggtgagatgcatggggtgaatctcctgtgtgtgggggtgacttgagtctgggattatcccctgggttgcctctgctccagcccctatggggagcctaattaattcaacaaacttttttgacaactagccatgtgctagaccttattctatgtcttggggatccagtgaaggccagaatagacaaagtctctgccctcatcctaaagacagacagtaaataggacattacatctcagtgtgacaaagggctatgagaggagaagtagaagggattatggaggatcagagggtaagggtgctcctgactcaacttggtgctggggaatttacaaggaaagcttcctggaggaagctagaggtgatataagaaggagatgaaatggtctggggagtggggaaataaatttaattcagagacagaaaataactcatgtgaagacccagagatgagaagagagcatggcaatttcaggggattgaaggaaagaatagcacagaggctgggacagcaatagtgagatctgaagaaaagggagatgaggctagaaaggaagccaggccaccaggctttatagttcatgttgagggattcaaatgctgcccaaacaacaatgagatgtcattgatggggtccacatcaagtaggagtaatctgaatgtgttgcacatttttcaaaaaagcccactctgggcatgtgtggaaacttggtgggaggaaggccagaatgaacaagtagaccagtaagaagttgacttcattagtctggcaagaggtgggggcatgttgaaccagagtagtggcatcggagatggaatgaagaaggactttgggaatgtttcaaaggtggaatcaggccaggtgcagtggctcatacctataatcccagcactttgggagggctaggtgggaggatcacttgagcccaggagttggagaccagcctgagcaacatagtaaaaccccatctctacaaacaatttaaaaattagctgggtgcagtggtgcatgcctgtgaccccagctactctggaggctgagataggaggattgtttaagcctgggaggttgaggctgcagtgagctgtgatcatgccactgcactccagcctgagtgacaatcaaggccctgtctcaaaaaaaaaaaaaaattaaggtggaatcagcagggcttgctggtgcactggctgtaagggatgagggagagggagacatgaaggacccaaccctggtggtatagcagtctctcttcagggtcaggttcttccatgagctctttgagaaaggagctgtttcctctccattgttcacctgcactgtaggtacaatggcactgggcagcagtgcacaggttatgattgttaggcgtcaacataaaagcttcaccacttgtgtaaataacttgcgtgtgggtaggttaacttacttgcctgctagatatgcctctatagaaacagacatatatgtgtgtgtacattcatacatatgtgtatataaatatagaggtacagaaatacacatagttagaaaagggctatacagcattgttctgtataccacatacatttgctgtaaaatatatgcaagcaaatatgaaatttcttcatcataagtttggtggcttcttatttctggcccacatgtggtataaacatttattgaacccctccttgtttcaggttctggagtgatgctggaggtggaaattgatctaattcattcctgtcttcactgaattttcaggctaaatagggtagacagaggaataaacagagaaatagagaacagcatgtgtgatacaggctctgataggtaagactatgggtgcatagactttggggcaggacacctaactcagccaagatctacctggaagaagtgatacctagctgaagcctcaggtttgagtaacagtgaaccaagtagaaaggatcaagaatgacattccaggcagagagacagggatagggagcttcataaacaaagagggtattgtatgtgtgtggaaatgctaaggttgtagtagtacaaatggagaggctggaaaaaaggaatccatttgagagagctttaggaggtggaatctcaggaattggctatgaggggtgagtgaggaagaagcaagaatttaggatgaagataaagcaagaatttacgtttctggtttattttccatgagtaataaaatattaatacttcattctaatgattgagtctttaaaatgtcccttgcgcattctgtactagtatgttttacttacattttcccaatattcaaaacacttctgtgaagtagttctaattctccacattttgcagataaggaaagtaaaattcggagaggttaagcaatttgactcaataaggagtcaatgaccatttccataggcgacaggctcctagtactcctcagaatagaaagttgaagccaatcttgaacgacctcgtgtacccagtagggtgcactttcttccatgggcagtgtgggttggagaagtttcacactgcagagatgtttgtgggttggggtaggggttcacttcctcacccctgatgggggcatggtagatgggcccaatagacaacaaccagaggccactggccccctacagggagatttaattggaatccacatacccagaaggaaaccttagaaacccaacatcactttccaccaccagcagcagtcacctcacctctgggagtttctcagtagacttggaatctctcataagctccttaggaactcattctctgagtactcaattccttttttgagtgaggagagtgtatctcccccaaatccactctgaaaccattaggaatttgttaatttttcctgtctgagatgtctatggatgcctgtttatctgccagagttcccaaagtagaggtcttcagacacaggcacacagatactctcacatatacaccagagacataatgagggacatatacattaacagacacacatgccacagacacactgagacctgcatggaaagaccacatggacacattctcagatgcttagacaccctatacacacacatacacacacacacgcaagcacacaacatatgctgagacaaatacacaaacacaaggcataagtctttaaacataccacaagtacatatcataagcatgctgcacacagacttgtaaacacagccacaaatccttatgcccatatatttataaaaatacatacttatatgtataatgtacacctacagacctatctgtacaatcatagaaaaacatcatacactcagcctgaacacatctactcacatacactcactgtcacatctacacagccacacacctcacacacacacacacacacacacgcacacacacacacacacacgcatacacacttatggacaacaggcacaaacccagagctgtgttcacagagacccaggtgctcatgtgctactgtttcacaatcatcgaagaattatggcaaagactctgtggaatttcatcttgtgaatactttcgcccccaaatactttttctcagggtgtctgtgaggagatgacctatgaagaaatccaggaacattaccctgaagaatttgcactgcgagaccaagataaatatcgctaccgctatcccaagggagaggtaaggtttgcggggtggcctaatgcctaggactactccccagtgtcttcattgcaactgctaggattccacaattgtctagacagctttagaaacagagtaagcatatcttgcagcagctgccatcccacaaggcacatgattatctggcccttggttgttttagattcttggctataggcaatagatccatccctttcttttaaaagctacataattttcttgcttattctctttctgcttcagaagtgctgactttatcctggaccttgtctctggtatcccttcatgaagacactttaaatagttcaacatactctgatttcctgatattttgttgccaagttgcctaaagctccagcctgtctgggcagttggcattgtcccaagggacaatggctaataatttaatcaacttctttgccactacatgaaccagaccatcagttccctatccccatatgagatgaatgctcattgcttttaatcaagcctccacttaaccagttccacattttagagcatttattagtcatactttatttctgatataaatggctgggaaaagttattagaaaagaaggacatctgggaggataaaacaatagatattctattcagttatacaacactttcacatttttaatcttcacccacagagatgacattataaaattcatcttaatttgccctcattttcctttaggtatttagaggctatgttattagaggtatacaaaattaaagcaattatgtcttctcagtgaattgcacattttattattacatagtgaccaaacctctttctcctcgataatcctttttgcctaaaaacgtattttatctgatattaatatagctgtacaagattcagtgacttctggtgactccttacctagttcacttttagctattcatttactttcaacttctctgtgtatctttgttttgtgtctcttataaacagcttatagttgggtttcgttgtttttaatccaaactgaaaatatatgtcttttgaatggtaagtttggtatatttacttttattgtaattactaacttttttagtttattactattatcttgtcttgagctctctgcttagttttttctcttttcctgccctctttaggattgataaagtttttatatccatatttaagttatataatttgtttccattcatttagagattacccttaacattttaaaaatttttcatcatgattctttcaatttttagttgatatctcaataaggatgtaaggtcaaaatgtatttcaaaatcactcataataattttttgctgagtgctattatgcaaccaacttgaatccttaacattttaatattcattattaacaaaatctaaaatcaatatctctaccctctacctaaacaacagaagaactttaaaaccctggccattgtgtctcctaatttacatgttaattgtttgtattttaggtcaaacttggtcttaacccccaagtgaattattcctgttgttgttattattgtatgcagtcaatgtttatttagatttaaccacatgcttactaattcctctgatcattcttgccccttgcacctcaaatcttccctctgagttcattttccgtctttcttttttatttttatttatttattttttattttatttatttatttatttatttattttttgagacggagtctcgctctttcacccaggctggagtgcagtggccccatctcggctcactgcaagctctacctcccaggttcacaccattctcctgcctcagcctcccgagtagctgggactacgggcacctgccaccacacctggctaattttttgtatttttagtagagacggggtatcaccgtgttagccaggatggtctccatctcctgacctcatgatccacccacctcggcctcccaaagtgctaggattacaggcgtgagccaccacgcccagccttccatctttctttagaagcttttttagtgagtaaacacacccttctttttgtctaaaaatgtcttggtaggagggggtcctcaatcctagtgatgcttggctgggtaaaaactctaggatgacagttgttttctctcagcactttgaaagtattaccctcactgtcttctggcttctactgtggctaggaaatctgctgtcagtctagttttctttcctctctggctacttttaaggtttttgtatcattgttgctttaaagtttccctctaatatgtctagatgataatttcttttcatttattaatgtatagcttgggattagtgagacttcctgaatctgaggactgggattcttcttcaagtctggaaaactctcagacaatttatctttaaaaattcatctctcacattctattatcttcttctggaaatacaattggatgtatgttactcctgcctctattcttcatgtctcctaacttttccttcctattttctatctctttgtatcttttgctgcatcctgagtaatttcttcagctttatcttctagtcactatttaagtagtatccaatatgctccttaccccatacactgagttttcaattttaatgactattttttatttctgaaattctatttagttatttttcaaatctacattgtatatttgatggcatcttgtttcttccttacattttttattccaccttttatttctttaaaagtttcaaacatatttattttatattgtggcatcccttatcttaagtttttagggttctcttcttgtttctgcttattctcactcatggtagcttatttccttgtgtgttatatgagctccagcttgtcaagaatttatctatggaaatctcacgcagcctgagttgagagaatccagagagatttcatttgcttcttctaagcagtcctgggagctaacgacttgggatcactttttattaaactctcagcataacattcttcaaaccaaatggatagtgtagctctgaatcaccagcccacctgagggaagtctggtggttataaattcttacaggatttttttattataatttaagttttagggtacatgtgcacaatgtgcaagtttgttacatatgtatacatgtgccatgctggtgtgctgcacctattaaatcgtcatttacattaggtatatctccaaatgctatccctcccccattcctccaccccacaacaggccccggggtgtgatgttccccttcctgtgtccaagtgttcttagtgttcaattcccacctatgagcgagaatatgtggtgtttggttttttgtccttgagatagtttgctgagaatgaaggtttccagcttcatccatgtcactacaaaggacatgaactcatcattttttatggctgcatagtatttcatggtgtatatgtgccacattttcttaatccagtctatcattgttggacatttgggttggttccaagtctttgctattgtgaatagtgccacagtaaacatacgtgtgcatgtgtctttatagcagcataatttatactcctttgggtatatacccagtaatgggatagctgggtcaaatgggatttctagttctagatccctgaggagacgccacactgacttccacaatggttgaactagtttccagtcccaccaacagtgtaaaagtgttcctatttctccagatcctctccagcacatggtgtttcctgattttatattgatcaccattctaactggtgtgagatggtatctcattgtggttttgatttgcatttctctgatggccagtgatgatgagcagtttttcatgtgtcttttggctgcatagatgtcttcttttgagaagtgtctattcatatccttcacccactttttgatggggttgtttgtttttttcttgtaaatttgtttcagttctttgtacattctggatattagccctttgtcagatgagtagattgcaaaaattttctcccattctgtaggttgcctgttcactctgatggtagtttcttttgctgtgaagaagctcttgagttttaattagatcccatttgtctgttttggcttttgttgccattgcttttggtgttttagacatgaagtccttgcccatgcctatgtcctgaatggtaatgcctaggttttcttctgggtttttatggttttaggtctaacgtttaagtctttcatccatcttgaattaatttttgaataaggtgtaaggaaggggtccagtttcagctttctacatgtggctagccagttttcccagcaccgtttattaaatagggaagcctttccccattgcttgtttttctcaggtttgtcaaagatcagatagttgtagatatgcagcattatttctgaaggctctgttctgttccattggtctatatctctgttttggtaccagcaccatgctgttttggttactgtaggcttgtagtatagtttgaagtcaggtagcatgatgcccccagctttgttcttttgacttaggattgacttggcgatgcgggcccttttttggttccatacgaactttaaagtagttttttccaattctgtgaagaaaggcattggtagcttgatggggatggcattgaatctataaattaccttgggcagtatggccatcttcacgatattgattcttcctacccatgagcatggaatgttcttccatttgtttgtatcctcttttatttcattgagcagtggtttgtagttctccttgaagaggtccttcacatcccttgtaagttggattccttggtattttattctctttgaagcaattgtgaatgggagttcactcaggatttggctctctgtttgtctgtttttggtgtaaagaatgcttgtgatttttgcacattgattttgtatcctgagactttgctgaagttgcttatcagcttaaggagattttgcgctgagacgatggggttttctaaatatacaatcatgtcttctgcaaacagggacaatttgacttcctcttttcctaattgaatgccctttatttctctctcctgcctgactgccctggccagaacttccaacactatgttgaataggagtggtgagagagggcatccctgtcttgtgccagttttcaaagggaatgcttccagtttttgcccattcagtatgatactggctgtgggtttgtcataaatagctcttattattttgagatacgtcccatcaatacctaatttattgagagtttttagcatgaagggctgctgaattttgtcaaaggccttttctgcgtctattgagataatcatgtggtttttgtcattggttctgtttatatgctggattatgtttattgatttgcatatgttgaaccagccttgcatcccagggatgaagcccacttgatcatagtggataagctttttgatgtgttgctggattcggtttgccagtattttattgagcatttttgcatcgatgttcatcagggatattggtctaaaattctcctttttttgtgtctctgcctggctttggtatcaggatgatgctggcctcataaaatgagttaagaaggattccctctttttctattgattggaatagtttcagacggaatggtaccagttcctccttgtacatctggtagaattcggctgtgaatccatctggtcctggactatttttggttggtaagctattaattattgcctcaatttcagagcctgttattggtctattcagagattcaacctctttctggtttagtcttgggagggtgtatgtgtccaggaatttatccatttcttctagattttctagtttatttgcgtagaggtgtttatattattctctgatggtagtttgtgtatctgtgggatcggtggtgatattccctttatcattttttattgcatctatttgattcttatctcttttcttctttattagtcttgctactggtctatcaattttgttgatcttttcaaaaaaacagctcctggattcattgattttttgaagggttttttgtgtctctatctccttcagttctgctctgatcttagttatttcttgccttctgctagcttttgaatgtgtttgctcttgcttctctagttctttcagttgtgatgttaggtgtcaattttagatctttcctgctttctgttgtgggcatttagtgctataaatttccctgtacacactgctttaaatgtgtcccagagattctggtatgttgtgtctttgttctcgttggtttcaaagaacatctttatttctgccttcatttcgttatgtacccagtagtcattcaggagcaggttgttcagtttccatgtagctgagcggttttgcatgagtttcttaatcctgagttcttctagtttgattgcactgtggtctgagagacagtttgttataatttctgttcttttacatttgctgaggagtgctttacttccaaccaggtggtcaattttggaataagtgcggtgtggtgctgagaagaatgtgtattctattgatttggggtggagagttctgtagatgtctattaggtccgcttggtgcagagctgagttcaattcctggatatccttgttaactttctgtctcattgatctgtctaatgttgacagtgggtgttaaagtctctcattattattgtgtgggagtctaagtctctttgtaggtcactcaggacttgctttatgaatctgggtgctcctgtattgggtgcatatatatttaggatagttagctctccttgttgaattgatccctttaccattatgtaatggccttgtctcttttgatctttgttggtttaaagtctgttttatcagagactaggattgcaacccctgcctttttttgttttccatttgcttggtagatcttcctccatccctttattttgagcctatgtgtgtcactgcatgtgagatgggtttcctgaatacagcacactgatgggtcttgactctttatccaatttgccagtctgtatcttttaattggagcatttagcccatttacatttaaggttaatattgttatgtgtgaatttgatacaggaggattttcacttatttcccctgagagccaaggagagacagacacattttcttgttgtttctttttgcttgttaaggaactttttctagtttgcacttagagcgtaaagatttggcctttgagcatctcagatttatgtgagagtctcagtcttaactccccaccttgtgcacacccaaggccttgtcttctacttccgtacggtttttaaaactcaaaactcttagttactatgattggcaaatgcctgcagggcagctgtggctgctacatccacttatcacttgtttttttccgtttttctctattttggggccctatatttataaaattttctttatttttgtgaaaggtcagcagtgcatttaagaagacaatttgcagtggggagttgtattgttgttattgttatttagtccactgtattgatacatttatttggtccactatattgatagcccccatttagcagataatgaaactaagaccctaagaaggaagtgagttgcctaaggtcatactggtgggtcaacaattgaactggcactggaaccaaatgttcttgattcctagtttagagttcttcccctctgggcaaatgtgcctcatcttcctttctcactcaagtatctctcttacgtttagtcctatgaggatctggttcagcgtctggagccagtgataatggagctagaacgacaggagaatgtactggtgatctgccaccaggctgtcatgcggtgcctcctggcctatttcctggataaaagttcaggtactaccctcatctctgctttgggaatgtttgatggtatttgagacactgacaccaacaattagatatctatatcttagtagttaagagaagagtatctagaacaaggatgcctaggttcagattctttctctttcacatactagctgtactgcctttcacaaatttctttaacttctctggcctcagtgtcctcatctgtaaaatggggagaataatgatgaattttaaataacataagtaaaaagtttagaacagttcatgacacattgtgtgggctatatattaactgctattattagtatagtattattcttagctaacattttcaaagccaacgttaacagtctgcctcaatctggaaaagatgagctagtatttctgtgaagcatgctaccatcaggtgatagtagggcctttcatagcttcatgatcctgattacaagtttctgtccttgctataggggtaatttccccaagatagtgatgttttcattttaaattgtttttcaaatgataatttatttttaaaaaaatatgtaggcattgcatttacagagtatttacacactgactgcataggctgaactgcaaactggggcagctggcctggcaaaaaaaaaaaaactgttatatcactttcaggcatgagattccatttccaatgtggatgctgatgtgttagcatttccaggatatttttaaggtgtctcagagcaatgcaaaattatattcaatgtctacactgttttacagtcttggatcttttctacgatgctagtttgaaaataaagaacactgtaatatggagtcatccagaattggaacccagggcacttgagaacttgacattaaataaggaatttcctctgcctggtcctcagtttcctcactggaaataggtgataggatgtgcggtgggggtccttgcactggtagatttctctctgttcacatctttacttttcagggcaatgttttgagaccatgaggcaggtgctgtaactcccattgtccagatgaggaaatgggagacccagaaaggtgaagtgactggcacaaggtcatggggctcagagtgtgagggatagacattgatcccaggtacatgccagaggacttcccgtctcagacatgtgtggagtgctttttacacacaggctacctgtcctgggagccagacagggcagcactggacagatgtttctcacccccccacccaccccattacttaggtgaatgctggaacaaggcccagagagatgatgtgactgagaatgcagacccacagaacatcagggctggggcaccctcagagtacatctagtccaatcctgtcctgtgaaatgggaacactgaggaccagagagagaagagcccgggccaaggtcattagtggaggcagtggcagagctgggtcagagatctcaggcaagtcacttcccttctccgagtctgtttcctcaagtgtacaaggagggtgtacagtagtacctcaatctagctttaagggtgtcatgaggtagtgggcaaaacacccttggcccagggcctgatgatgacaaaaacaaggaggagcagcaggatggatgcccaggaaggaaaaaagccaacctaatgtctcaggaggctgggagggcagtggcagacctcagaaacctagggtggaacctgctgttgagggaagccatgagggtcggtgatcctgcaaaatgaagggaaatgggtagcgttatgtgcaggtgggcaggaaagtgggtgtcaggagagagtgcctagcaggtgggtttatcacccccaggacactgcaagcccctggatggcaggggcagttgacagtaggggccagtgcatgcattctggcctcacagggtcccaggttcaaggccttgctctgctgcttcctggctgtgtgacttgcggagagcattttccctctcaaggcctcagttggctgagaccatgaaatgggcttactgtccccacctcttgggcttgcctgagaaatggaaacatagacccagacaagaatgcatatgaatattcagaacaactttatgcataatgtcaataactggaaacaagtgaatgcacaaatgcttgtccatcaccaggcctgaggcagggatgatcagagggagcgggccaggctgggagaaggctgtgggagctgtccactgccacagcagggtctcaaaaaacacttgctgacgtgaactgtgggcctttgtggtgtggggtctgctgaaggccccaggcttggggcgggagagaagcctgcctgggtctcatttgtcctgtgagtgaggtggtggccgtctccagggtggccggcccaaccctcctgcaggacacccagtccagtctaccaccattttccaaggcattcctgcctccctgctctcctcctctcttcccaggtgctctcagtgctgcccctgcagggtgtggggagtgggcccctggtgaggccccaccacggcaaggggacatggaatggggagcatccagcaagcctgggggcctggggaggctgtgtcctggccagcaccctgcctctgagggctgcttcctgttcctttctagatgagcttccatatctcaagtgccctctgcacacagtgctcaaactcactcctgtggcttatggtaagtactcccaccctgatcaaaggacaggcatatagaggctatgagcatggccctagtgcctaccatttgcccagaagagtcctgcaggaggtttcctgggtgggtgtcctgcaggaggttcccttagtgggtggtgggggtgggactgatggtagtaggataacagggaaagagtaggatggtttctaaatctggggctggctctgactctgtgtctttgccagagcacccagcacagagcaccaagctgtggaagggggattccccaaaggggaccagaggaaaattataggttagggccgtattggagaaagagcacaaagaccagcctgggcagtttagggtctttcttgggacattagctatgaaaggttcatgaacaggggagggacagaatcaaatctattctggggtgcgaacagggcagatgacctactgaagcctggagtaaggtgcagtccacagggatgaagctaagggagcttccacaggcattaggccccctctgtcagccccaagccccaatgatgcaccctcatccgtcttcaggtttcctaaaactcccaggtgaacttccatactcctggtgttgccacaaccacattgtcctccagataaactttgcctggcactgatcgcccaaggcagtggccccaggactcttccacctcttcaccacctaacacggcttggaggatccgcagagctacatcaatattacatagatgagactgctgtcctgcggacctcaagagctgtgggcagccagagttcatctctcatctccatccccatttacaaatgagcacctgaagctcagcgaactaagactgttaggggcagaggtgacaggataccctgttggctgcctcttaggcctggtgtcttccccacacatcacatagctgtctaaattctcctccatacaggcgagtcatgatctgtacacagtatgaagctgggggtgtggctggtgatgggggaggggaggtgatacctcagggaagacctgtgcctaccttgggggcctatggacagatggattgttcttttctaaggctgcaaagtggaatccatctacctgaatgtggaggccgtgaacacacaccgggagaagcctgaggtaggtgggggactccatggcccaagctggctgtggacacagcacatggtgaaagcaccttatccacagaaaggctgccccaaccccaccaagcctgggtgttttgcaccaacagatggagcaaacagcacccagaaatgcagaaaccacaacccagacacgaggcaccatggagatgcaaggctggggcaattcccgcctaaaaggcctcaggctgagattcccccaggcctacctgagggtcaggatccgggcctggctgaaagaggggagcctggcaatgaagacaagaggcaggggagaggttggggccctgcactgctgtctccttcctattaatcctgcgctctctcctcagaatgtggacatcacccgggaacctgaggaagccctggatactgtcccagcccactactgagccctttccaagaagtcaaactgcctgtgtcctcatcgccttccacctttaggaaatgctatctttgctcttctcctactctgccttggcctcactgaggcaccccacttccagtgaagaagtcctccgcaactcccaaacaagcctcgcttgctggccgcaaccaaggagctatctagctctggaggaaactttctttcttaattcctattctctgacgaataaagacttactgcctacaagaggagaggaggaggtcatggcgaggcttttccagttgttctcaaggtactgaccctaatcctgacccagctctgctgctgtgagggcatggaatgggtgaggatttcctggagggaaaagttctacagtagcacctccaaagatgggggagaagataggtgcctgtgagttcctgtgggccttgttccagcaaggtggctgtgggcatgacactttcatccttatactcagggaagaatctggcacttgagccaagtgctcctttcttctccaactcttgctgccatcctgagtgatttcactgtttatgtgaatgatccaaccaatactctggcctcacagtcccctgaccccctcaactccagtgatcatcttctccccttcaaccacctactccatggattttggtatcatctccctggtctgacttcttaaacgtaagcatccaactgtctgaccactgcccacccactaccccagtccttacaactctctgtcatccactgaatccctagcagtgtgcctccatacagtaggcatatatgtagtattttcttctttttttttgagacagggtctcactctgtcacccaggctgaagtgcagtggtgcaatctcagctcactgcagcctcaaactcctgggcttaagcaatcctcccacctcagcctctctcacaaggagctgggaccacaggtgcacaccaccatgcccggctaattttcaattattctgtagagacgaagtcttactatgttatccaggctggtcttgaactcctgggctcaagcaatcctcccatcttggcctctcccaaagtcctgggattacagacatgagccactgtgcccagccctgtagtattttttgaatgaacaatatttgttgctgtacagcatcaagagcagagtcctttgaatgctctattgtcccccaatctatccttagtgttctgtccctaactatgttggatactatgggccatctcttcagccactctccaggcagctaccataagccaggtaccagtgacccagtggtaaagagacagactcatacacttgctgcctttgttcccttgtccttccatcacaaccacccagcaagacctaaaccttgtataatccacctctccttttgttgttgttgttgtctactacagaagttgctgatccctgcttgaagcagatctatatttatctgcatccacagccacccttaagtctgttcaaagtcagggttgtcttctctggtaccctattccatcccaccttctcagggatgggctacttcagtcaattcctgactcttccatatctatctcctgttcctgttagcttttgccccacagtctatacaatatgcccaagttttcctctcctatcccaattaaaccctcccttgttcttatgtccacccctagtgacctctgcccttccctccattcttacaccagtgattcaaaatcaatctgtacttactgtccagaagcctctccgtttgccttctgctccaggctttccctctccatatctttcctcaacctgttatcctcttgcctgccatgctttccccaggcctctatcctgctgaaatcatatttgcctttgagccaaaagctggagacccacattctccaaagagctatgctgatctccagctcttctacgaacccaagatgccactccacaactacctaagcacattaaaagacagaaaaaactccaattcattttgcaaatttaatgtaactctgataccaaaatatgacagcacacagaaagcaaacaataaagcaggaacagcaaacagatttttccatcacatgacaccctcagctgattggccataactgccttgactgctgtgtggacaaagattccaaggatgtactttggctccatgggaaggactactgcaatttattagcggtatctgtaaacatggggaataaatctgaaaacaaaacaaataggaacacattttagcaccaaatacactgtc

SEQ ID NO: 12902 - DNA, 20961 bp, Human
tgaacaagaacatccaacaatgaaattggagagctggaattttaataagaaaagctaacatttattgaagatttactatgtgccaaaaactatactaaaggcttaacttggattgtttcatttagtccctccaacaacccttctgtcttttccaatttcagggcccacatgccttggccccacataccaacccaggctgctgtgacagcccatgagagggggagaggttgctctgggatggaacaagaaaaagaggttgttttgtgaggtacggggagggtgcttgttctatgagatcaggaagggagggagatgaaggaggttgccatatgagggcagggccatgagctgacctgtccctcaaaacataaggctgagggtgctagtagattctactcagtaactttcttcacagtgtcagtgctttagtcttctcacattctcccatgtctctcccattgtactgtcccttatcttgtctcactttttgactctgtctttccaatttgccctttttctttacatctgtctctccttcttgctctctctagctgtctttctcttggtgtctctcagctctcacccctcttaaccctcatccccctgctttagtcacctctctgtctctatcctttgatcttgtcattttctctactctcttctctctgtccctcagtctctctctcatctccctcaattagggccatgattctcttccctaaacttacttagccttttgcaatttctggcagcatttttttatgtttgtgtctgactgactctctacccctgctggatcctctccactcctgttctcacttctatgaatctttgtataatcctctagactcattgatccctcctcatgtccctttcgtgccccttggtctatctgtctctgcctttatccctgtgtgcactatcaccaccccctttttcttttttcattttctctttctctcgactcaatctctgttttcatctctaccctgctccctttccctctacctttgatctctttttccccctcaatttctgttcttttaactctaccaccaccaccacatctttgttctctctctactttcctccttttatctttcctaaattttcttttcttctggcttttctcctagtcccttctccttcctcaatttcagactctgttcattcatcaatttaccccaaaattcaacaaatatttattgagtgcctgtgtgtcatttgctttctctttttctgatctctttgccccctttctcttctctgtcttggcctctgcctgtttcactaatccatagactatgtctttgtccctgttttccagccccactgggacttgctttcacctcttcctatatctgtgcttatccaagagacaggagcaaattcaaagacagcataatatcaggctggtggtacacattctgtaggacctagggcctacccttccttccggatcccttgatttccttaaactgatacatgtgacctcaagctccttctcccctctggctgatcctgcttaggaaacaccctgggccaagcctcaggagctctactcaatgacatatgtttgcattagcaggctgaatcttcacttggctaagaccaacattcttagaaagattcttggccttaagtattgatcaaagggttagtgggttggcagttctcatcctgccacacaaaaacacatttcagtgatcctcatcatcacagaggtagtcagtgccagaatgtgagtcagaatccaggctttctgacctccagttagaactgtttccttcacccctttgcccagtagtcagtttcctatttcttcctccctcatgttttattggtacatgttaacattgggaaagaagttctttccctggaagggcaataagagcatctcggaggcagcaagttttgggtgggaagctgaagacgaggatcaaaggcttggctttttgccaggccctcatgatggaacctcatctcttccatgtcttctgcaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggaggtaagaagaggctgctagcaaaaggggagaatgttagggtcctggggtaaaagttccaagttatactggccatctttgcctaataattaggacggttcatgtgaaaagtgtcaagatagcatgaactggccccaaaatatacccagaatctgtcttctgccaggttctctagaaagagtctcattctcggccaggcacagtggctcacgcctgtaatcccagcactttgggaggccgaggcgagtggatcacgaggtcaggagttcaagaccaccctggccaagatggtgaaatcccatatctactaaaaataaaaaaattagccaggagtggtggtgggcgcctgtaatcccagctgcttgggaggctgaggcagagaattgcttgaacccaggaggcggaggttgcagtgagccaagatcatgccactgcactccagcctgggcaacagagcgagaatctgtcaaagaaaagaaaagaaaagaaaagaaacagtctcactgtcatgtccctcacacactatactccagacatgctgaaactacttaaaattgcctaaatcaactattctgtcaagagtttgtgcctttgctcctgtcagattaccctctcctagaccctgtactggagaatctcatacttctcatttgacactaagcttggccatcatctcctctgcaaagcctgcttagacctccaaactgtctaattccaattctggctcatttcccctccctcttctggacttctgtagcccatgtacttcctctatcccagcactgttcacaatgtgtcttcagtgtatgccattcccaccagtttagtagctcccctagcacagggaccagactcatctatctctgtgtctctacaatagcctgagatagggctttaggggtacattagatctcagcaattattgttgagctgaacttatgactagaaatgcaccccaaattactctcttacctttgcatagattctccatcttgggcgaagggccactgtcccttcatgctgtcggaactccaggatgggaagagcaagattgtgcagaaggcagccccagaagtccaggaagatgtgaaggctttcaagacaggttggagtcaagttccaccttatgcaacctttactcctaatgcttgaacacactacgtcacagtcctgagctaggctaatacaaaagcagccagtacacatcccatgatgagaagtccagtctttccaggggagccatggtaggcaacagtttaggctgtatgctgaagcacaccatacctgacaaacacatatgtacgggctcctgaaacttttagtcattattctaagatgagccctctagaattttgactcctctttttcaggtggctaaactgatcccaacaggctggggtcccacatttcagcaagaccactctatgagaatatggatttgcatgaaagagaaagagctgggagtaggtacctcctttaaccagggtgcagatccccaggtcaacttaattagtgcagaccacccaagataatcacccttgagatatggccacactgttgacatctttcataggcccctttgggatatcattaaggacaaaaacttcaaaattgaaatttaatgatgtttagaaaagaagagtaaggtacattatcctgcatctactttctaaatgcaggacccagggtggctgctccagttacctgagccaagggaaaatcctagtggagagaagtatgattcaccttatagaaggtttcctaacaatgtaatagtctccattcggggggataaatagaagctcaccttggagaagatttcttctcgctgtagaagctgcccttaccttataaacttgaattttcatgtgttgcattgagcttaaagaggacaacacatgctttctttttcccccattctcttcacggccaatgaatctcacattccgtctcagatctgcctagctccctggtctcagtcagcctaaggaagccattttccggtccccaggagcaggagcagatctctgggaaggtcacacacctgattcagaacaatatgcctggtgagtttgctgaggtggaaaaaaaggggaccggaatagggaaggcattctgaaagggcctctgtcacagtaggggaaacagtacagaagggccttggaaccaaaggaaatttgagtttaaaatttaatgctggcacttgctggatctaggtgttttggcaagtaagacactttccttcagtggcatttaatacctacctcaataggttaccatgagaagaaagtgaaattacatttatggaagtgtttctaatgaggcttcattaaatattaggcttatttccattatttcttctctatgcttccctcaaaaactttcacccttcatacagcaccttttccccattcttatatgtgtttatattcctttccataatgacatttacattattttctaatgtaaaaggaatatgattcatggtaaaatatttttcaacatatacaggaaagtataaggagggaaatttaagtcatgcagagttccaccattaagtttttgttatattttctcccagatatttttctatggctacacacacacacacacacacacacacacacacaccctctgctctcttcaccacacccatgcttttgttagaagtgtgatcttattttacctggagttcgttatgctgttttgttcacttaaaaatatgtcatgggtatagtatggattcaatatcattcagttaatcaagcatctataatttaagttgtttccaattttttgtattctctcagtttagattgtaggttggttttacatacatacaaatgtactcaaagaaaatgtatagtattacttttttcaatttttatttttacctaataatatcttgctatatattttactctgtgcccttttttcactcaacaatatactgtggaaatgcttccactttaacacatatgtatctaccttatttttcaatgcttcaaaatattttgtagtatagatataatagagattatttggctactcctctatttggttgcttccaattttttctattacaaacagtggtgcaacaaacatccttgaatgtatctccttgtgtacacaggcaagtgtttctccaggataaacactcagtggtggaaattcttgggatgtaaggatgtgtacatttttgatattaatacattttgtcaattagccctccaacatggctgtaccagttatcaaggagggtatccatagtctcatacccttaccagcccttgatattatcaaactttaaatctttatcaattgataggtgaaattttgttttcccagttttatttttcctgattaagaatctttttctacatttattgaattgtctgttcatattctatgcccatttttctactgagttgaaatttttcatgttaatttttcagagattatataataaattctgagtatcaatcatttgtctgttaagtatgctgcaaatatttctctagatatgtcagtatgtgcatttaaaaaacttttgatatgtatttccaaacatctctgcagcaaggatgttaccagtttgcacctccagcagccatataaattgctgtctgcaacatgatttctgtctcacgtaaagagttctagagtttaacaagctctttggcaaacgttatttcaatttatcctagaaataaagttaccccattttgtagtggtaatggttaaagaagtgggctctgagttacttacttgatgaacacttacttgctgcatgaccctggtcaagttgtctaacacttaatgccccagttccctcatctgtaaaatggagatactaatagaactgtccatggagcattgttgtgaggaataaattaaatatttataaagttcctaggaaagaacttacatgtactaggcattcattaaatgttagctataatgatgtaattgaatattagctatctttattagtattattatgactactaatactatagcagtaataatactactattaccatgtgccatttattagtttgaatatattacatgttgttggttgtcagatgctcacaactctccaaggaaagtattattagcctcattctacaaataaagaaatttaaagtaagaaagaagattcatgacttgttcaaggccacacagctaggaagtggcaaagagatcgctagaaacaagatctgttgatactccttccagtgagactgaaagcagtgattctagtaaggaggctgccacaccaacccgggaagagagatgaggccataagaaagtctaaatgaatgtgtgaatgaactactgagtgaatgagtgaatgagtaagcaaaaggatggctgaatgaagtagtagagagttaatgtggtccataagtcaatgactgagcaaataaatgaatatgtggaaaaagagttggagaactcaaaatcagcaacatgggtaaaatacagactagccagggagagacttaaaacgaattcttttcatcctcatatctgctcctgcaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacagtgagtagtaggctttcagccatcagcagtggccagaggagatgaaaaaccacacatggaaaaaaaaaaaaggcagagctggcagtggaaacttgggttctatcaccacttcttttgtccaaggtcctccatcatatctattccttggatatgaaataagtcaacacaccatgtttcccaaactcttcggtgtccaatgctatggaggggaaggatgggagaccaagcaaggcccactctgcctgagtttttaatctagctgcagaattagtattgccagagatggagtgtgacttcctctaggtcttccaaactactcaagctcaacctagcttctccctctctccctgagtacctccagtcctagaaggaaggcacatgtctccctatcctccccatccttccctctactttgtctcataggacacagtttatataggatcactaactcaacattgactcccatcaaggaagagaaacctacccagttcctcgatgcctgacaagagtttctttttctccttttctcctgttttctcctggccagggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccaggtaagcctgaggcctgagctttgttcagggctggtatcctgcaatacagcatccagtttcactggttccatcactccttccctgtatttggagttccctcactcccattgttcttccttcttatccaccttgcatatcctcaacactggataattatatccctctgctttctctccttctgcacgtagagaggaccattaccggggaacattaccccacctcacagaaaggaaacactataaattcatcacctcccaactcaactgagctcttaacacacatacatagttattttatgtctccacaggagctttttcaaacttcttctcctcttctaaaacctctgactaccttctcctccacacttagcaaataacctcacatcttacttcacaataaaaacagaagccccagacagagaatccttatttattgccaccaaacctacgaacttatctaattgtttatctagccttgcctcattctttccttttacaatggaaggcatatctctccttctgcctaaaaccaatcccttcacttgtacactggttcccatattcccagtctcctactctctagtctgtaatgtcctcacctcatacgccttgttgtccttccgccaaggcccaatccagaatgaatacaaccctccatcttcactatatcaattccgggctcatacagttgctcagacaggagtcactaaaaattcatactcttaacctctactgggttctccatggtctctgacaatcccatttccctggtcagttctcgaagtttatggggcagttttgccaaaccaccattatcctcagccttcccacaccccctcctccccatctccctcagcagacaacttcatgttctactacattcaaaatagaagataccagacagcaatgtccttgactcccagccacaaagcacctacaaactcataagcatcttcaaatgtcctctcctcactccttctcttctgtcatagtggaagaagtatcctttttcttgtgactaatccttccactgttgctctgtgccccattcccctctaccaccttaggaatcttgacctattggctctctcctcctctcctgtatcttcagcctctccctctctttaaacatgttttcaagtctcttgtatcttataaaaaaacattgcctcaacccctgatcactctctagctactgccctctttcctccctataacaggcaaactgcttgagagaagtcttcgctcttactatctacttcctcacctcctgctgattcttcagcacagcaaaaatattaccaccacttctcagaaactttttttgagtccacccataagccccaactaaactcaacatctttaagttgtttttagtccatcccctcctcaaccattaaacttctttccatctctactgccagcatcctagcctgatccaacatcattttttaaagaaaattttacctttgccctccgataatctattctttacaacagtcagaattttttttaatgcaaaactatctttgtcaccccaccctcagccctggtcaaaaccctttagtggacccccattcccccaggaccaaatccaaatttcttatcacagcttctaaagttctcaataatctggcttctatgtatctcttcggtctcacctttttgcatccctcctctcactatttcattcagtaatacattcattcatatactcattcacttacttataaatctgtcatcagtttatttatccattcatttaataaatgtttacttagcatctactgtgtgcttactcttatactggacaccagagacagagagataataagatgtttttgctcccatgcaactcccagtctgcttgtctttcaagccattttctccagaaagccataactcattttctcaggtggaagttatcccttaatcttataataaggccacagttccttgatggcagtgcagttggtggcaggggttggggaggtccaggaatcaactccctctaccaatttcacatgcccacctgccccaccaggattgcccagtaaaaagccctgcattcttcaaatctttctggaccttagctttctcacttgtatagtaaagggatgaatcccatgatcactaacagccctgccagctctgacatgccataagcttatgattccaacagtaaaagcctgataaatatccatccctgtaaccacaagcagatgctacctggaatggatggaatttcatctagactaggaacaatctagcatcagtccgagtcaacaaacattccctggggtaatccctttttcaagtcttgatcttatatattggggagaaggaaaataggtcccgtcctcaaaaaactctgaagcttcttgggaaattaaatgttcttccaccccaaggcagtcagaggctagaccagggttacaaatgactggagggaaggatgtaggggtcagaatttgggaacagtgaagtccttccaagggagaaagaagtgtcacaaaagttcccagagaaggaagaagcagagcaaggtcttcaaagggaagaaagggttggcccttttctttgccaggtcaaacctgaaggttgaagtgggagtactgggacagaagcttaaggattatacatctgcttcctcagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtatgtatatgagtgagtgtatgtttactagtgttggtctcacaaaaaccatgatgatcatgatgatgatgatgacgataacattataacagctaatatttatagtgtttattatgtgccaagcaaaattattagtattttacatgtattaattcatttaattttctgaacaattctatgtgataggtgttattattattttgattttttacatgaggaaactgagacataagagtaatttgtccaaggtcacacagctagtaaatgccaaagaatggaggcagctattacattcatcttataggtaaagaaactaaagttcagagttggcatccaattcatcttgagtggctcagcaagttggtgctaaagtgagtatctgcaccctaacacatataactccaattcctcgagtaacacttctcttgttagaaatgatatgtaaatcaataatcccagtgtttggtttttatgaaggaaatttcaaaaaccattgcctaggatttttttcaaggtccagtatgaagcattggggtcaaaacaggttttcaagtcagagagacctgggttcaaatcccacctttgacagttactggctatgaccatgggtaactctttaactgtctaagcctcaattttcccaaaggtaaaatatctggttgtaagaattagagatgatagaaaccattctagttattatgctttagtagaattaaatgatcttcacactcctacctcctttctttgctcaattgaaacaatgtccaaagctttctattgctggccctgttgtgtagaaatcatgtgttttaggcatcctcttatggatttatttaagggaagaggtcctcaactcatttcagtttgtcccttttccaactgaaacaaaagagtccatagtattccctgatttaggtatcttaagtggcatgtaatgactatacacacaggctctaaaaccagactatccatgttcaaatcctagcatgaccatttactagcttgggcaagcttcttaattgctctgtgtctcagttctcagttgcttatttgaaaaatgtaagtgataataattaaataggtatgcaaattaaatgagttaatatatgtaagaaacttactattatgcccactcccacatttctaacactagcaataaagtaaaactatcctatcccttttgtatatttctaccactgagactattcaaattcattatttctctagtggaaactatgttggtaccattctacctcgttacatttgcaaataaatagttatttacctatttttggggtgcaaactctgcccaaactgttgatccttaggctgaatctctcccattgaaatgatgctaggctgaacacagcagaaacaggaaaatagacattgtcagaatgaagtaaaaacagaaagacaaagagtcaagccttgatcccaggctggggaacacacacacatgcgcacacacacgtacacacacacacacacacacacacacacacacacacacacacacacacacagagagacagagagagagagagagaaggcagggatgagatacaggcaatcgatccatacacagaggtttgtaatagttctaaatgaaggcgcacatcctccttcctctctacaacacccttttccaacccaaagtaggcatgtatgggaaattccacattggagatggagctggggaagggttatgatgtcctacctctatcccttggctttgctcaggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggtaagtgaatgctttgggccttcttatataccctccagagaggaggcccttacaaaattcttttctgcctcctccccaaagctataggggttgtttggacagaattcacagccccaggctgctgccatcctggactccctctctccactcgcatcccactgcagagttgatgagaaagtctggtagagttttttgaaaagaccttgaactaggccaaatagttagattcaacttgagtatgtgaagagctgtgtttctaaacccctcccccaccctagccccaagcttcatcttagctccactcctgaccctatccagctaaaggtccccacccagctcctgcctatctagtcattgcatatggcaagacttgaaagtcctatctcaaagcagcagaattatcagctacgactgccttgtcatggacagatgagcagaggcctgggaagacagcctggagccccaacttctggtgcacccccttgtgttatctggcacatgatcctgttgctctgggactgattatgggatctgtgtatatcttattcctttctgtctccaggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgagagccccaccatgcccattgccctctccacctatttattctgggagcctcacgctcccaacaaacctacatctgttgctgtcttcaattatttgctttcctgctaaccattccctttattgccagctttgtttccctttttgaaaaattatcagccattctggattaaccagtcttttccttgcatcagccattacctcatgcttattagattatcctaaccctaacaatagcgagtgctcacagcctataattcagagtttttcaaactggatcaagacaattaatgggtcacaaaatcagcttagtgggttatcattagcattaaaaaaagaaaagaaacagaaaatgttggagtacatcacatactaagggtatcatcaatttgtgaaaaatttgtatgcattttgggtatttgcatatacacatgtatgtgtatgtgtgcgtttatggtcacggtgtaaaacgtacttcttattgagaaatgagggcagaaaaataaaatcaaaagccataggattagctgctactttggatcctcaatatgagcatttactgcctttaaaaatgaactgctacttctttcttaaataacacgtatttgtgtgagtcagtaagccagggcagggaaaggacacttatttgtgacaattttgtggatgagaaatagtcactgctctttagactaacctagtatttcctttaaacactcattttatgaattaatttagtgacagcaccccagaattggcttggcgggggttccagaattggcttggtggggggtatcttctcacccagaaccatcccaaactaagatattagctaagtaaaatcagtgtgcttgctctgcaaacagcttccaaacagggctcctggtaccacctctgctccatccttttcaaaccaaattgctagctctgagctcctccttgatagaaattctggagctgccactaagcccctaatggaaaaaaaaaatctatcccaaaattcagtgatgttccctcatctagttccctccatctgcttaatggagctagtgatggtggagccagagtggcaggtactgattagcctttctcctgagtccaggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtgggtaagttctcaacatgggtgcctacaggacctccctcccctcagccccaggatctgaaagagaagctgagaggacagagaccactgagtttacaaaatatttctggaacatctaatgtgtgccagcacctatactagggtcacaaataaatgagaagcagcccctacacttgtagggctccagtttggttggggataccatagtgaacacaaacaatgacactaagggatgatcaaagctccacaaggcagtgcatgatagagttgtcggagcagagaggaggggcctgactcagcctgagggatgcaagacccacttcctagtagaggtgacacctgagctgagtcttgcaaagtgagtggtattaaaagaaagagggcatggaagaagtattcctaccagagggaagagcatgaagataggtgaggagaatgagaagcagccagggatatatcaagaacaataagcaggtggtattggaatgtagggtcataggaatggagtggggcaggggagtatcaatctatgagtctacaaagacaacatgagatagagactggattgagaggcttgtagagctgagtagtttgagatttaccctgaaaatgccagtttagtcaattcacctaatgtttgttggatttctgttgggtagttttgtttttgtttgtttgtttttgtttttgtttttttgagacagagtctggctctgtagcccaggctggagtgcagtggcacgatcttggctcactgctacctctgcctcccgggtcctggctcaagcaattctcctgcctcagcctcccaagtagctgggattacaggcacgtgccaccatgcctagctaatttctgtatttttagtagagatggggtttcaccatgttggccaggctagtctcgaactcctgacctcgtaatccacctgcctaggcctcccaaagtgctgggattacaggcgtgagccaccatgcccggcctgggtagtttttaatgcagggcctgacattgaataggtgctcattccaggcctgttggatgaaagacatgtaggcagttgatggtctagcagaggagccagatatagatggtactggtccagtatgatgagctccagtattctgggagctagagggagtggacacattatggagagagagggtgggaaggatgaaattggagaggctttgtgagtaaggaagtttttatgatgcatgttgaagtacatgtgaatatgttgtaagaatattccagaataagggaattccacgagcaatgacctagagataggaaagcagtgggtatgtattgacaacataattctgtttgtctgaagcatgggcagtatgagaattcaaggaagacaagctaggtaggcgccattcattcattcaaaaacattaaataatgctggctaacattaagtacttaccatgtgccaagcactgttctaaacactttacacgtattaactcatctaatccccacaacaacctcaagagttagagatcctcttatcatttccattttgtacatgtggaaattgaggcacaaaaatatatagtcgctgatccaaggtcacacagcttctaagttgcaactgggaggtctgtctctacctccatggtcataactgctaggtctaccacctctctgagctgatgacccagactcctgggccttttgttcagtattctcttttgctctgggcttcaattgtagagctctcagtattcttggttctctgaatgtccacctaggctaggcttttgtaagaatatatgaggcatccacgatggctccaccagtccctaagttccatagccaatccatcctgaaatcctgcaaaagttatctataatctctctcaaacctatttgcttttctcccctgccacttctttaatccatgtcaacatgatttttttcctaatttctctgcttctctcttgctcctctcaaatcctttctcgatgatgaccactagagggatttttctaaaattctgactatattgctcccttgcttaaaccccttcatgtttccctctagactctaaagcagtgacctccaaggggtatgcaaaatgattacagggtgaaggaacagaatatgtattagaattttatgtttttttatcttaaaaataggaaatcaagcatcactgatactgatctttaatatacagactgacagttatacatgtatataatatataaacaaatatagagattggaggtacatgctaaaacatttgtactgatagggatgtatagtccaaaatttggaaacattgacatataggacagagttgaagctcttcagcatagcattcaatgccttccacatggtgatctctatgccctcacctcctccccacatgcattttgttttttcagctacactgaaggacttgtcgttccctcatttttttctgctctcttacctctgggactttgctcatgctgctctcttttgattggaatgccctccctcacactttcctctggcttactttccttcatcttgtagacttaacttaggcattctttcaacaaatatttattgagtaccaactgtgtactagatactgttctaggcactggggatgcagtagcaaacaaatcagacacaaaattcctaccctctggagcttacattctagtggaaggggtagtaaaaaaaattaccaaaaataagcaaattaagtagcacattagttctaagtgctatgggaaaaaataaagcaggataaggagaatgggataaggggccaggggcgagttcagagaagggttgtagtattagagtggcaagggtagaagacgctgaggtgaaacttgagcaaaaatttgaaggaggtgaagttagtgaggcagatatctaagggaatggcatcgcaggcagagggaacatcctaaggcagggaagacacaggagtattccttttatatttgaggaacagtaagaagatgggtgtgggtggaatggtataagcaagtgggagacagaaaaattgagtacatagaggcaatgtgggaccagattgtatagggtatggtaggccattagaaggagtttggcttttactctgagagcccttgaaaggatttgaacacaggactgatatttctgactcgggttttaacaaaattgctccaacttctatgtagagaatacactaaaagggagcaagggtggaagcagggagacccaagagtgggctacagtaatatcccaggtgagagatgatggtggctcagacttgatcataatgaaggcaataagaagtggtcagattttgaaggtagagccaagggtctttgctgatagatgggatatagggtaagagagaaagagaaaaataaaggatagctctgaaatttttggactgagcaactggaattgccatccactgagatgggaaaagctaaaagtagaatagcttggtggagggtagggacatgagtagctcagttgtactcctaagttagaaatgcatattagacatctaggtggagatggagaaaagccattggatatacaagattggaaaccagtagagtggcgtgagctggagattaaaatttctgaaccatcagcatatagatggtctttaaagtcatgtgactagacaagatcaacaagggcatgaacacagaaaaggccaagaacagagccctggaacgtacctggggtacttcctccagctaggtcaggttcccttctctgggttttcacacccccaggtggaccccctaccccaggtttcctggtcatagcaccaatgacacagtatagttactgtcattatcattgtcctcatagggcttagagttcccaagcagacagtcattcttgggccacagcacatcctatacttagggagtggtccaggccaggacagtatggcttcaaattgtgtcaaaggagagcttccaaatcttttataatatatatcccagcatccagatacaaatggtaatattcacggcacacacagaagcaaacagtaggctacttctggccctgaggtatcttgaagggttgagggggatcaatatcttggctcatctgtactgtgacagatttggaagatctagtctaacccattttttccctcccctccccctaccaccttcagagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagcatgtgaagccttttattggacagggaacagacaagtgcattctgactccctcagacaagtggcagatctatgaggtaaccataggtcacttgttggtcaccattccattttaccaacagggaaacagaatgagaaagaggaaggaaatgcccaaaaactacacagtgagttgcaaagagctaggatacttggcagatttatttgagatggctcttctccaatggtttcaataaaaatccagggattgacgcttcactggtaatccgggccctggaaatctgggcccagggtagcccctgaagccaggaaatgagtcagccctaaccaaattccctagaaaggagtggttccccaaaaccaaagaggtattttccataaggggatatggatgtcttcctcaatccattatcctctctccctcccacggcatcccacagaacaggatttaccagtcccattctttttcttttctttttttttttttggagactgaatttcactcttgttgcccaggctggagtgcaatgcatgatctcagcccactgcaacctccgcctcccaggtacaagctattctcctgtctcagcctcctaagtagcttggattacaggcacgcgccaccacgcccagttaatttttttgtatttagtagagacggggtctcaccatgttaggctggttgcgaactcctgacctcaggtgatccacccatctcagcctcccaaagtgctgggattacaggcgtgcaccactgtgcctggtctaccagtcccattttcaaaggtgagaagaggcttggctagagcaagcactgtgttcaaagcaatgctcccactttccaggtcacagtatacaggaaacatttccatggcacacttaggggtactaatgatactacttgctaaggaggcaatcgtccctgaaacttgtgtggtcccaggccctgcctggcaactctgagggctgaggaccgtttctttcaaccctgtaacccactgtggcagctgtgggacgcactagctggaaagctctggtttaaggctacacagcccaccttccttgctgatttcaccttagccgtacaggaaattcctacaactgagcagagaaccctttatggtgagcactgctgctcacgcctcactattccctcctcccccctccctcctcccctttctctgggaattacatcattgggctacagccagccggcaaaccaagtattgagatagcttctctgactcaactttatggagtacctccacaatgtccaaagtgcaaccctgaaacaaatacacagactttatttatgcacaaatacactttccagcaaagacagaagtgatttaaaatcacacaacttcctggggcagctagtgtccgtgtacttcggacaggaaggtggaaagtggtgtaaggggctgggtcacaggattaaggcacaagaagctcaccaacaaggagctaggtaggaaggaaagcgaggaagagagggcttaaaagaggaagagaagggtaggagactttgagggagaagcaggaggcagctcagggaaggggagctggcctcagatcatgtgcaggggtgaccatgccagatgtccccaggcctccattggttcagctgggcctgctccagaggaagaagttgcaccgggaggaggggtcagtgggaggaccccggggcctggcacacatgtagaagcggcggcccaagttgggtcctggcttcttcacagtacgcatcacacatggctccctgtggcccccacagaggggtgtgcgcaagggccccgccagcacagacttccagaatgaggtccgtaactccttctcatctttggcttctgaagtcttggcctgccccttcaccactttggccactgccttctcttctggagtcttcggggtcatgagggcgctcatcagtggtaggctaggcagctctatgtcaggagaggcttggggacagctaggggagggctgaaagtagctctt

SEQ ID NO: 12903 - DNA, 27632 bp, Human
gaagttgcagtgagccgagatcatgccactgcactccagcctgggtgacagagcgaggctccgtctcaaaaagtaaaaataaaaataaaacaggtaactaatacctaataaagcttgaaaactttcaaactaagttaaaaataaaaagagcttgacatccgactgtgaggccagctgtgctgtctgctccaggtgtggctgccacaattcacttgtggtccctcataggcctctggggagggtgcagctggaagggctacagaaacccacccagtagccctagaaagtggcctggtcagggccccagccccactcagccccatccatctctcaagtgggcccccagcccaccctctccatgaggcaggcctgggcgcctccacccgacacctgcctccagttcttctgggcccaggcagctgcatcctcaaaccaggatgtggagggtcacccctcttgtatccccagagtggcaaacctggccagccactggccatctgtcctcccagggctgcgtctgcccccgtgtcctccagaggtacccccttgaaatccccctccagccactgcacaccccacctcccacctgtccgtcatccaatcagctgagagagggaccttccagagccccagctagcacctggggcccagcccagcacccccctggacaactctgagcgtcccacctgcactgcacagaggccctccccagcctctgcccctgtggcgcccccaaactggaactgcctccaaatccgcctgttctctccacacccaccttccaaggcctagtgcagtgccaccctccacacagcccctccgaccccttccgttggactcaatcaacagttgccttctcctggccactgcccccaaccacgacaagcaagggctgcttggccttgcaacccccaggcacgtgacggttcaggacttggtgggccggagcatcccttgcccaaggttctgaacttgggttcccgtcacctgcaagtcagtgccggcggcgcccctaagcgcgctcagcccacgccgcggtccctctggatgaggaccggcgcctctccccagctgcgcccaggcgctttcggggcctcggggagctggcggaggcctcctcctgacctcccagcaagccctgcgcaggagaggatgcggccggccggcccgagcagcctcaccgagcggcagcagcgagtggcacaacagcgtggcggccgtgcggcgcaagtggaagggcacgaaggcggcgtcctcgctgcccagccagcccgacagcaggttctgcaccgtgagccccgccgcgtggaactcgttgggcgtgaacacgaagcacacggcgaacaccagataggcgagagtgaaggtcacctcggggctgtccatcgcgcagccgccgggaagctgtcgagctaggcccccgccccggcgcgcggacgaggccgcagcgcccagtcccggacctgtcggttgcggcggccgccgcccggccgcccgcggggcactctaggacatggagtcccgccgcccggccgcccgcggggcactctagggcatggagtcccgccgctcggccgctcgcggggcgctctgggagatgcagtccccgtgcgggtgcggcctctcttctcggccggccctggaggcggcaccgcacctgtgcattgagcacaggtggggaaacttaggcctgagcgaggccctggccatgaagccccgcccagtagcgtcagttgcggaactcgaaattcatggggcgactgcgagcccggggtctcagcttcagacaccctggcgtgccctccactccggaaacggaaccgtcggcgcccgagcggggggtggggggggagggagggcggagcggcgaggcacagcttcccattggacgcccgccctcctgcggtcctgcccccggccgcgcgctgattggccgcgcgaaggcaaccgtcggcgtttgaaactccggcgcgccggcggccatcaagggctagaagcgcggcggcggtagcagccaggcttggcccccggcgtggagcagacgcggacccctccttcctggcggcggcggcgcgggctcagagcccggcaacgggcgggcgggcaggtaggagagcggctacacggcgcggggaggctggggtcctgggggcgcgaggccgtcccgccccgccccgccctcggccctcgccctcccgccccggccgccgctttccccgggaagcgtcccccacggctcctcctggggccgccgccagaacctgtaccgcgccctgtcatgggacccggccctagaccgaccgccgggctgggccccctggatggtggccaggggcggctagagctgggccaagaccgacggcggagcgggcgccccgaggtgctttgctctcctcgaccctctcctgtctctcggtcgcccaccttggctctttgttggctcccagcacgcggaccctcctgttgttctttggtcccttccggcctccgtcctggggccaactccatctaggccacctgcggcggacacctgggcccctaccgcttccccgcacctgctgcgccgctccaccttccccccgcaccgcatccctcttgtgcaccagagtagcaccaaagcaccagcctggggccggtcccttctctgcccagagcccctcccgggcctccatagtcagtaaaggcccctcctgactaaggctgggtctgctgctctcccgagctcctccaggccgccagaaggcttcctccgagtcactttctccctgagttcgaggcttgcgggtcccccagcgatccagcaccccttcccctgccctgtacccagttattcagggcgaaaacctaagcgtcgtccgtaagtcccatatgtgccagtggccaggcccgggtctggtctggcatctactccttgggctccagaagcctgtggtttccctgcttcccttctgctcttaacctccccacccacacacagcaccacagtgggcttctcaagctgcagcaccgacctgccggggctgccccctctctcttctccaggaccctccccaactttgctcttcttcaaatcaaagcctccccaggtccccctccaccaccaggtgcctgtggggttcctgccctggtcgacactcggttctctctggcagcctttttccctacgtcattccctagactgggaacgctgtagacagaaagggtggcaagtgtgtgggtgaccggcgtgaggacctgggcagccctggaacctgggactgactggaggctctgatgtggaagttccttggcacctgttgctcagctctgggcttcccttgtttgcgcatcgtctcccagctcctcctctgggccttcaccctctcagcctggtcttgtcccgctgcctagcccggtgggagagagcagaccagagccgctgtcctgcttttctgccctctactgcccggtcctgcctcacgtcacacgcagaggcctgtggggagaccagggcttcctctggctcatccgggtttcttattggcccgggcttttctgtctcttgacttctgcttgatatagtaatacagcagtagagattatgcaggcttgggttttctttctcaccatctcagcctgaaggccctttagctcttggtcccaggaagcagcagtgctgcccatggctccccctgccaggctggagagtgagtctctgaagcaagatggggactcagtctgaggctttctctgccaagagacacgtgtgggaggtgtgagttccagagcaatgagcacacctgtgtgggaagtggtcgtgccccttgcagcagctgtcacgtctgtgtctggacaatgtggtagtgttgccctcacactgacacaaacatgttctgcttttccagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtaagtgtgacctgtacagtgtgtggctggccaggttgccctagggcctgctttcttggtgacctctgagctgcaggacactgctggtgtggctgtaacagcttgaactaatgaataggtgctctcctcctcactccgcaacaggtgacttttcagacacctctgcgggatccacagacgcacaggattctaagtcctagcatggccagcaaacttgaggctcctttcactcaggatgacacccttggactggaaaactcacacccggtctggacacagaaagagaagtaagtgttggtgctgctggacatgctggagcttcaccctctctgtccgatggctcttgcaggaaagtgctgtcttgttctatcaggccttggctggattttttgtttgtttgtttgagatggagtctcgctctgttgcccacgctggagtgcagtggcgcgatgtccgctcactgcaagctccgccccccaggttcatgccattctcctgcctcagccttccaagtagctgggactacaggcgcctgccaccacgcccggctaatttttttgtatttttagtaaagaaggggtttcaccgtgttagccaggatggtcttgatctcctcctgacctcatgatgcgcccgccttggcctcacaaagtgctgggattacaggtgtgagccaccacgcccggccggccttggctggatttctcctgaaatctgcactgagtgtatgcagcatatggccagttcactaacagaaaagtcgatcatcagatacttggataacttcatacttcacttttttttttttttttttttttttttctggagacagagtctggctctgtcacccaggctggagtgcagtggctcgatttcggctcactgcaaactccacctcccaggttcatgccattctcctgcctcagcctcccgagtagctggggctacaggcgcccgccgccaccactcccggctaattttttagccgacctgattcttaactgcaagtggatggcgaggcggtgtctgtctttgcctagaaagggaggatcctggaggcagctctttactctgcggctgaactaatctgtctgggcacccaggaacacctcatctgcatccagggtgggaagggaccccagaggcatgattttctgttggttttttgctgatgtaactgttgttgctgttgttttgagacagagtttcgctctgtcacccaggctggagtgccgtggtgccatcacagctcactgcagcctcaacctcctgggctcaagcagtcctccaccttggcctccttagtagctgggactacaactgtgagccaccatgcccggccaattttttttttttttttttttttttacacggagtttcattcttgttgctcaggctggagtgcaatggtgcgatcttaactcaccacaacctccgcctcccaggttcaaacgattctcctgcctcagcctccgagtagctgggattacaggcatgcgccaccacacccggctaattttgtgtatttttagtaaatatggggtttatccgtgttggtcaggctggtcttgaactcccgacctcaggtgatctgccggcctcggcctcccaaagtgctgggattacaggcatgagccaccacgcccggctggcccaaaacttttaagcagattttagatgtgcagagaaaagcataaggaacagaataccactgatgcttctcaccccctgagataaaatgtcaccagtaagtgcaggcagcatttcctacatccttctctgggccctgggtccgtctcccctctacccctccagcctgaatttgcagttcttcccatgtctgcttgctacttttcaactttgttttttgccccttttgaaatttggtcaaacgaagtgagaatgaatcaaacattggtttacaacgaccccaagaaggaagggagacccagcagcagagaagtcgcctcccagctgccatgggtgtgatccgtcccagagccacagatcccctgcctctcccctatgcctccaggatcacccagcagcctccatagggcagagggtgtagaggagctgggaggggcttgagaggttggccctgaggggctccagccagagtgactctgagcttgtggcttggactcgtggctgtcatctcctttctggaactctgctgaggcccaggtggtggtcactgtggtgctcccacgtcagtgggatgagaccaagagcagccgctgcgtgcagctgcccacgtgtcattcagaggacagccgagtggccgcctgggaaggcagtgccgccccaaggtggcagctgggcagcagaggagttgtgagcagtctgacaggtccctcaccctcagtttctcagttttgacatcttcaaacttagagttggaagagaagggcaggtgacatgggccccttatctgaggcactggcacatgaccctgcgtcttctcagggacctgaaggctggggaacaggtgaaacagtgtttgtgccctctgtgttgtagtccagccccaaccatcccaacagccgcctcttctgtcaggggccctgcgccatgcagtcccacattgtgagcagcgagtgccccagagacaggtgggtccctgggaaggtgttctctgcacctgtgccactccactgtagcaggcgccatcccagggaggcgtcgcagaggccactcaggtccttctgtgcctgcaggtggcatcctgcacctcagccctgcccttcagtgaaggctttgactgtccctggccacagcactgccagtccccgacttgaaggggaaagcagattcatgcagaaaacctttgtttaccacgccccctgctggccatcctggggcctgcaagtccccaggactgatctgttgggcatgtcctcgggtgaggtttaagccacaggacaatgttgactgagctttcttgttttgcttgtagctgatgttttcacgcagattaaagtgttatcggaatgctgtcaggtcccttaatgttagaattcagggtcattaagtggtgcacacccttcagtgattaggagaaacacaggcagaaataatgattatatgacttacaggcccacagcaggctggaggccacacagaggactggggccaggccctggagcataggcaggggacagctgagagggtggcagccagccttgtctatcggggagtagggtggggtcactgtatgctggtgggcaggtgctcgaatggattttttacaggaaatggtggatgccgggtgcggtggctcctgcctgtaatcctagcactgggaggccgaggcgggtggatcacctaaggtcaggagtttgagaccaggctgaccaacatgatgaaaacctgtctctactaaaaatacaaaacaaaattagccagacatggtggcgggcacctgtaatcccagctacttgggaggctgaggcaggagaatcgcttgaaccccagaggtggaggttgcagtgagccgagatcatgccattacactccagccttggcaacagagcaaaaatccgtctcaaaaaaaaaaaacataaaaataaaggaagtggtgggaaattgaggagcccagtctaccaggtgggagagatgcctccaggcttctttctctggcatcagcttgaggcatttgggtgtgctgtcccacatctgaccccccaggcagcagcctgtgctgtgtgcatgctgtgggcctgggggcagacctcgtgcatgatgacgagtgctgtttgggtggcagaggctgctggaggagtctgggtccagcacctggcaaagcgcgtgatgagcacaattaaacaggcaagcagcccagaggcacccctgtaacttggaaccccaagaagcatgagggcggggtcagcgaggaagtcacgtggttgtgtccagccgttccaccgggagctggtccctgggaggacaggaaggaactacattgaggaactgaggtggggggtggagaacgggaagccgtgccaagggtgactcagccctgcttctggtgtgagaatgttaaacctatgttgagaatgaatgctgaggcccctaacctcaccaggtactcgctgcttcacgttgattaagtctcttttaaaagccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagtaagtgtgaggatgggatggggagcgtggcgtggggcagctgccctgcagtgtatgtggtccaggacccgaggccagaagtgtcatcagatactcctttgaggccgggtaggttctgcctgaggaggggcctctggataaaaacagggctcaggtggctcccagctgagggtgcttggccttgccttggctgccatgcatctctttagtgctcctggcctaaggagggatccaataagggcgggctcaggccagaagccaaatgcaaccaaccctgggcaggaccctgtcccccagtcatgttcctcctcaggtgaacttgacttgggtgtgtaactccaaaagccaggcaaagcctgttactgcctgggtggcgtccgctgcttgctggggtcttggccgtgggtctgctgcctcctggctgaatggtcttaggctacatctcctagagttgctcagtgggagattgtcctgcctgtagggtccagccctactgggtctgtgggttttttctcctcgtgtgcatagacaagagattgtacaaataaagacacaagaaaaagacagaagaaaagacagctgggcccgggggaccactaccaccaaggcacagagatcggtaatggccccgaatgcctggctgcgctgttacttattggatacaaggcaaggggacaggttaaggagtgtgagccatctccaatgataggtcaggtcacgcaagtcacgtgtccactgggcccttccctgtttggcagccaaggcggagagagaggacagctgacgccattattttttctatgtatttcaaagactttagcactttgactaattctgctactgctatctagaagacagagccaggtgtacagagcggatcatgaaagtggaccaggagcgtgactgctgaagcacagcatcacagggacacaggcctctggatggctgcgggcgggcctgactgattccacaagagatggtggagcagagtcttctctaactcccccagggaaagggagactccctttcccagtctaattaacgggtgccttcccaggcactggtgctaccgctagaccaagctaggtaacgggtgccttcccaagcgctggtgttaccgctagaccagggagccctctagtggccctgtccgggcgtgacagagggctcacacacctcttccggtcactttctcaccgtgtgccttcacctcctatctctatatggcctggtttttcctagggttatttgtttgtttgtttgttttttgagacagagtctcgctctgtcacccaggctggagcgcagtggcgtgatctcgcctcactgcgagttctgcctcccgggttcacaccattctcctgcctcagcctcccgagtagctgggactgcaggcacccgccaccatgcccggctaatttttttgtattttttagtagagacggggtttcaccgtgttagccaggatggtctagatatgacctcgtgatccgaccgcctcggcctcccaaagtgctgggattacatgcgtgagccaccgcacccggcgtttcctaggttattattgtagaacaaagattattataatattagaataaagagtaaagctacaaactaatgattaacgatattcatatataatcatatctataatctatttctagtataactattcttattctgtatatttatgatactggaacagcttgtgcccttggtgtcttgccttggcccctgggtggcttgctgcccacacctgccccagcctccacatttgaagccttttgtcagtttcacagtaaaagggatgtactcatccttgtgattccctttggctgcatcgtgctgactttagagctcccagcctgcttctcccagagctggcaggcaaggcgcgtgttttcctgctgggtgaggttggtgaggcagttttgtggccaggtcgcttgggacagccccatgcctggcacgctctagctgaatgttcacgtggccggcacagcagtgcagggaaaggcgatggcagctcagtgctggagcaggggacgccggggttatggggtggggggcatgggcctctgctgactctgtctccccaggcagctgcattcagcctcagcggaggacacgcctgtggtgcagttggcagccgagaccccaacagcagagagcaaggtaaggggtgcttgtgtgggtacctgtgctcctggcctggtcgtgtagaagagtagcaggcagtggaagcccccagcagccttgggtgacggggtgggatgtcccgctccctctcccccaagtctacttcaacaaggttgtggggaggcaaagccacaccccaagtaccttgactgcactgcacagggtgactctgccctttcctccaggagagagccttgaactctgccagcacctcgcttcccacaagctgtccaggcagtgagccagtgcccacccatcagcaggggcagcctgccttggagctgaaagaggagagcttcagagaccccgctgagggtacgttgcctggcacagacgtcacacacagtctgcccggaggggatcccgtgagcacttgggcagctcgagacacctgcatcatcggcaggtggtcatttcgcaggcagttgggtcccttgactttgaatgactcatgcacaaacttgtggtttgtcaaaacttagtcagtgttaggagagcagggctcatacctttaacataaaagacttctagaaatggaaactgtagactcaggaaaatgagcaggagaggtgaacaatgcagtgcgctaatgagatacaagtgtagagtcaacaactggatactcgatcatcagaaatactgcttgaaacgaccttcttttttttttctgagatagtctcgctctgtcacccagcctggaatgcagtggcacaatctgggttcaatgcaacctccacttcccaggttcaagagattctcctgctcagcctcccgagtagctgggattacaagcatgtaccaccacatccagctaatttttgtacttttagtggcaacggggtttcaccatgttggccaggctggtctcaaactctgacctcaagtgatccacctgcctcggcctcccaaagtgctgggattgcacgcgtgagcccccgcgcccggcccagaaccccttgataatgaaatgtgaagcctgaaccttagacaccagactgcagttaaatacggtttgtccgtaagactggaggctgcagttgaatacggtttgtccataagattggaggctgcacttgaatacggtttgtctgtaagattggaggctgcagttaaacatggtttgtccataagattggaggctgcacttgaatacggtttgtctgtaagattggaggctgcagttaaataaatacggcttgtccgtaagattggaggctgcagttaaataaatacggtttgtccgtaagattggaggctgcagttaaataaatacggtttgtccgtaagattggaggctgcagttaaataaatacggtttgtccgtaagattggaggctgcagttgaatacggtttgtccgtaagattggaggctgcagttgaatacggtttgtccgtaagattggaggctgcagttaaataaatacagtttgtccgtaagattggaggctgcagttaaataaatacggtttgtccgtaagattggaaggtggaacggtccttaaattaaagtgcatttggtaggaactgatggctgagttgttttaaaggacacacagccaggtgggtgtaagatctcaatttagagaactgaaaacccaggcacacagcagacacgaatggcatgtagggtttgtcgctgacaggatagttgtgggccgccaccatgtggggatatcagctcagctgggatgggcctgtcaccctcacgcaggatccctggaatcacacagcacggccttctgtgtccggcgtctccctcggggaggtgtgtttccgagtcctggccatgctggagcaggtgtgggtgctcctgtccttgccgtggcagcttggcttcacatcatcttatccattcattcatggatttgctggtttctgctttttagctgtcaggagtagtgctgcctcgaatgttcaggtgtaagttctatgtggatgtattcttccatttctcctggatacatagctaggagtggagtcgctggtcacagtaactctgctcaccttttagctaccaggtggccttccagagtggctgcagtgtttcacattcccactggcagttataagagagctccagtttctccacatcctcgccagcgctgcttgtctgtcttgttgatcctagacttccagcgggtgggaagcggatctggttgcggttttgatttgcagttcccaggtggctcatgaacgagcgtctttttatgtgctcgttggatatcttctttgggaaagtgtctgtcgagatcccttgtccattgagccacttatgtttttattactgagttttaagaggtaaatcccttttattcaagaagtgagggaaaggaaaaaatacaaagttaagtcccttatcagatgatgtttcaaagtattggcttttggccaggcataggggcccacacttgtaatctcagcattttgcggggccgaggcaggattgtttgagccctgtagtttgagactaacctgggcaacatggcaagacctcatctctaccaaaaaaaacctttttttttattacctgggcatggtggcgtacacctatagtcccagctgctcgggaagctgagatgggaggctcgcttgagccaggaggtcaaggctgcagtgagccatgattgcactactgcactccagtctgggcgacagcgagaccctatctgaaggaaagaaaaaaaaggcagaaatgaaaactgacaacaaggctaggtgcggtggctcacgcccgtaatcctagcactttgggaggctgaggagggcgaatcacctgagatcaagagtttgagatcagcctggccaacatggtgaaacctcatctctactaaaaatacaaaaattagctgggtgtgttggcacatgcctgtaatcctagctacttgggaggctgaggcgggagaatcgcttgaacccaggaggcggaggttgcagtgagccgagatggcgccaccgcactccacctgagcaacagagcaagactctgtctcaaaaaaaaaaaaaagaaaagaaaactgacaaggccatagcagagaaggacctacaagtttttgctagactaaataattggcaaccgttttttagcttaattgagaaaaggagagaatgagcaaatactgctaggcatgaagaaagggacaaaactagagatgcctcagcctggatctcagccagatcaagaccctgtcttaaagtaccagtttggtttgtttttttcccgagacggagtcttgctctgtcgcccaggctggagtgcagtagcatgatctcagcttgttgcaacctccgcctcctgggttcaagcgattctcctgcctcagcctcccaagtagctgggattacaggctcatgccaccgtgcccaactaatttttgcatttttcgtagagacagggtttccccatgttggccaggctggcctcaaactcctgacctcaggtgatccacctgccttggcctcccaaagtgctgggattacagatgtgagctactgcgcccagccacagtttaagagttttatagttttagaggccgagaccggaggatcacttgaagtcaggagttcaagaccagccctggcaacgtagcaagactcctcctctaccaaaacaaaaagtaggatagttttaactctcacagttagggtgttgatccattctgagttaatctttgtatgtggtatgaggcaccttttctttttttttgcaacagttttccctccgctgcccaggttggagtgcagtggcataatctcagctcagtgcagcctccacctcccaggctcaaggagttctcctgcctcagcctccctgtaataggagtgcagcaccgcgcctagctaatttttgtattttttgtacagacaaggttttgccctgttgaactcctgggctcaagtgatccactcgcctcagcctccacccttagttttaatcaaaagttatattatcaaaaattaaaagacttgtctagggtaattttaaagactaatagttctcaaccagagcagttttgcccccgcctttccccagatgtttgtggttgtcacacctggaggtgctgctggcagggagtgggtagaggctggggatgccgctcagcaccctgcggtgcccaggaggcgcctgccgcagacagcagtcaggccccgaacatccacacctccaagggaggaaatactgctggctggaatgatcctgcctcactgagtgctgagggagacaccagcccgccgcccttagggccctggtgaggggcgatggcggcggcatgattcactcctctcagttctaggcacgggcgcggaggtggattacctggagcagtttggaacttcctcggtaggtaccaggcaattccgcgaagcctcacccacagggtgtccgagagcagccacggcaggtcttgcccccggagcgtcccttggtgcccacgtccccccatctgcacacaggcccaggcattgtggcgggctgtgaatccagggccccttctgcagcacctcctctaagtggtgtcctgtgggagggctctaggggtctctacctggtgcctagcccaggatgaaactctgacacgctgtgctgctgggaatggtggtgtctcgggcagggttgtgggtgaccggcggtgggagtgtgcgggtgaccgggggtgggagtgtgcaggtgacctccctggcccttagcccccctgtgtgtgttaggggatggcagtcagacctgatcacttgccctcttgtccccagtttaaggagtcggccttgaggaagcagtccttatacctcaagtttgaccccctcctgagggacagtcctggtagaccagtgcccgtggccaccgagaccagcaggtatgtgcgccggccctccctcacgcatgaagccttgagtgtgggaagactggaggctgttcctaggtgtgctgtctgcacagaggcttctagaccggggggagatgatcagaactggaaaggagctgtgctaggggtgggctgggcagcaaggccagagcagcccttgtgtgtctggcaggagcaacggcagcctaccctccagccacagggctgctgccttgctggttacagccaccgttctaggtatattaaagatctaaacttaaatcttttaagagtacttcctctaaaacagaggtcggcaggccaggcgcggtggcttacgcctgtaatcccagcactttgggaggccgaggtggatggatagcctcagctcaggagtttgccaccagcctgggcaacatgttgaaaccccgtctctactaaaatacaaaaattagccgggtgtgacggcatgcacctgtagtctcagctacttgggaagccgaggcaggagaattgcttgaacccaggaggcggaggttgcagtgagctgagattgcgccactgcactccagcctgggcaacagagtgagactccatctcaaaaaaaaaaaaaaaaaaaaaaaccaaaaaatagaggtcagcaaactatcacctgtgggccagacttggccactgcctgtttgtgtaaagttttatcgtcacagagccatgcccgttcctttgcaaattgtggcaactttcacactacaaggccagaactgagtagtgtgacagaggctgtgtggccttcaaatcctaacacatggccgggcgcagtggctcacacctggaatcccagccctttgggaggctgaggcgggtggatcgcctgaggtcaggagtttgagaccagcctggccaacatagtgaacccccatctctactaaaaataacaaaaattagccgggtgaggcggcaggcgcctgtaatcccagctacttgggttgctgaagcaggagaatcgggtgagcctgggaggcaggggttgcagggagccgagatcatgccactgcactccaatctgggtgacagagtgagaccctgtctcggaaaaagaaaaaaaaaaaggctctgagctgtgaacagccccctgatgaggcagcactggctccgctcagcctgcagtgggtaatgaagcgtcaccgtgctctcccggaaggacaagcagccacgtgggatgggcaggtgagggaggggggcacggagcagcagagaggccgggcatgctggatgcgggtctgcgttttctaccactaccctgacttgagtggttttaaactaaaaagcaaagagcccggttagcttgtccacatggtcctctgtgtcctactcaacactgggagggcctagtgactgaggctgcctctgcttggtggcagcatgcacggtgcaaatgagactccctcaggacgtccgcgggaagccaagcttgtggagttcgatttcttgggagcactggacattcctgtaagtccttgagtccctcttgaactgtcttgtgtgtggtctgagggaacgagttgttttaagggcctatattttctattcctgggggtctgagcctttggttttgttgggggcatggggccgctgtgctgttccctcgccgcactgtctcgggtccctcatgcactgtctgaggctcttggcctgtgtgggcctttcctccctcacactaggtcagaggtaagaggcaagggcgaaatgggttcctgtttcatccccatctcccgcaggtgccaggcccacccccaggtgttcccgcgcctgggggcccacccctgtccaccggacctatagtggacctgctccagtacagccagaaggacctggatgcagtggtaaggacgcaggtagtagctattccacagaacctgcaggccgctctggggcttggccaacagtgggcaggggtccaacagcctgacccgccatccctgcccctgctggttggggtggaattgcagagagctgccggcccctggcctgtcactgctgcccaggtcgctgagggtccaggcttccacccagtgtccccgcagtcagctgcccaccagcagcctccccgggactctccggcctgggcatggcgttggcctctggtggccttgcagcagtgagtgtggttcttgctgccgtgagcccgagtgtcgcccctttcctcccgccctcccacgagtccagacgcatctcctggcagcttaggaagctccatcttcacccaccccacatctgagggtcccgtgccttgtctccctccatcctcactgtacatgccaggcttcagcctgttctaactccgggcctaaattgtccctaagagagctgtaggcacacaaaggggctgggtgtctgcaggcaccactgtgagctaccgtcgccagatggtccccagggaggtgcagacagggtggttccggaggccggctggcagggctgggttcaagccccaacatccacaccagtgttgttcacagtggccccaggtgtcatctccgcagaggcctgtgatgtggccctgaccccgtaccccaacaacctccttccctgtgtcagagcccgtgtgagtaacccaatagcaggcctggggaccacagtgtggctggccccctcctctgcaggcctgggctccgggggcaggtggcccctgcatgtaacttatgttagaaatgcacaatgcttgttctctggtgccacaaagaaatagtgctcgaacattaattttctcagcaaggcagtttttactttctgcagaaagggtgcccctcgcagatggagcaatggcaagagcacacctgaacaagggaggggaaggggttcttattcctgacacaggtagccctactgctgtgttgttcccctgttggctaaggttggaccacacagtctaagccaattccaattggctattttaaagagggcagggtaagagtcagagtggcggggtgagtagtttgacgggaaggacggttaggaacaggtaactcaaggtgacttaggtcagagcaggtgaccgggatgagtcaggatggagcaggtgaccagggaacagatgtgaactactgattaggactggcaggaaaattgtttactgaaactagaagcaaggggcgaagagaaccaggaattttaaatggagaatcaaagaagagatctggccgggtgcagtgggtcacgcctgtaatcccagtactttgggaggccgaggtgggcggatcacgaggtcaagagatggagaccatcctggctaacacggtgaaaccctgtctctactaaaaaatacaaaaattagccgggcgtggtggtgggcacctgtagtcccacctactcgggaggccgaagcaagacaatggcttgaacccgggaggcggagcttgcagcaagcagagatcacgtgactgcactccagcctgggcgacagagtgagactcttgtctcaaaaaaaaaaaagagatctgaacatactgacttactgattctttgaagacaaacttggagttcactatatttaacacttaggacccctagtatctgccactgggctgcgggggcagctgcagggacacacacctgttgggtgcctgctggttccacccaggagcacagccagcagcctcatgcctcctgccccctggcagtcgggtgcacgtggagcaggtggccttggcctcgacagggttcccagggtcccactggaagccccacatggaactgtgcctctgggacattgctccagggacctcgggtgcgggctggccccatcctgtggggaggtcctgggagggtcagtctggcccgcctgcctgctgacttgggtgtggcctgagcaggtaaaggcgacacaggaggagaaccgggagctgaggagcaggtgtgaggagctccacgggaagaacctggaactggggtaaggaggccccgtctcctgtcctccccgtccccatccccctcgccatccttgtccccatccccctcgccatccttgtccccatccccctcgccatccctgtccccgtccccatccccacctggcctgggaccgctgggcacccgaggcaatggctgtgtgtctgttctcctcccacaggaagatcatggacaggttcgaagaggttgtgtaccaggccatgggtgagtgcccgggccaccgaggccacgtgcctccacgaggggctgcctatgccccaccctggccctgccctgcaccctgcctaggaccccaccctcctgaggccccttttcctaacacacgagtcccttcaacatgggcccggccgtggaagcactgaggcgagttgcggggaagctggtggtagtgaggctggtggctcccacggagccagggcttggcaggccccacagttgtgcagatgctgagctagcagtggggctgtggtgggagcagagtctgtcccgccgtggcctaccccactccaccctgccctcgccgtgcggctatgtctagcagcagcctctgtaggtgtctggcaggacgggaacaccaggcctcatctggcctcccaaaagcttgggctcctggaggtgctactgtggggatctgtcttaggctgagtgtcagccggcggcaggtgaccgcctggcccttgcagtccctccaggaccaccacgaagcacgacgcacatcctggagctcgccataccggctcccaggcctcaccctaggctctagggtgttgggcgccgcctcttcagggacctctggcccaggctccagttccctgcggatctgatgtggaggaaacagctgtttcctgggctttgcatccggcctagaagatcctgggtggagggacccatcaccctccgaggctcacacccactgcccacctctcctcctggcgctcgagtcccttgcctcattccttgggctgtctctggcacccatcgtttcggttgcctcctcatcctgaacgtttgcttttcttttctcaagaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaaggtatgtctccgccaccctggtgtcctcacctcggaggctgatggactcatggtccaagccagcggggctacaagctgctgtctttgcaccttggtccttggccaagcctccccttgccacgggggcatgggatgacctgtgaacgagacagggtgcaggagtcacagcatagctggtttgcgaggcagctgagggcggcaggaggcagagtgagcagggaggccatctgagccgtccgctgttgtgtgacagacgactcggctatgatcaggcatctgtgagatttgagacagcgctggtgcaccggggcctggggcacctcggaaaggtgtctgggctgtccgagcgcttgggtcccaagggttggggacccagggcatgcagtatccaaggcgggaggcccactgaaaggtggtcacggctgtgcaaggccaccctggtgtcctcctggccacaggactctgagcgccccccaccttctgtgctgggcaaggcccacatgcttgctggaaggagggatgtctgggccatccatctgcccagagcaggcctggaaggtgcctgcgaggccgccagagggttctgcccacagcagcaatgttggagcggaggtgctcaacgcctcctgtagaggagctggacctgcaggtgcagctggaagaggggctgtcactgttggtgcaagggggttggggacaccagatgggtcccctgggagtcagactaaactggaaaagcggcccttgcagggcctgctgagccacacctcatctgagtcctgaagtcaggtgggtgtcagtggctggggcccagctgcctaacagaagcaagcctgaatactctagggaagaaggtatcttatgctttaaattgctgctgcagttttaaattagtgtctggcacagaataaccaagtgtgaaaggaacaggaaacatgagtgaaaatcagacccgttattagagtgaggcatggtgatgtacacctgtggtcccagctactagggaggctgaggtgggaggatcatttgagcccgggaggttgaagctgcagtgagccatgattgtatcactgcacccccagcctgggcaatagaccaagacccccatctctaaaattaaaaaacaaaaacaaaaactgttgatagacccacaggagccccagacgctggagttggcaccggcaggtggtgcctcaggtctgcagggagcagatgggaagggccctgtggcagcagagtgcccaccggcagcagagtacagcagtctggcccagcacagacgcttggagaggcaggactcttcacacggtgctgctggcttgaggacacagcggctttgctgaccttccctcaggttgggctgtggtgtgagcagctgccttggcctcgcctctccccggggcaggcctgtgcctcagctcccactggccacctccctacttcctcatggaggctcctttgcacatctaatcccatcttggacgacccagtgcagactttaaagtaattgtcttctgtattcagaagagtattgcttcaatagagaccttgaaactagaaaagaatccccttcgggagaccgagacgggtggatcacttgaggtcaggagttcgagaccagcctgggttacatgatgaaactccgtctcctaaaaatacaaaaattagctgggcagggtggcatttgcctgtagtcccagctactcaggaggctgaggtaggagaatcacttgaacccaggaagtagaggttgcagtgagccaagatcgtgccactgcactccagcctgggcgacagagtgagactccatctcaaaaaaaaaaaatacaaaaattaggcatggtggtgtgcacctatagtcccagctactcaggaaactgagacagaaaatcatttgaacctgggagacagaggttgcagtgagccgatatggcaccattgcactccagcctgggcgacagagcgagactctctcagaaaacaaaaaatacagaaaaactaggccggcttatgcctgtaatcccagcactttgggaggccaaggcgggaggatcatgaggtcaggagttcaagaccattctggccaacatggtgaaaccctttctgtactaaaaatacaaaaattagctgggcatggtggcaggcacctgtagtcccagctacttgggaggctgaggcaggagaatcaatcaggaggtggaggttgcaatgagccaagatcgtgccatcacactatggcctggcgatagagcgagactccgtctcaaaaaaaaaaaaaaaaaagcctgggcacagtggctcacgcctgtaatcccagcactttgggaggccgaggcgggtggatcacgagatcaggagtttgagaccagcctgaccaacatggtgaaaccctgtctcttctaaagatacaaaaattagccgggcatggtggcacgcacctgtagtcccagctacttgtgaggctgaggcaggagaatcgcttgaatccgggaggcggaggttgcagtgagccgagatcatgccacttcactccagcctgagtgacagagtgagtctccgtctaaaaaaaaaaacaaaacagaaactagaaaagaaccaaatggaaatttctaacaggtacacagttaacaacattaacaattcaaagggtacaggtcagatgagggaagcagaggctgagttgggaaccagtgtgtggacggcagcccccagagccagagggagagacgccgctgtggcgggaggcttgacctgtgcacacgtgagagcttccagatgctgcctcccggacagacgctgttgggaattttccacagcagagaaacacagtgctgtgggtttaagggaggcgtgacctccgcaggacatcaggggctgcatgctgggtaggggctcagggagaggctgcagtgctgagggtgcttctgggatacagggctgcgacagaggagtgaggatggctgggctgtgaggccgctgggggcactgcaggaagaaggcaggtaggctgagccttcccaagcagaggccactcggggacccaggaacccctcagttagggcttctcagtcactgagcggaaggtgcccccagagggggcagcagcctgtgaggagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgggaacttgtgtgaaggggctttttccaaaaggaaaacgggagctactggctcacggctgatgccccagacagcctcgaggatctgcaggtccccagacaccaagcctgggtgctctccagcagacggcgtggtacccacagctaattcctgccccttcctagaacgaagagtcactgaagaagtgcgtggaggattacctggcaaggatcacccaggagggccagaggtaccaagccctgaaggcccacgcggaggagaagctgcagctgtgagtgctgggcgaggccccaccctggagggagaatctgagcacctgggccccagctcagcctctgccccgcccctacccctccagggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaactttttttaaaactagattgctttgaaaacatgactcaataaaagtttcctttcaatttaaacactgaagccgctctggtcttgatgaagcaaaggtttcccagctctagcctgaggctgagccgacccgcaggtgccctcccttcccctcagagctggccacttggtccctgcctaccccaggctcaggccaccctgccgaggggcagggacagccagtggatagaggaggctcaggcctgcccagtctgccccggccacctcgggttggctacatggtcctggcctcaggtacacacatcaaagtccaaatggactcgtttttttgtttgtttttttgttttttgttttttttgagacagtctctcacccacgctggagtgcagtggcgtgaactcggctcactgtaagctccgcctcccaggttcacgccattctcctgcttcagcctcccgagtagctggaactacaggcgcccgccaccacgcccggctaattttttgtatttttagtagagacggggaagttttcatataaaacaaaaactgtgaacagccaggcatgcatgccggtggctctgattctggtgccgacctggcgagcctgcagccccagctaattgagcgctcacctgggtgtgggtgtggagggaggccccctgcaggtgcagctgctcagctcctgtcgtcctcgtccttgggggcgtggagacttcagagcaaaacaggcttccctgaggaagttctgtctccacacggcagggcttcctccccgaccctaaccccatctccagcagtcccgtcctgcggatctcaaactcagacaggcacactggaacccaaggcagttccaggagcccttctggtcaggcagaggcttggcccagctggggcatcccgggaacctgggtaccgagctgagagatgctggtcactgggttcagccatggcacctaggaccccagcaccagccagagggccagggcctcctgaggggccaggcaagaccaagggttgacgctgtaacctgtttccaggggtcggtgctgctgctgtgcccagatcacgccgtccagaaaagccgttttctcccatcagtgaagagtggggctccccacatagggagggacccaggccgagatctggccgcagtcacctggccccagtagtgtctgagcctgggggttgcagtcccaggacctgcttccaaggctctgcgagtctgccccttgggctggtgagcagcactgcagtactgacctcgggtgggcgcaacaacacccccagccgccgccaggggtcgcttgccgccatgggccatgcagggaccggaccaggtgggtgacaccctgaaggggcggggcgcgggtgccaagaagccgcatggaccgccagggaggctgaggggcgggcaggggcttcagcctgggtggccagtggggtgtccccaagggcatgagggtgcatttgttcttagcacgtttggaggagggggcctggcacagggatggacggccacagcgggccatggccagtcacggctggggcagggactgggccagcctcaggggggcctgggggccactccctccccctccacagcccacctgtgctcctgcggcacctcctgactggcttcccaggaccatcgcgcccctccctcccgtgggcagcaacccccatctcagccccgagcctgggtaacaatagggtgtaatccctggctgaggggcctctgagagccttccgtggcccacttcacagacgagaaaccgaggcccacagaccagtggccattggccgggggagacgggccaagcacagggtgtgggccccctctcctgcttggggttgaggatatgggggagaagaagggccctcgagcctccagagctcaccagctgccctatgggcagcacggcccgcctcggcctccccgctgcccacaggcatgtccggccgcaggactcccacctctctttgccgggtcagctctgctctgacaaggtctcaggacacaaggcggctgccaggtcctcctcctcactcagccctgccggtctgg

SEQ ID NO: 12904 - DNA, 47727 bp, Human
  misc_feature (1)...(47727): n = A,T,C or G
ggtcctgaagttacagatgtgtgagctctggcccaggtgtctggggcagcagcgctgggtctacgtgcacacctttgcgggatgcccctggtcacctgttcctgctggcgcctggccctgagcctatctcctgcgtcagtgtttggttgaaaccctgcttattttgccgacttatataaatatctgcctggtggccataggcctgaatttgccacttacggtctagccatctggaccactttgccatgtgaaaaggactagagatcttttcagtgataaaatgtataaactaataatggtacatttacagtgaaattcttggtgactgctcagatgttagggattatttaggacagtagctgctcatctcctcagcatctacctgtaaggagggtgtcatgtgtaaagcgttgctgtgtgattatgctttcctactctggtcggcacccaggccgtcgggcggtgtctgctgatggcttaggaaggatgaggccacacactcagtcctgggaagtggagccctgggtttgtaactataacacgttggcacgtaccatgcaactctttcatcacctacaatgaaaggtctgggttttagatattttaaattctggttttggctaaaaagttgtaaattttcccctcctgtcccggagcatgacctcggattggagtcttgtctgtctggaaactgaggtaacccgcccccagccctggagggcggagcctgtgcagcatttaccctgcagtgaggcctggcgccaggcttcagccatttgagtaccgccagagccttatcgtaatgtgacttgttactgcaggagctgagatgagctgtgcgtcagagcggaccccaaatgtaactgagcaaagaaatgcactcggggtctcgtgaccccacgacggctgagctcctgtggctgggtactgcctgtaactccacggtgccggcgtttcaggttctcccagcggggtcacgagaacctgctgtgaagccagggcaagttgcagcgtggtgagagctgagcctgcctcagagtgctcggcacggctccagctttgaacccagttctttctgttgttaaaaggcacttgctgccgggcacggtggctcaggcccataatctcagcactttgagaggccgaggtgggcggatcacctcaggtcgggagttcgagaccagcctgaccaacatggagaaaccctgtctctactaaaaataccaaagtcgtcaggggtcgtgttgcatgcctgtaatcccacctactcaggaggctgtggcaggagaatcgcttgaacccaggaggcagaggttgtggtgagccgagatcgcaccattgcactccagcctgggcaacaagaatgaaactccgtctcaaaaaaaaaaaaaaaaaaggccgggcgcggtggctcacgcctgtaatcccagcactttgggaggccgaggcgggtggatcatgaggtcaggagatcgagaccatcctgactaacatggtgaaaccccgtctctactaaaaatacaaaaaattagccaggcgtggtggcgggcgcctgtattcccagctacttgggaggctgaggcaggagaatggtgtgaacctgggaggcggaggttgctgtgagccgagatcatgccactgcactccattctgggcgacagagtgagactccatctcaaaaaaaaaaaaaaaaaaaaaggcacttgctgccatttcctgttttaccaggggaatgccccaggtggggtgtactcatcatgggatcacagacccagtgcctggccactgtgtctcctgtgaggtagatcccgcctgtggtccgtgtccggggctcacagttctctcttgatctagaaattgtccttccaaacaagatggctgtgcattgtttaggtgtaaagtatatgggtaattaagtacaaaatgaccaagttcttgtgcctgattgttctgcatcctggtattttatgagtttccaaattgcccttttcccactgcaggctctacagattctcccctgcccctggagaaggaggagcaggtccgacttcaggctcggaagtggctggaagagcagctcaaacagtacagggtgaagcgccagcaggagagggtgagtctccctctcccgaacaagctcatggaaagcttcctgtgccagagacaactgttggtcccacataacccggggacctgccattggcttctctgagctgccatgggctcaggggcaacaagcacattttatttctaaatctgccaattgaaaagcaaagaaagcaaacacgggtgacctcagaggtactgtgggttcagttctggaccaccacaaaaatgtaaacattgcaataaagcaagtcctacaatgtttttggtttcctagtgcataaagaagttatgtgtatacgctactgtagtttactaagtgtgcagtagcactgtgtctaaataaaactgatgtacccacattaatttgaaaatgctttattactaaaaaatgctaacgatcatctgagccttcagcaagtcgtaatctctttgctgttggagcatcttgcctcaagtttgatggctgctgactcatcagggtggtggttgctgaaggttgggctgtggtaatttcttaaaaccgcactaaagtttaccatatcttagaaaagatgtctctgtaacatgcggtgctatttgatggcattttacccattcaggttttatcctgagattgcagcaattcagtcacatcttcaggctccacttctagttctagtgcccttgctgtttccaccacatctgcagtcaagttctccacggaagcactgaatccctcaacgctgtccgtgagggtagaaatcagcttcttccacactcctgttaatgttgatattttgacccctccacccatgaatcatgaatgtttttaatggcatctagaatggtgaatcctttccagaaggttttcagtttactttgcccagatccatgagaggaatcactatgactatggcagttgtacccttacagaaggtatttcttaagtaataagacttgaaagtcaaaactagtccttgatccatgggctgcagaagggatgttgtgtctgcaggcaggaaagcgacattcacctccttgtacatctcccatcagagctcttaggtgatctggcgtattgtcaatgagcagttaaaaaaaaaatatatatatatatgtgtgtgtgtgtgtgtgtgtgtgtgtattttgagacagaatctcgctttgtcacccaagcaggtgtgtagtggtgcagtcttggcccactgcaacctccgtctccctagttcaagcaattctccagcctcagcctcccgagtaactgggattaaaagcacgtgccaccatgcccggctactttttttttttaatgtttttttttttttttttttttgagagacggagtctcactctgttgcccaggctggagcgatctcggttcactgcaacctccacctcccaggttccagtgattctctgcctcagcctcctgagtagctgggactacaggcacccaccatcgcgcccagcctatgtcatgtttcaaaaggatctcttcagtagaagaagatcaataaaatgaccagcgtgttcttcttatacctttaaggttatgtttttaaatactttaatctggctgggtgcagtggctcacacctataatcccagcactatgggagggtggggcgggcggattgcttgaggtcaggagtttgagaccagcctggccaacgtggagaaaccccgtctctactaaaaatacaaaaaattagccggatgtgatggcacacccctgtaatcctagctactcaggaggctgagacaggagaatcgcttgaacccaggcggcagaggttgcagtgagccaagattgcaccactgcactccagcctgggtccatctcaaaaaaaaaataaaaatgcaagtatgaaaaatgaagagttatcctagcagttgtaagattagtgggaagtataacatttataacaacaaaaaggataaactgagaaataagttagaatggccgcagagggcctgggttctagatgggggtggggtagctgctctgttgaggggcgtgcatgtagggtccagccccacagggtcagtgggttttctccctgtgtgcggagacgagagagtgtagaaataaagacacaagacaaagagataaaagacagctgggcccgggggaccactaccaccaagacgtggagacaggtagtggccccgaatgtcaggctgtgctgttatttattggatacaaagcaaaaggggcagggtaaagagtgtgagtcatctccaatgataagtaaggtcacgtgggtcacgtgcccactggacagggggccctcccctgcctggcagctgaggtagagagagagggagagagagagacagcttatgccattatttctgcatatcagagacttttagtactttcactaattttgctactgttatctaaaaggcagagccacgtgtacaggatggaacatgaaagcagactaggagtgtgaccactgaagcacagcatcacaggttgatggttaggcctccggataactgtgcgcgggcctgactgatgtcaggccctccacaagaggtggaggagtagagtcttctctaaactctgctaagtagtgggtgtttttccttgacactgatgctaccgctagaccatggtctgcttggcaatgggcgtcttcccagatgctggcgttaccgctagacccaggagccctctggtggccctgtctgggcataacagaaggctcgcacttgtcttctggtcacttctcactgtgtcccctcagctcctatctctgtatggcctggtttttcctaggttatgattgtagagtgaggattattataatattggaataaaaagtaattgctgcaaactaatgattaatgatattcatatataatcatatctaagatctatatctggtataactattcttattttatatactttattatactggaacagttcgcgtcctcagtctcttgcctcggcacctgggtggcttgccgcccacacgtgcaagcagatgtgggcaggcggaggaaattatggatttaaggtggttatagttcaacagaatgttcttcctttttgaagaaatttttttttgttttggagacagggtctcactctgtcacccaggctggagtgcagtggcatgatctcggcttattacgacctccacctcctgggttcaagtgattctcctgcctcatcctcccaagtagctgagattacaggtgtgtgccaccatgcctggctcatttttttgtatttttagtagagacgggggtttcaacatgttggccagcctggtcttgaactccttacctcaaatgatctgcccgcctcagcctcccaaagtgctgggattacaggtgtgaaccaccacgcccggccttgaagaaaatttctatgtttatccaaaaaaataaaataaactggagagtagccaggaaagttctgttgaggaagtctgtgggtggcaagccactcaggcaccgaggcaagagacagaggacacgggctgttccagtataataaaatataaaacaagaatagttacaccagatatagatcttagatatgattatatatgaatatcattaatcattagtttgtagcaattactttttattccaatattatgataatcctcgctctataatcatagcctaggaaaaaccaggccatacagagataggagctgaggggacatagtgaggtgtgaccagaaggcaagagtgcaagccttctgttatgcccagacagggccaccagagggctccttggtctagcggtgaagccagtgtctgggaagacgggaagacgcccgttaccaggcggatcgtggtccagcggtagcaaaaggtgtcaaggaacaacacccactacttagcagaccgggaaccggggggcgggggggcgggggtgggggttggtgtctccctttccccgggggagtttagagaagactctgctcctccacctcttgtggagggcctgactgatgtcaggcctgcccgcagttatccggaggcctaaccatctccctgtgatgctgtgcttcagtggtcacactcctagtctgccttcatgttccatcctgtatacctggctctgccttctagacagcagtagtaaattagtgaaagtactaatagtccctgatatgcagaaataatggcgtaagctgtctttgtgtctcctctccctctctgcctcggctgccaggcagggaagggcccccgtccagtggacacgtgacccacgtgaccttacctatcattggaggtgactcacattctttaccctgccccttctgccttgtatccaataaataacagcgcagcccgacattcagggccactaccggtctccgcgcattggtggtagtggtcccccaggcccagctgccttttctcttgtctctttgtcttgtgtctttatttctacactctcgtcgccgcacacagggggagacccactgaccctgtggggctggtccctacagaagtctgatgaggaggtacttgctgggatgtgttttaaacgtgttgaggtcacagtcactgaagagtgtgctttagaccagaggtggtcatgctggtcactagagtggggccttgcggcagtgagaccaccacggatcggaggcctggccgcaccctgtgtggtgaggggctggggaggtggtgctctctggttgtcagcggagggagtagtgatcggtgccacctttctgaatggcagttttaagtatgctgcttgtggattttaaatgtaatttttgtacttttgttttcttctcagtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcaggtggtggggacagcagaggtgggcggggtgggtggaggtgggtggggccaacagaggggggtgtggggcgggcagaggtgggtggggcggtagcagaggtgggtggggccaacagagggggcggggtgggcagagacgggcagggcaggcagagggcctggcctgagatgttgcttcccgggcccacggctctccgcactggaacaggcgatacacagcttttcttcctgattctatccttagtcttgacatgaacatttaattcataacaagtctgctgctttttaatcagtagaattagatcagcaatggtctgtgttactaaaatatccagtctcccgtttacatagacttgtcactaagctgcacgacgcttgcatgtctcatgtttctgtaacagttcccactgcgtgaggtgccaactgttggcaggaatgttcatccgtgcatcatgcaagcctcagctctctacttaaatctcttacttaattttaaaaaattgggagagagcagcaggggtgtgtggaatttggagaatgtggaggagtgtgaaggaaaatgaggatggctcgcacaggcctgacccgtgcctttgtccccagcgtgtccttggagagctctgcagcagaaacacaggaggagatgctgcaggtgctcaaagagaaaatgcgactcgaaggacagctggaagccttgtcactggaggcgagtcaggtaacggacgttcgactgacatctcagcgtgcggcgaagtcggaaagcatgtgtggctcctctgttgggtacgaggtttcacagatgtggttgggaatcagccgccgcagcatgtgtggcagccgagggttctgcatctttacgttttttgtctacttgtcagccttagaaagagttgtgagttttctgcctcatcgtgcgtgggcgtgtttctccctgcgtctctaccagaatatttcctagatgttaggtgtctcacagtccataagagtcaaattctcttggtgggttgcagctttttctggcatggtgaaccttttttctttgtagtgatttctgctttttctgatactaattgtgctgtatcagagaaagctgcacacgctggcttggttagcatgtgccagaaacatcattttccatcccttatttcagctctcctttgtcattttgtcgtatgcactttatccacagtgaagagctaggtatttatcttctgtcggcagttgagtaaatctgttcagtggggttcagctgtccgcttctggcgtgggagggtgagaatgcacccaggccctgaggtgacacagctgagggagcctcctgtggcctgcgaggccgcagagcagggctggagctgctcacagtgtccggagcttgccttgctaaatgcacgcctcatgtcgaagatggttttctcatacaacatggtccttggacacaaaccaaccagtttgtgacacctaaagctgtgtctacagaagaggtgatttcggctgttttgaggctaattctggttgtacggtcgtcacttctccagtgttacagcgtgagcctccctccgtcggatgcatttcccctcctctgtgtagccactctctcgaacggtggcttgctgtcactgcactttgtcttcttatcctcttaggatcactgattggtccttcggttgcatccacaccaagatcgtgagggttgtttcaggtgtggtggttgctggccccttgctctagggtctcctggagtttgtggagttcctcaattgctttgggtgtttgttgtcttggtgatgtgtgaactggatccctgcccctgtaggcctcagcgtgggggcaggtggtggggcgatttcctctggcgattctctgctgctcctgggaccacacagcactgcggtggccactcaggactgtgctgtgtcccgtggctctggctggagccgcacttaggcagccgcctttccctgcctgtgttttttgcccatttccccccagatctgaatccgcttttaatctctcaggggtccctctacacgtctggcattctgtgtgtgtgcgcatacatgtgcacccgtgtacacgtttggtgttttgaacacgtttccagtgtcctcgcaggagacgggtgcttccccagccctgccctagcgctgccctgtgcaggtgcagttgggcccaaaaccagtgcaggctccctgtgcgtcctgggcctgtttggaaagtcgcctttttctgtgacggctgtgctgggagagcgcctgggggtctcggggtcctctgtcaggccttgggagagcgcctgggggtctcggggtcccctgtcaggccttgggagagcgcctgggggtctcggggtcccctgtcaggccttgggagagcgcctgggggtctcggggtcccctgtcaggccttgggagagcgcctgggggtctcggggtcccctgtcaggccttgggagagcgcctgggggtctcggggtcccctgtcaggccttgggagagcgcctgggggtctcggggcagggtcctctgtcaggccttgggagagcgcctgggggtcttggggtcccctgtcaggccttgggagagcgcctgggggtcttggggtcccctgtcaggccttgggagagcgcctgggggtcttggggtcctctgtcaggccttgggagagcgcctgggggtctcggggtcccctgtcaggccctgactgactcgctggttgtgttcctgttaatacactggatggaagtgactcgttttcttaaaatcattgtggttgttgggatcttttcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacaggtgaggctggccctggccacgccctcccctccctgactggtccctgctgctccctcctccttcctcgactggcccccgccacgccctcctccttccctgactggtccttgctgctccctcctccttcctcgactggtccccgctgctccctccttcctcgactggtccccgccacaccctccttccctgactggtccccgccacgccctcctccctggtgctgacagctctgtcggcatgtgactgtgcctgtgagggttgcattggtttatagtttacacataaggaggctgcttttctaaaggaaatacaagttttagttgaacttgtggaattgtgtacatttttgtgtgcacatccaggggaatgaattaggtcttggagattgaccttggaccctggagtatctgcggtgatcctgcctcaaaagtccagtgttatttgggagtatagagctgcccacttattccacagaattgcagattccatttaaaatattcaagaacagctccttgactgtccgtctggcaaccttttctccctggatgcagtgcgtcggtccagctgcctccctatagggctcgcccagagagtacaagtagggcagtggattgcggaagccgcggcgggcttccatgtggcttggcagcacgccttccaccccctcagtccccgcccgggccagtcccagagctcacactccagtgcccagcagacacggagaagactgtggttggcctgctcagagcaagcgtgaacaggagtgggaaggagagggcgaagcagggtgggaagattgaagacaaagcccgaggggtgtagagtgacccgggtccagagtcctcccagggaggccgcttggtgggctcatctctcaggtcttgggatctcctgagccaggggtccctggtgcagccgctgtgagggctgactccatgtgagccggtccgcctatgaggctgtgagactgggtcttggatgacacagaggaaggtgacaagctggcgtcacagaggctacattctaatactaggaaagagaaagccggccgagagacagtagtactcttgtaatcgctttaatattttagtccttgagcatttcgtgatacccaatcccttaggaaaaaccatgaaacccaaaaagttctcaacactaaagtagtttggggccctgtgggttgccacgcttcacttgaccagtgatcggggggtggcaaaaccaacctgaactttgatgaggccgcccagtcctaaccggtgggtttaagttggaattagccacacggatacccttgctgtttgttgatggctggtagacatcgttgggtcgaagacagagcctcggcgtccatgaccattttcacagatttcctaagtgtgaatttgccgacttgattaaatttgtttgaaccacaaactcagtattcatggacacgtgtggagcagcagagtacgtgagtcatcctaggcgcccgctgaggagggcaggatactctgcctgccttggtgctcagccgggctgcaggcaggagttctttccagggccatgtttacatgtttgtgctttggggggtaattttgcagttaaagatggccccaaacactgtctagtgtttttttttgttgttttgttgttgttgttgttttgttttgtttttgagacggagtttcactcttgttgcccaggctggagtgcaatggcgccatcttggctcaccgcaacctctgcctcccaggttcaagcgattctcctgcctcagcctccctagtagctggtattacaggcgtctgccaccgcgcccggctaattttgtatttttattagagacagggtttctccatgttggccaggctggtctcgaactcccaacctcaggtgatccgcccgcctcagcctcccaaagtgctgggattacaggcgtgagccactgtgcccggccaacactgtctagtgtttttaaacacagagaggatgtgaggtgtttcatggagaagatgtacttcatttttttcttttggtttatttttttcaattcatcctgtttctatttttttaaattttctttttgtttttaaaaattcatttgtctttgagatgggttgctctgttgcccacgctggagtgcagcagtgcagttgtggctcactgcagcctcaaactcctgggctcatgggatccgcccgcctcagcctcccaagtggctgggaccacagatgcatgccaccccgcctggctaattttttttttttggtggtgggggatctcgctgtgttgcccaggctggtctggatctcctgggcgtgcacccctgtgccccctgcaccccccatgccccctgcacccccgtgtccggccactgttatttcctagagaatctttgctcaggcttgttggtcaagttgctgttggccgtgagctcggtgtgaatgaatcgacgctatgtattagatcggtgtcgtaaatggaaacactgaacagaggttatgtattgatgagctggtgaaggtgctgtgagcagaggcctgcaggaacctcaccctgcatttctgccaggagcggcatctctcagcgcccactaatgccgtgttcacggcgacttcatggagtcagctatggggaataaccggaactgactcattcttggtctcccctgagagtcccgccttgtgtcccgcacgcgcggagctgcggactcccccgttggccgtcgctggcctgagccgctgtgcttgccccatttcagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggtacggcccacatctaccttccagggcaggtcacgcttcttgtcttcatgtagaacggtgctttttcctgagatttttctgtttttagagttcacaggcatgtttttgtttttaacctgctgtccagcccaccccgtgtcccatgtaggacgtgtcgtatgcaggacgtgtcccgtgggcccccccccaaccttctgacatgggagtcccacggcagcctctgccagcattttcagttccaaagcctctcttgctgggcatggtgacacatgccggtgaatcctcatttgcctgggtctcgggaccctcccaccctggcctcctgactcggcacagtgttgcgtgcctgtgaatcctcatctgcctgggtctcaggaccctcccacctcagcctccccactctgctgtgatgtctcacaggcgtgcggtgccagtggggttctcttcccggttggagcttttcctttccctgctgcctgagccctcagtgatacacggggaccacgtcttcccagcaggccttgcattttctacgtcctgttggaaaactctttcctctcccgtccactcgttagcgggcacagcccatgtccagcttggtcccgcatatgtgggagtgtgtgtccgtccaggcctgtgcctcggcccacagcaactgcttcgtgtgctggagacgcccagaccgacaggcgaatggttcgagtgcacctcgatccgagtctcagcacctagactaattaggatgacctcagagatgctgaagagtacctttggtcagcctcagtctttttgtttttggtttttttttgagactgtgtctcactccgtcacccaggctggagagcagtggtgcgatctcagctcactgcagcctcaacctctcagactcaagctattctcctacctcagcctcttaactagctgggatcacagacatttgccaccatgcccggctaagttttgtactttttgtagagacaaggttttgccatgttgcccaggctggcctccaactcctgggctcaagtgatgcctgcctcagcctcccaaagtgttgggattacaggcgtgagccaccgcacctggcctgttattttttaattagctgtggaatttttttttcccagataaaatattataaatttattaaaactttatttctcaagaggggaacgtgaaatactaattccaccaaatgttccttttacatctagagttacaaatatacacaatagaacttttcttcaattttcgttacttttttgtttgttttgagatggagtcttgctctgtctcccaggctggagtacagtgttgtgatctcagctcactgcaacctctgtctcctgggttcaagtgattctcctgcctcagcgtcccgagtagctgggattacaggcgcccgccaccatgcccggctaatttttgtatttttaggagagatggggtttcaccatattggccaagctcgtcttgaactcttgaccttgtgatccgccttcctcagccttccagagtgctgggattacaggtgtgagccaccacactcgactgttacatattttttaagccaaagaacaatacggaaaagcatttgttctacttacaacatagcttggaaacaaatcagtatacaaattaatacacttttttacagctgcagtgcatttatatgaggtatttaaagacgtaggccaagccaggtgtattttagaagtatagtttgggccaggtgcagtagcgcatgcctgtaatcccagcactttgggaggccgaggcgggccgatcacttgaggccaggagttcaagaccagcctggccaacatagcgaaactgcatctctactaaaaatgcaaaagttagccaggtgtggtggtgagtgcctgtagtcccagctacttgggaggctgaggcatgagatgtgcttgaatccaggaggcagaggttgtagtgagccaagattgcgctgctgcactccacacttcagcctgggcaacagagccagactttgtctcaaaaaaaaaaaaccaacaacaaggaagtatggtggtgtagcctggacaacaaaaagagaggaagctttaaagcaatggtggctccagagccctatctgctgttttttcggagacagggtcttgccctgtcacccaggctgctggaattcagtgttaccatcatagctccctgcagccttgacctgttgggctcaaacagtcctcctgcctcagccccccaagtagctgggacataggtgaacaccatcacacctggctaattgtttaaaagttttctgtaaggacagggtctcgctatgttgcctaagcaggttttgaactcctggactcaagcgatcctcccagcgtgctgggattacaggatgagccactgccgggccctcactgctttttccaaatacctttggaacccaggttcagcattccttaatcagagtttttaatacatttttttggtacccaaatgtatcccttcattcccagtaacgttcaggagggaggagaattccaggcagtcagtctgctttcatggtctcgaaacacagtcccagcaaaggctgtcttccctggctccgtgcaccttctcctgaggtcctggagcgtgtggcttctgtcacgtctcgcactgtgcactccaggaagcagcatggagctagaggcgatgcgggcaggtctagcctcaggccccaggctgtcctcacacctccttttcagtgctacttcccttggctgacgccgtcctcctcagggccatggtcctgggctttttcacgagacgcttggccagcgtgggcctgagcacctggaggtctgggccgggccctagctggctggaaaggctgtatccctggaatggcacctgtcgggcgtctggctgagggcaggccctggtgtgtgtctggctggatttgttcagttaagataaggctcctcacctacaggggctcagagatgcccctcctcacccacaggggctcagagatgccttgtcaatggggacttttgggtaggtcctgctacaaaccgcagtctgatgagctacaaacagcatgatgagcgctggctgatggcccgcccgccctcccactcaggcacgcagagcccagacagcgcatattttgagatgggaagacgtgtagtgggtagtggggcttgcgtgggagacactgagggggcagccagtgaccctcaccctggggcctccagggacaggctggtctgcatttcttgcttgaaattgagcaactttttactttgtgggttttttttttaaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggtgaggctgcggccggggccgtggaagcttaggagaacagacgcagacatcgataccatgtgtgttttcttacatgttccgtctctctgtgtgtatctcttaaatattctcatggatggcgggcagtgactgctcgttaaggctttgggaccccccccccacccctcatccctcacctgtgggggcttagcatggatggcctgcagtgactgctcgttaaggctttgggaccccccccacccctcatcctcacctgtgggggcttagtgcagtgagcacttgcggctcttttcctgcaagccccgccttgggcctgggcccccggctgtcagtcattgccagtcagggatggcgctgggtacagagtgggtacggaggaaggggccagtgcgtttttgcctgacagcctgtcgaagcctagggatgagaggattttctttgcttactgagcactcagactgcattgccatttaaccctccagcaaccacacgctgtcgaggtcatggccgctgcctgcacagccatctccagaggacagaaatgcagcagccttgatagctgttctcctttagctgtggggcgctggacaatttcttacctctctgagccgcatcttttttttttttgaggtggaattttgctcttgtcgcccagggtggagtgcagtggtgcgatcttggctcactgcaacctctgcctaccaagttcaagcaattctcctgcctcagcctcccgagtagctgggattacaggcactcgtcaccataccctgctaattttttgtatttttagtagagacggggtctcgccatgttggccaggccagtctcaaactcttgacctcaggtgatccgcctgcctcggcctcccaaagtgctgggattacaggcgtgagcctcatctttataaaatggggatagtgtcacctactcgatagccttgtggaaaaattaaagaagaagaaatggtgtaaaaccccaaggcagtgtatggagggaggttctgtgctggatgttgctgggctggtctcgttgccgatcttgccagttgtacagggagctctctgcagcctcacgtggtttctcatctcctgcgactgctcccacctctctgtggcattagctgggctgcccggctgggatgagaagaatcacgttgcgtcagccatagtgcttcaagggcttagtagagaagaactgaaaagaatttcaagtttcaagttaggaatttgtgttttccctaagaagtgtaccccgatgtgaggctgtgttcactgcgggggcctctggtctcttacccggtagcaccaagcaccgctcttgtgagagcatgtccgggtctcactcccgaaaggaggcagctgtcgccacacgagaaagtcggggaggctctgctcaccagtgggtccaagtccttctcatggggttgctggcctgggctgggcctggcctcggtctcctggttggggggcggccaagctgcccatcctgggccctcagtctgcagtcggtagacaggatgaggaggtggatggggcccatgccagggcggtgggtttctctgcagagcacggggccaccggctgctgttcactattaaggtttcctgcctttttaaaaacaagtttcctgggctcaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtaagtccctgcagcccttcaggctggacccaggccccaggtgatcccgagcagccaggactgcacacaaggagaccgagcagtcctctgctgtggggccacgtccgctcaggtgggagttgggctgtcggtcagacgctgctgctgctgcagacctgaccctgtgtttgccctgctggttcttctataccaggattgtgcgtgaaaaaaagaccctccatagtgtccatcaaaattacttgaaacccgaacaggaaaagggcatacgctctcggaggagggtcaggcgcagccatgtgggcttcattccttctccaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtaatgcattctgctgtgttttgttttgaatcagaaccctccttgcaggaatgatgctgattatttgcttctttctttctttcttttttttttgaaacagtctcgctgtgttgcccaggctggagtgcagtgggatgatctgcgctcactgcaacctccacctcccaggttcaggcaattcttgtgcctcagcctcctgagtagctgggattacaggtgtgcgccaccatgcccagctaatttttgtatttgtagtagagatggggtttcgccatgttggccaggctagtctcaaactcctaacctcaagtgatccacccgcctcggtctcccacagtgctgggattacaggctgaaccaccatgcctggctaatttttgtatttgtagtagagatggggttttgccatgttggccaggctagtctcgaactcctaacctcaagtgatccgcccgcctcagtctcccacagtgctgggattacaggcctgagccattgtgcccagctaacttttgtatttgtagtagagatggagttttgccatgttggccaggctagtctcgaactcctaaacccaagtgatctgcctgcctccgcctcccacagtgctcggattacaggcgtgagccaccgcgcccgaccccttttttctttttttttttttttgagatggagtctcactctgtcgccaggctggagtgtagtgcggtgatctcggctcactgcaacctctgcctccggggttcaagtgattctcctgcctcagtctcccaagtagctaggactacaggtgcatgccaccacacccagctaatttttgtatttttagtagagatggggtttcaccatgttggccaggatggtctgcatctcttgacctcatgatctgctcacctcggcctcccgaagtgttgggattacaggtgtgagccacctattctgtctttaaatcccactctataaggatcaagggcaagaggaaatcatgagcctgttttccctcctttctgaaggaagctgtcactacaaacactgacctgtactaagtgattttctagtaaagaggcactcagacaggtcattactgtttacagtgttgggggagtaaatttagaggaattgtcccaattctgtggatgaatttaaacttgattttactgaccattagctcagtaagaaacagctgatacctggaagactgcgagagagacttttgtggagctatatgttatttctcatattggaattttacctgtgttgtcattactggcagttatttaatccaagttaacctctgggttgggctgttttccccagggcagatgaaggtggtggtagcagtgaccttgtcttggaagctgccttcccagctctgaagtctgttttccacctggggaccatagtcagccgactgggagacggactggcctcctgggcctgcctggtgttggccactctgcctggccttgtcggaatgtgcacacatccccggccatctttttttttttttttttttttaaatagatacggggttttgccatgttgcccaggctggtctcaaactcttaggctcgagtgaactgcccgcctcagcctcccgaagtgctgggattacaggcgtgagccactgcattccctaggcatctagacacagcagtatccacgtgggggctgaggtttctctgaccatggctccctgtttgctgagttccaagtctgttgcccactgtgggagccgctgtgggaccaggggcaggtgacgtgaggatcatcggaacggatgaatgatgcgtgtggaacaaccagcactttgatccttcgcaggggggctcctgagggaccgccctccatattgtagggaaaaaggctcattcttcagtcatgctctagtgataactaggatttgcatgcagtgtgttctgtattcagacagaaaacctaggccctaaacaagctcttccctatttctggagtcggccgccccatgtgtgtgtgcactgagagctgtttgctgaggtagagaagtgtttcacaaacacatggattcctgagtcctccgggaccctccaagtgcaggtcctgtgccgtgggtctgtatggagccctccgagtgcagatcccgtgtggtgggtctgtgtggagccctccgagtgcgggtcccgtgcggtgggtctgtgtggagccctccgagtgcgggtcccgtgcggtgggtctgtgtggagccctccgagtgcgggtcccgtgcggtgggtctgtgtggagccctccgagtgcgggtcccgtgcggtgggtctgtgtggagccctccgagtgcgggtcccgtggggtgggtctgtgtggagccctccgagtgcgggtcccgtgcggtgggtctgtgtggagccctccgagtgcgggtcccgtgcggtctgtctgtgtggagccctccgagttcagatcccgtgtggtgggtctgtgtggagccctccgagtgcaggtcccgtggggtgggtctgtgtggggccctccgagtgcagatcccgtgtggtgggtctgtgtggagccctccgagtgcaggtcccgtgtggtcggtccgtgtggagccctccgagtggagatcccgtggggtgggtccgtgtggagccctccgagtgcaggtcccgtgcggtcagtccgtgtggagccctccgagtgcaggtcccgtgcggtcggtccgtgtggagccctccgagtgcagatcccgtgtggtgggtctgtgtggagccctccgagtgcaggtcccgtgcggtcggtctgtgtggagccctcggagtgcaggtcccgtggggtgggtctgtgtggagccctctgagtgcaggtcctgtgcggtgggtctgtgtggggcccgaggctctgcatttctcacaagctcctgggctgaatgggctgggctccaacagactttgcaggacaaggaccagagcctggggtcagcaccctcagcctgtgggcgcagcccaacaccgggttctgtaaactgtcactgtaacagccctgctcgctcgcctgtgctgcaagagcattgctgagcagctgtgactgacgtgcagcctgtgagctgcagtcttttcccatcaggcatctccaagaaaggcttgccgagccctgggctgcagtgtcccctggcctcatcccctctcccacctccctgccactcactgtgccttcatgctgtcagtggtgaggagggagagcccaggccttaggaaccaccagttcccgtcagaacacaagtgcttcttcctataacatctgtgcagatgtgtgccctcctggagccatcagtgtaatgtctgtgtagttgcatccccctcctggagccctcagtgtaacatctgtgtagatgtgtccccctgctgtagccctcagtgtaatattcatgcacatgcatccccctcttggagccctcagtgtaacatctgtgcagacacattcccctcctatagtcctcagtgtaacaactctgcagatgtgtcctttcctggagccctcagtgtaacatctctgcagatgtgtccccttctggagccctcagtgtaacaactctgcagatgtgtcctttcctggagctctcagtgtaacatcgctgcagatgtggccccttctggagccctcagtgtaacatctctgcagatgtggcccctcctggagccctcagtgtaacatctgtgtagatgtgtccccctgctgtagccctcagtgtaatattcatgcacatgcatccccctcttggagccctcagtgtaacatctgtgcagacacattcccctcctatagtcctcagtgtaacaactctgcagatgtgtcctttcctggagccctcagtgtaacatcgctgcagatgtggccccttctggagccctcagtgtaacatcgctgcagatgtggccccttctggagccctcagtgaaacatctctgcagatgtgtcctttcctggagccctcagtgtaacatctgtgaggatgtgtcccctcctggagctctctgtaacatttgtgcagatgtgttcccctcctggaggcttcagtgtaacatctgtgcagacagattcccctcctggagccgtcagtgtaatgtctgtgcacatgtctcccacaggtggaacacctgcagcaggagactgctgctctgaaaaagcaaatgcaaaaaataaaggaacagtttctccaacaaaaggtaaaaatctgttgttgatttcttcacttgaaacaagcatatgaacagagttttctgtggtttaattgcttagcaattccaatgtcattgaagttgagaagaaggtaacatcttgagttctctttaaattttttttttttttttttttttttttttttttttttggagacggagtctctctctgtcagccaggctggagtgcagtgacgcgatcttggctcactgcaagctctgcctcccgggttcaagctattctcctgcctcagcctcccgagtagctgcgactacaggcgccctccaccacgtccggctaattttttgttttttgtattttgagatggggtttctccgtgttagccaggatggtctcaatctcctgacctcaggtgatccaccctcctcggcctcccaaagtgctgggattacaggtatgagtcaccgcgcccggccctctttaactttttttaaaggtacttaatctgcaaagtcaagacacacttccacagtggggtgggggtcttggcccctcagatctccaggggcggctgtcactggagcgcctgtcagcataccctgttgtgctcactccagggagctgtgtgttgtgcagtgttgttaacacacaggttgggtttgccatttaaaatgtctttgaaaaatgcacatagagttccagcattgaaacaaattttggttatccaaaaagacatggaatataaattttgtgtcagtgaagccagtacctcctgttggattttatgggatctgagcaagggtgaccccgaagctatattgtgagtgctgctgtgttttatttctgagcgagggtgacccctgaagcagcgttgtgagcgctgctgtattttattttattttatttttgagatgaagtctcgctctgtaccccaggctggagggcagtggtgcgatctcggctcactgcaagctccgcctcccaggttcacgccattctcttgcctcagcctcctgagtagctgggactacaggcaccggccaccacgcccgactaatttttttttgcatttttagtagagacggggtttcaccgtgttagccaggatggtctcaatctcctgacctcgtgatccgcccaccttggcctcccaaagtgctgggattacaggcatgagccaccacgcccggcctgtaatttagtttttttgagacagagtctggctgtgtcgcccgggctggagtgcagtagtgctgtctccgctcactgcaacctccaactgccaggttcaaatgattctcatgcctcagcctcgtgagtagctgggactacaagcatgcaccaccacgcctggctagttttttgtatttttagtagagatggggttttcaccttgttggccaggctggttgaactcctgacctcaggtgatcagccagctcgggctcccagagtgctgggattacaagtgtgagccaccgcgcccggcctgctgtattttatttctgagagtgctgggattacaagtgtgagccaccgcgcccggcctgctgtattttatttctgagcaagggcggcccctgaagtggtgtcgtgagtcctgctttgctttattactgagccacaagcaaggggattacctgttggaagcaaagccgtgcaactgaagtcaggagagagccagactccttggaatagaggagacgtctatgaggccggtgtgactgccttgtgcaccacgcagtctctcaacaggcagtgatgtcacctgtggataaacagtggtgtgtctcagtcgatggagtcttagatttgatgaaatgtatctttacctcaaaaaagttatgcccccgataagtggtaaacatttttgttgaagccagcttgacccccaggtacgccccccacgccccgccgcccagcgtccgctcacagcctctgtctttggcaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcaggtctgtccgtgtcgggttgactcatttgatggggaggattcggccaaagtgcttgtcgggagggtggggcctgtgtctggggcggggcctgtgtctggggcggggtctgtctggggcggggcctgtgtctggggtggggccaaggtgggagaggcttttggaagaacagctgggaacaaggcccacctggagcataggtcccagaggggcagtccggtgaggcctggtaagtccaggtggtgatggtgcatgaagggagggagtgaggaggccccgtgaggcacccagcttctccccattgccatgggctcccgggatctagcatgtgagaggacagcggctgtcatgcagaaagcaagggtgagtgttttgtggagaccccacgtcagggcagggcgtcggggcccggggaccctgggagtccctcgtggctgagtgcggagctgggactgaccagagctagtcatgttcctgtggaagctgagcctgggctggcttctgcacacagtgggtgtccgagatgctggtgacagtttctcggctgcaggtagcagagcaggtgaggggtagaggcgggggacggaggccgcagtccaggatcctgtccagacatccaggctgaggaaccgggaggtgagacgagaaatcaggagagcaacagtaaatttggggagagtcgtctgatggcacgttagaccaagtgctacgttttgcttatgaagtttctgaagttgccggagaggaccgagccaaggtcccagcaggcagattggtcagcatgtctggctcattaggagccaggctgaggcctgtgagtaggcggtgtggccggcaccatcattgttggaaagtgagggctgatggattagcgctggtgccggggtggggaggtgggccaaggggagggccggctctttggactgtaggaggcttggaggactcagcagtgcgggcagagcacgttcggaccccacagctgcaggcctgggctggttgtggggactcgcctcgcacacaggagctggggaaaggctgcgagggcaggagcaggtcggggacgcggccctcagtgttcacagttgatcctgaggagggcatccggggggggtccagggaagggtcctggggtctcaggaagggtcctggggtctcgggaaggggtcccggggtctccggggaggggtcccggggtctccggggaggggtcccggggtctccggggaggggtcccgtggtctccggggaggggtcccgtggtctccggggaggggtcccggggtctccggggaggggtcccggggtctccggggaggggtcccggggtctccggggaggggtcccggggtctccggggaggggtcccggggtctccggggaggggtcccgtggtctccggggaggggtcccggggtctccggggaagggtcccaggggttctggggaggggtcccggggtctcaggaagggtcctgggggctctgggggaggggtctggggactgtggggaggggatccaggggcttgtggggagggttcccgggggctcttggggaggggtcctggggtttcctaggaggggtctggatccttgaggaggggtcctaggccttggggagggttcctggggccctggggaggggtcctgggtcctgggggtttggaggagaggtcctgggtccacaggctttcctatgaaccagtcatgtcctgttgtgcctctgatgctctggacagtgtttggaaatgcttgttggtctcagtaatgagtggtttgtggccgggtgcagtggctcacacctgtaatcccagcactttgggaggccgaggcaggtggatcacgaggtcaggagttcaagactagcctgaccaatatggtgaaaccctgtctctactaaaaatacaaaaattagctgggcatggtggcgggcacctgtagtcccagccactcgggaggctgaggcaggagaatcacttgaacctgggaggcggaggttgcagtgagctgagatcacgcccctgcactccagcctgggtgacagagtgagactccatctcaataaaaaaaaaaaagagtggtttgtaagaaggcagacgtctctctcaggatttttctcaaggcccaagtcctccagggcgagcctgagcagtgcctttggtgggggtgatgggctggagccaggaaggggagacaggctgggggtggcagtgccgctcctcacgccctccttcccttccaaagtcgttgcagttcgataaggagcagatggtcgcggtcacagaggccaatgaggcgctgaagaaacaaatcgaagagttgcagcaagaggcccggaagtaagtctgcatgtgcccgggggaggtgcgggggccaggtgggaggtgcgggggccgggggggaggcgaaccagaatgccagacggtcacatcgggataattcagcttcctcctgtgtctccctcatgacaccccagggccatcacggaacagaagcagaagatgaggcggctgggctcagacttgaccagcgcccagaaggagatgaagaccaaacataaggcctacgagaacgccgtgggcatcctcagccgccgcctgcaggaggcccttgcggccaaggaggctgcggacgcggagctgggccagctccgagcccagggtggcagcagtgacagcagcctggctctacatgtaggtaacaccgtgccatccccggccagggtcaccagcccctcagtgcagggaagggctctccatcagcagttgtcccctaaagcctagcggggccgagctcgcgtgggaggtggcaactctctaaactcccgctcatcttcgaggttaccaggaacccacagtgactgagcattgcctcgcgtctccctcatgaaccccacatggcctgtggcctgtggcgttcacctgattttcctcaagaaatctccttggctcagagaagttcagctgctcccttggggcagagggagggcctgccctggtccgctcgcgttccagctgcctctgcgcctcctcgcatctcaggaggaaaagcagcctccgcactcactgagaagcaggagtgagggcatggggtcagcgattgacagggttcagggagcgtttagaggtagccatgctgcggtggcccagaacaagcgggtgccctttctggagggctctgagcagagccttccgtggaggccgtggccctccgtgctctgtcacctttcgtggtaggcataacattctacctgagtgagttcatccgcattttatttattattctccaattcacgtccttgcactgacaacttagtatttcttcttatatgtggtttgtttctatctcctgtccacttaagaatttatgggtaggaagagactgtatcataacgtggggttttcttgtcaaataaactcggccgggcacggtggctcacacctataatcccagcgctttgggaggctgaggcaggaggatcgcttgagcacaggagtttgagaccagcctgggcaacataattagaccctgtatttacaaataatacaaaaataaaacccaggcatggtagcacgtgcctgtggacacagatgcttgagacactgaggtgggaggatcgcctcagcctgggaggtgaggctgaaactgcagtgagtcatgattttgctgctgcactccagcccgggcgatagagactctgtgtctgaaattcaataaataaatcaagtgcttcctctcacctggttgctttgtaaaatgttggggagattgattcagttgccattttctttgggctcactaagggctggggtggggaggtcgcaaaggccgggcagagctggcccctcgccacgctgttgcagctgaggaatagcacagctgcgagccgatgtcttgtgtccgtccgggcttcacccctcgcaagtggtgacttttggcaaatttctcacctttttgatcctcagcaaaatgaggccaaattgaggtgaatgagaaccttctcatgtaagggttaagttaggtggtactggaacatgcttggcaagggcctggtaccatcgaggcagcaagtgggcggggtgtgagagcacacctgtgcctgcatgtatccgtgcatgtgtgaggtgtgagcatgtgtgtgtgcagcgtgtggagtgtttgtgtgcatggtgtgtgggatgtgagcatatgtgtgcatgcagtgtggggtgtatgtgtgcatgcagtgtgaggtgtgagcacatgtgcatgtgtggtgtggggtgtgaacacgtggggtgtgagcatgtgcgtgtggggtgtgagcacgtgtgtgtgtggtgtgtgggatgtgaacatgtgcacgtggtgtgtgttacatgagtgtgtgtatgtgatgtgtggtgcgtgagcacgtgtgtggtatttattacaactggtgctgcttgcttgccacagatggtgatttatagccattatctgcaggtcagattttcttctgtatttttgaagcattgaactgaagagatgattttgtttgtcccaactatccccgtgtgtcatcgtgtgcatgctgtggtcggttaattcaacttctttaacaaaaaggaaggttgtgagactgtgtcagacagctggtgtctggtgtgtgcagccacacagcctcatgcctgccggcaccacaggaagtgaggggggtcagggcctgtcccatgaccaagcgcccgttccatcttggcccttaggaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgaggtgaggcctggccatctgctgtggcggcagcgtggggcaggtcacgtgagccctggacatgccgccacgcgtgagacccgaagaacaaaacttcaccgtgtgcccagcgttgctacttttggtgttgccaccttctgaccgtcggcctctggctctgtggtggggcaggccctgattccagccctctggggaggatcactgtacagcctctttggtggagtggttacagaattcatagtggaacccttctcagttcaaatgctttggttgcaaataagaaacccaacttcgccaggcgagtggctcatgcctgtaatcccagcactttgggaggctgaggtgggcggatcatgaggttaggagctcgagaccagcctggccgacatggtgaaaccccatctctactaaaaatacaaaaattagccgggtgtggtggcgggtgcctgtagtcccagttacttgggtggctgaggcaggtaaaccgcttgaacccaggagcggaggttgcagtgagccaagatcgcgccactgcactccaggctgggcgacagagtgagactccgtctcaaaaaaagaaaaacgtcagatatctcaggttcagagacagttctcgcttcagcgctgctggtggcagctcagtgtcccggcgccccccactccccagcccctccctgtggagctccgtcacagtagggccgcctgttccactctctggctgtgtcctgccctgaagtggttttgctcatgcccaccctgctgagtggcctagccagggctcagtgcctggacagacttctccagaagcccatggccccaggagaaggctgggctcttggccatggggaggaatgagaggggcctggggaagcaactgaccatgaccacgacagccttcagatcatgaagcaagcacggtcctgtggtgtccatcgcagggttgtgtggtgtccattgttctttgtttttgttgtcttgagacagagtctcactctgtcattcaggctggagtgcacaatcttggctcaccacagcctccacttcccaggttcaagtgattctcccgcctcattctcctgagtagctggaactacaggtgatcgccaccacacctggataatttctgtagttttggtagagacagggtttcatcatgttggctaggctggtctcaaacccctgacctcccaaagtgctgggattacaggtgtgagtcactgcgtccagcccattgctgtgttttagttttcgatgtttcttttcttttctttttctttttttttttttttttgagacagagtctcgctgtgttgcccaggctggagtgcaggggcacaatctcagctcactgcaacctccacctcctgggttcaagcgatccttctgcctcagcctcctgagtagctgggactaaaggcatgtgccacgatagtggctaatttttgtattttcagtagggacggggtttcaccatgttggccaggctggtctcaaactcctgacctcaggtgatccccctgcctcggcctcccaatgtgctgtgattacaggcgtgagcctctgcgcctggcctaagttttcgctgtttcttgttgaaaactcacctgtttctggggtatgtgaactccactcaccagtgcaggtaattttacagtgacattggtatgtttcagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtattcaaactcgtcaaactcacgccagcaacggtgtgagagttggtggggctgtgcgcactccgagaatctcatccagattcagtcacctgtgctgactcctagcccacccggcctgcagccgagagaacaggctcaggagtccgggtgacccacggccctgggtccccagctgttggtgcagggctgggctctccgaggggaggaacaggctcaggggtctgggtgacccacagccctgagtccccagctgttggtgcagggctgggctctctgaggtgaggctggagcccctgcgtgtgctcagttcacctgtttagttgaggggcagacctgcttagtcggggggcagacctgcttagttggggggcagacctgcttagttgaggggtagaccttccatgtgggtgtggctgagttccagtcccagacggtgacattgtttgtagggggcacttaacaagaggttcacacaattcagaactgggacttgaaccctgacctggttctcactcagctacttagtctccacagcctctctgaattgaggactaggctgggcatttcagggaaatcctgggggccaaatcgagctgctggtgttgactatcccatcttagttccatattttgccctagttcccaccacttctgttctttttgtacccggctgcagcccctgatttgtatgtagtttttgagttcccagccaccatgttccatttttttgttgttgttgttgttagtaatacggagtctcactctgtctctcaggctggagtgcagtggcacgatcgcggctccctgcctcccgggttcaagcgattctcctgcctcagcctctggtatagctgggactacaggcgtgcaccaccgcgcccagctaatttttcatatttttagtagagacaaggtttcactgtgttagccaggatggtctcgattttctgactgtcatccgcctgcctcggcctcccaaagtgctgggattacaggtgtgagccaccgcgcccggcccattcttttttttttgagacagggtctggctcttgcccggagtggagggcagtgcggtggtaccatcatagctcactgcatcctcaacctcctgggctccagcgatcctcctgccctggcctctggagccgtggggcccacaggtgtgccacgttcttgagtgcggccctgtgatcatgctcccgcaacctaggattctgttttgtcacagattcttcagcagtgaagttccctctacctccctggcgtgtgcctgtgatgtggcgtgtgtcacgttgcctgctgtagcagccttgtgtgtttgtaattcgacgtccttccttatctgtcctcctgcaatctgatctaggtgcaggcagttttgcagcgcaaagaagaggaggatcgccagatgaagcatcttgtccaggccctgcaggcctcactagagaaggagagggagaaggtgaacagcctcaaggagcaggtgcgtgccaccttccgtctcacagggcgttccagaggacgctccagtgcctagaaatctatgcagggtccttcacacaccagcctccttccagcagttacacagagcaaaggtgtgttgcagttgttggtgacggaggccgcagagcacctgctctggtccgtagaaggtggcgttagattaaatggcagtgcagctgtgagggcctggggccaatgagctccgcgtgcatgtgtatttatattgtgctgggagtggtgtcctgtatgtcgtgttgcattgcaaaagcaaacttgagaatagcatatgatcccatttgtgttcggcagataagaggggtggttctgtggacccttctctgtgtagagagctgtcttttcgtggctggcccctgccctgcttcaggtgttcactgacacgttggtcacgtcgccagcagaggcccatcctgacccccaggtgccctgtctgggccctgctcctctgttagaacgctgctgcttgctggctacctccgccatacctggcacagagcagctactcctagtacgcttgccgtgtgtgtgcacatggggggtgtgcgtgcacgtgtgcctggggtgtggtgtgtgtgcacgcggggggctgtgcatgcaagtgttgtgatgtctgtacacacgtgtgcctggggtgtgtgcacgcggggggctgtgcgtgcaagtgtgatgtctgcacacacgtgtgcctggggtgtgtgtgtgtatgtgcgcgggggggtgtccgtgcaagggctgtggtgtgtgtgcgcacgtgtgtgcctggggtgtgtgtgcacgcgggctgtgcgtggaagggttgtgatgtctgtatacgcgtgtgtgcctgggttgtgtgcatgcggggggctgtgcgtgcaagagttgtgatgtctgtacacgtgtgtgcctgaggtgtatgtgcgcgggggggtgtccgtgcaagggctgtggtgtgtgtgcacacacgtgtgtgcctggggtgtgtgtatgtgcacggggggggtgtccatgcaagggctgtggtgtgtgtgcgcacgtgtgtgcctgggctgtggtgtgtgtgcatgcatttgatgctgatgtatatgtagaaaatttctaggaggaacacaagaaataactggttgtctctagagaaaggcaggaaagaacacatcacttttcctttaaatcccgtttgaattgaacttgtaaaaaagtaattgcttcacaattcaaacttttcggcctaacagtgaagctgctttcgttcctatgacctggctttgccacaacctttaagaacttttctatgataatgtaattgagatgaaaagaaaaaggttcttgattttttttaaggggtgaaacaacaaagtttctttataaatagaattaattttaagatgtggcaggtggctgggcgcggtggctcatgcctgtaatcccagcactttgggaggctgaggcaggcagatcacctgaggtcgggagttcaagaccaggctgaccaacatggagaaaccctgtctctactatgaatacaaaattagcctggcatggtggcacatgcctgtagtcccagctactcgggaggctgaggcaggagaatcgcttgaaccaggaggcggaggttgtggtgagccagatcacaccattgcactccagcctgggcaacaagtgggaaactccgtctcaaaaaaaaaatgtggctggaatattttaacaggagcagttaacagctttctcttggccccacaggcctcatccgcccggccgtttaaccctggcctggggcctgctgctgggccgtggttcaggctggctcacacggtgccccagctctccagctttcgctccgtgcttagggttcactgaatttttttcggttttttttttttcagacggagtctcactttgtcaccaggctggagtgcagtggcttaatcttggttcactgtaacctctgcctcccgggttcaagtgattctcctgcctcagcctccccagtagctggaactacaggcgtgcaccaccatgcctggctaattttttgtattttagtagagatggggtttcaccatattagccaggatggtctcaatctcctgacctgatgacctgcccgccttggccttccaattaattttatttttattttttaaatgtatttattttattttattatttttatttatttatttgtttatttttttgagattttgagatggagtctcgctctgtcgcccaggccggagtgcagtggcgcgatctcggctcactgcaagctccacctcccgggttcacgccattctcctgcctcagcctcctgagtagctgggactacaggtgcccgccaccacgcctggctaattttttgtatttttagtagagacggggtttccccgtgttagccaggatagtctcgatctgacctcgtgatccacccgcctcggcctcccacagtgctgggattacaggcgtgagccgccacgcctggcctatttatttcatttttgggaccgggtctcactctgtcaccccagctggagtgcagtggcgcgatcacagctcccctgcagcctggaactcctgagctcaagtgatccttccacctcagcctcctgagtacctgggaccaccatgccctgctaatttttttattttttgtggagacagggtcttgctatgttgtccaggctgtgaatacactggaagaagactataaaaactatttagaccgagaaatctcgaataaatgtgttcattcaacagatagcagcagccacataagtgtgcacttgctgcgtgccgagctccgggtcaggtggtttcatctttacaaggaacttgacaggcctgtggagaagcacacgccggcagccaggacatgcatggggccgggagtgcgttcaccccctgcgcccagcacgtcataaagctgtgggtgtcacgcagggcatggacaacgtggcttccttcctcctaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagtgagtgcctgggccccgccagccctcaaacatggctgtcctggcaatgggcggggtctaattcacaccttcagcacagcgagggtcatctatattttgcaaattgccgagtacttgagtgaatcataggagtagaaggcacccagcctccgtctccagaatcctgagcctcactcactgccccgtgtcctccccccaagagagaaagcgccccagcaggagtacttagcttcaggtcagaggcgggaaggggcggcccggcgcggggctgatgcttggctctgtgggtcccatgcactgtggtctcggggccggcactctctgggatctgtgaggggtgccggcaaagtgagtctctgggatctgtgaggggtgccagtgaagtgtgagtctcaggtgcttcgtgaggactgcccgagtgcacactgtgggcaccaagcatggctgcagcacgcagtgcacagcagagggcctgccaggacgaacgccttccacaggcagcatttcccagcgggagggcacagcacactggaggagcgtggcgattcccttctttcttgtttttttacgctaggattcgggaggggaaacattcccaggagatagcacagttccaagcagagctggccgaggcccgggcacagctccagctcctgcagaagcagctggacgagcagctcagcaaacagcccgtgggaaaccaagaggtgacggttcacgggggctggacttgcagggctggactcacgggtgccctgggtgacttcactccatcctgcttggggagcaacagtgatggttttctgaatatggtattaaaagataaaccaaaacacagctagagccattttccagggcagtaaagccactttaatattcttttggccatgtgactttcccctctttagatggaaaatctcaaatgggaggtggatcagaaagaaagagaaatccagtccttgaagcagcagctggacttgacggagcagcagggcaggaaggaactggaagggctacagcagctgctgcaggtacctgtgtgtgaggcgctgggcacaggcgggagcagcagggaggaaggaactggaggggctacagcagctgctgcgggtacctgtgtgaggcgctgggcacaggcgggagcagcagggaggaaggagctggaggggctacagcagctgctgcaggtacctgtatctgaggcgctgggcacaggcgggagcagcagggcaggaaggagctggaggggctacagcagctgctgcaggtacctgtgtatgaggtgctggacacaggcgggagcaccacttctggggcagcccctggttcctgtgccatgcggcctgcggccaggcagtgctcccggggagctggcgccctcgtccagtggggcgctcgcaaagccacctggtccacgtcatgcggcaggacagaggcaggggcgaagcctgggccggctccgatcccttggccgcgctgtatgtcacggaccaagaacgtgatttcatggactacagcaaatgggagggtgcgtgggaaaagtttgccaatttgcgataaacttctcaacaaagaactcagggttcggtcttgactgctcgggaaaggagtgtaattgctaagttccccttgtaaatgaggggcttgagttacagtgagaatttatttatagacacaggccgacaagcgtccatcatccagaaatccaaaacctggccaggcctggtggctcacacctgtagtcccagcacttaggcagtgagctgtggttggaccactgcactccagcctggatgacagagtgagaccctgtgtctaaaaaaaacaagaacaaaaatccaaaatctgaaactttctgagcatcaacatgataaaggaaatgatcattggaacatttcaaatttttggattgtggatactcagctggtagttgtaacgcaaatattcaaaattccaaaatttgacacacttctggtcctgagcattttggacctggactggcatcatctagatggcgccgaggaggacatgtgtgtgcttaacctatgaaaatacaaactcggatcttggcaggatgtttaagatctgttagcttttaaaaatctgacttcattttccacagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacggtactcaggcccgcgtccctcccggggtagccgacgtgcgctgtagatgctctcggacaggaggctggcagacgtgttagtcattcagacataaacggatttgttgagcccacactgagcagctgctgtgtagtcagtggtaatggggtgacagatgaaatcatttcattctggtttcattcatccaacagtgttttcctcgttctgtgaattcaaataccactttgttgtaatgtgctttgtaaagcagatgagcggtggtctgtgactcggcagtccctgctgtgtgtgaagggctggggcccgggagctgtgcccaggcgcccggcggttttctgtgctcggtccacatccatgttttccaggaggcaggtgggagggcagcgctcggattgagaggccgtttagcgtcgtgtgcttatctgtggaaaaagtttgaagtcccagaaaagggagcctaagctggaaaacttacttaatttcttaaggaaattccacatcaaggtcttgagtatctgatgggagaagcgtctgggagagctgtagtctgtggctcggccccgtcctgccgcagacccaggacttaggttgtctctgctttgctctggttttgtgccttaggaataaaggtgtttcctcagccagctattctggagctccggggactgtcgtgctgggctgccacggcggccaggacggtccccttcccagaggccccacgtccaccagttggggaggcccgtttgccacaagctgtgctagtgagactgacccgagggaggggacggtgggaaagctgatcatgtgcttttaaaaacagagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagtacgaccgtattccgtgctgcacttcagctagtcttaaagattaatgccctcttacctgggagggcactcctggtgccagtactgagtgcccagcagagtttcagcaggtttatataagggtgggggactcgcatacatagcctctgaggtttatataagggagggacttgcacacacagcctttgaggtttatataaagggggaaggactcagcctctgaggtttatataaagggggagggggactcgcacagcctctgtggtttatataaagggggagggactcacagcctctgcggtttatataaagggggagggggactcgcacagcctctgaggtttatataaagggggagggggactcacacagcctctgcggtttatataaagtgggagggggactcgcacagcctctgaggtttatataaaggtgggggaactcgcacacacagcctgtgaactcataggtggaaactgcctggagttaaactaccctgataggccctgagaagctggaaggccacacatggtgcacctggcagcctgaggctgagcgaagtgtgtagggcggagccaggcggcgccccgagggcaggtaacggagtggaagtcgtgtgtgccaggcctcagtgacagcttccaccctgccgcctggtcaggactggtccttgagcctgtgtcctctgcacagtgtagagaacggtgctgagaacagctgagcttctgtggtctcagttggtttgcggatccccgaaggcgccccggtccactcaggtgctagcgagtgacgctgtccacaggtggcgcgttctgcctggcacttgtgtgatctgggccttcttcctcctccttctgtcccaggcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtcgtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatattgaatatcataatccaatctttgtttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagattttcatattcattggaagcttcattttaatagttatattttgtcgtttggcagtaactttttaatctcatgttattacacactctgttcaacacgtgctttaaaagagaattctactgtcctgccggtttctggcaggagtgaagcaaacttctgtggcttgtgaccacggcagacgcgcggcaccgcctcctccgtccttggcccacgcttcgctttgcccgttgtcatttgccaggaatacagaaggagggggagcaagcttcccggtgaaccggggaaggatggtgaccgctctgtgctgcgcctcctgaactgggtctcatcatccaggtgctgccctctgctgggcctccccggtgacagtggagtcatgactctcagacctcagcaatgtgacttcccagattctcgtctttttcatccatactttgattttggtcattaagagttaaccaggcgtaagctgggtgtggtggctcacgcctgtaatcccagcactttgggaggctgggagggggtggtcacctgaggtcaggggttcaagaccagcccggccaacatggtgaaactccacctctactaaacaaaaaattagccagggcgtggtggcgggcgcctgtaatccccacttgtcaggaggctgaggcagaagaatcgcttgatcgggcagaggttgcagtgagccgagatcacaccactgcactccagcctgggtgacagagcatgactccgtctaaaaaaaaaaagagttaaccaggtacagagttttcagttagacgttattagaggccaccatggtttaaaaagtacagaaaaggggcaggaagtggtggtcgctgggcttggccctgtgggattaatgcacttcttcctgtgagcgttaccagcttctgtacccagagaattgctacacagagtaaaaattccctgaccaccttctgtggccttaactttctgaaatattaaggatataattttttttggtctatagaacccttaaggggacatgtatgtatctgaactttttccttttctccatggagttgctacgtgtttgcaggcactgcactgacaggtatattttaagctgtgtctgtctcagcagctcgaagctccacgctgcgtcctgctacagagctcagcagtgggtgtcaggagtggttttggcagagatgaatgggtcacttcttcctggcttagagtggcggcaggtactgtcaggaatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcctcccaggttcacgccattctcctgcctcagcctcctgagtagctgggactacaggctcccgccaccacgcccggctaatttctttttgtattttagtagagacggggtttcaccgtgtcggcccggatggtctcgatctcctgacctcatgatccgcccgcctcggcctcccaaagtgctgggattacaggcatgaaggagactcaggatttaaaaattaccaggtcactcagaaatctgagacctcgggtagtattaggaagcaggccaggcacagtg

SEQ ID NO: 12905 - DNA, 16073 bp, Human; identical to SEQ ID NO: 12312

SEQ ID NO: 12906 - DNA, 161914 bp, Human
  misc_feature (1)...(161914): n = A,T,C or G
ttgaggaaggaggattgcttgaacctaggagttcaaggttgcagttagctgtgattatgccattgcactccagcctgggtaacagagtgagaccctgtctgaaaaacaaacaaacaacaataacaagaaatcgaaaataccacaatgccttaaatattatttaaataaaggtttgggttttatccagtaggcagtttggacccaatgaagaatttcagggcactgagtacacatttgtgtattagatatatataattggtgggtcctcagacttcaccagctcatggttttaagataaggtccatttctcctactgggtttctctcctcaaacaattcctgagactccctaaggtatccttgcctgtcccacaaagccattgcagtgattgctcaacccgtctgccagccatcctcagtccaaatagtcctgataccgaaggcctggggtcatattataccatcccttaactggcttcttcaggcttctctgctcctgctatacctatctgccaccacatcccatcccatttccacctactgatgctcttaactccgtaaatactgcacagctaaaaacaacctgtggtattaaacaaaacttcatagatatacagaaaagctgaagaacagcagagaatgattgatcttgctttacaaggggctagtcttagggtcagccccaaatctgaactcaggtccttctacttctcagcaggtctccggggcattacccaccttgagaacctctgggcctattatctacactgtctctgcctaggttcccaatacccttgggccaaggaagaggaagaggatgtttccttccccaaagcctgtttattttcacccccagaataaatgagtgcagacttctatttccttcaaagaaaactccacctacaaagtatgacttgacctttacaagccatataaagcaaacatagtagttaatagtacatttagtcaagtcggagttaaatcttaaatgataccatatgtaggatatcaacagttcatcttaaatctgtatttcagggaaagaatttctctaggatgtagaatgtaatctaggttagaatttctctaattttgcaggggcacgatcctgttgagtatagacccaatttacatttctaaacaagttatgccagtgaagccaaaggcagacaaagtttcttagctacactcttagacaagagaacagaaagccagcatacactctgagaaaaagaggaacatgagttaggaatgaatgcacgttaatttagtgagtttcttaagtgtcaatatggtttcagatggaatcattgaaagaaataggcttgaacaaggaagactctaaactggcaatgaattttccactgggttttgatgaaatgaaggaatccaaaaattataaaataggttgggaatggtattacacggtccaaaatctaccctctaaagaccagcctctggtccctccaagtgcgtctcctttacatctcacattaagtatccttcgagtacttctgaaaagccacattcaccagggtgcctgtgctttgtcgtagcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaagaaggacgaggagtctggtacgcgcggggcttccgaggcccaccctcagccgcgggacgccccttcccccgcccgccgccactctgctttcaggccggcggggctgggggcgtgggcgccgccgtgccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcaccggctctgtcccaggtccccgggggcaagactgtcccgtgggacacagctcgttgaatgctcaggtgtccagaagtgacctgcgtcttgatgcccgtctttggtccagagcaaatggggaagatgccaagcatcctcaaaaagaaaaaaattctcagtgtttggtagcatctcccacagtgtgagagggggttgggttagtcaacctccatggcctcttgcacctttacgcctgcatgattctctgggaaacttcgtttctgcctctccttaagtgttagaaacacataaaatactgcttacctaaggaaatcaaaagcaccctactacaatctcattaatcttcgttgttgtggaaatgacacatttttaacattcatggaaaaagagggcagggaaagaagacactcattttggagagggttgctgcgaaagagaagtctcagctcttcgagtatggcagtgacagagccgggatcaaaatgatttcattcagttcgtatgcgtattagccatgattatcactgtgccatccaagtgttcacttcccaagcattcagtacccttctctggaaagtatataagtttgtgtagaacagctgttcaggacatttttttgttttgttttataaataggtagtggctccaatcctttccagcatctggagaagagtgctgttttacaggaggtatgactgggaagtatcttgtgccctttcttttctattctgttttagagtggtgggcagagaatccctgggctgctgtgatcacgacatgcaaaacaagaaacgtaacagagtttagggaatatagatttgagggaaaagaaagaggggttacttgtcacaggagaatttggagcttatagaaatgcaaagacatgaagactgtcacaggttgggaattttaaatgtaagaacaggtgtttagtgcaaggttattgaaatcagttatctgtattaatctcattgtattagtatgatatagataagtattgtgatccttatttaactggtatagcccataaagttgaagtagtcaacctaagggaatgagaaagtataggatggaaaatcaaggccacgtgtaataatttatcagataccttagtaaattgagaactatagacaatgttctttggataccgtgattaaaaatagtctgtattaaagttgatttgctataatctgtgatagaaaaggtagaaaagtagcaatgttttttatgttttttcataggctcgtatattcaatgaaactccaatcaatccaagaagatgtttgcatattcttacaaagattctttacttactgaaccaggtatattatttttattttcctcagataagtgtgtcctggaatagaaatactgaagattcagtgaaatactttctggaaagtatatttatttattttaaattcacttaattttaacatatacaacgtttggttaacaaaataatatgtaaaacttgagtacgaggactatgacatatacaggttgagtataccttctttgcaatgctcggaaccagaagtgttttggatttcagatttttttggattttggaatatttgcagaatacatactcactgactattgctaatctgagtatctgaaatccagaatgctctgatgagtgtctccactgagtgttatattggcactcaaaaaatttctgattttggagcatttcagattttggattttgagattagagatgtttaacctatacttcctttttattcatgagatcctaaaccagtgatgcgcatagtagattctcaataaatcctttggtttcaatttaatgagtactagttagagcatgttgtttacatgtatttggagatcttcatgtttttctgaaaatacagtgcaagatcaggcaaattccagatattttcttttttatgtgtgtaatgatgttttaaagctttgattgttaatattcagattttatatttattatccctatgctaccattactagcagaataattctgggcagtagcttaaccattttatgtgccttgatgtccttttctctacatggggattatgataatacctgttacagagttgtaatgactaaatgagataattagtgtaaagcactgagaatagtcctgaacatacagtaagcattcaggaatagttttccttccatcattcagcaaatatttattgcgtagctgctgtgtgctgtgcactgttttaggtgttggggatatagcagacaaaccagcaaaaatatttgcgctcatgaaatgtagattctgcttgctgctgttgttattaatttttcttttctttttcttttttttttttttgccccagacttaaaaaaaactcatgaaatgtctagggccttagaaaatatgattttgtttcatggattcatattccctcagtatcagtggggaattggttccaggacctccattggatactaaagtccatagatgctcaagtccctcatacaaatggtgtagtatttgcatataacctacacatatcctcccatatataagttgtctctgtgattataatacttagactataatctctagattacaatacctggtgcaatgttagtgctgtgtaaatagttgttgtgctgtattgtttagggaataatgacaaaaaaccatctgtacgtgttcagtacaaacatagttttttttttccttgaatattttcaatctgagcctggttgaatccacagattcagaactcatggttatggagggctgactatatatgtctatacacatacagacggacacataaaacatacatatataccatatacctcaggtggtttacatatggtgctaagataaccatggtttccaatttgaattctaagagaatatattatctttactttgttttgtgactgaagacctcactcagagatttaataaagttttcttgtttacaaatgaagactaagcaacaagcacatagattttttttattttttgagatggagtctcgctctgttaccaggctggagtgcagtggcgcaatctcggctcactacaacctccacctccctggttcaagcaattctcctactttagcctcctgagtagctgggattacaggcatgcaccaccacgcctggctaatttttatatttttagtagagacggggtttcaccatattggccaggtgggtctcaaactcctgaccttaggtgatccgcccacctcagcttcccaaagtcctgggattacaggtgtgagctactgtgcctgatcatcaaacacatagttttaaataaaatatatctgttcacaaacaacataatccctctgtgtcagcatatgagaaacatttaaagcatagtcaattgggtttaacttttcatagcacacattgtgtctaagttggccaaatccattgtataaacaaaagttttgaatagtcaaagttgattgagagtaacatgtatttttatgttggtcattacctcttcaatgaggcaactcatgttgaaacatttaattatcttgataaggaaattaccaagcacagcataaacacaattaactatataaacaggtttgggaacataaattttatctctttgcctagaacttggtagagctttatagaaagatacttttgaatttctatgagagttgacatatccatgtgttttctgagtttcaagtaaaaaagtaggatgtaaggttttcctgtataactaaaaagcacacagacttctgggtattcagtaaatagttgtgaaagaaagataaatctcatgctgatgagcaggctggatacactgatttaagtaagtataaacttattgtactttgtcttttatcctaaactgtcagtatttttcaccaaaatttattcttatacctatggcaaatagattgaagactagttatattttatgtggaatctgaagctctgaaaagtgattgagtgtaacgtattatataagattgcttttagtgaagacattaaatattgaaatggtaatatttgaggtaatctatgatttgagatgttttgaaatacgttatctaacactttttcactgctcagaaaatgtagttcccagatcagcatttgcatcacttgttagaaatgccaaatctcaggccaggcgcagtggctcaagcctgtaatcccagcactttgggaggccgaggcaggtggatcacgaggtcaggagttcaagaccagcctggccaacatggtgaaaccccgtctctactaaagataacaaaaaattagttgggcgtggtggtgcacacctgtaatcacagctacttgggaggctgaggcaggagaatcacttgaacccaggaggtggaggttgcagtgagccaagattgcgccattgcactccaacctgagcaacagggtgagactccgtctcaaaaaaaaaaaaaaaaaaaaaaaaaagaaaagaaatgcaaaatctcaggctttaccccagagccactgaatcagaatctgcattttggcaagatcccaggatgaattgtcatgctcattaaactgtttgaagctctgatccaaagcatgtttttaggggcttgaaccaatattgagctacatagcagccccttaagcctagttttttaatatgatgaatctggttcctgcccttttggttggtccccttcttgccattttgctgagattctgaatagatagttccttatattttaatatttattatgctcccatgacatgttaggcattgtgctgggcattatagatatgatctctgctcttaggcagtgtaataataatgtcctattgtgagtgctgtaattttctccctccttgtaaactacaatacttcaggaaaatttcagatactttctactaaaagtttagagatcactatgccagaacttttaagcatggtatgcgatactgaattattttaaataaggggggataaatggctatgtgggtttatgcattgaaagccagaaaaattgcagaggcagaatgtttacaaagagattcttttttcttgagttctaaaggatttttgcagaaatagaaaatcctgtgtgtgtatatgtacatatatatgaatatacactttttaaaatttaaaaattgttttaaattttacttagggtgaacactttggaacaacggaagctacagaagccttctttgcaatgacgcgattgtttcaatctaatgatgtaagtctttttaaattttttttacgatgaaaaacctccttttatttattttccccagggaactaagagtgttctaaattagggagcattgcttgaaatgttttaaattatttaactgcttataaaacttataaatattcattataagacgtgaaaatggaagaattaaagtatgcagtgtaaaacttttccctgcagatctaccgtgaagtcataaagactgttaatacctagcttctggcatgacactgtgaaggtggactgataaagaagtcagtgcacatagctaccacatttgtcagttcttagtcaagtttctggtgggcctgggattgctgttagtcagcagtgctggcagttgagaagaagagctggatgtggagtggggaaggggaataaggaatagaataaggaaaaagaaaaatgagtacaaactaaacctgcctctcattaccttaggccaccctgaccttcagaacatacagctgctgctttttgtctgtcttctaagtgttgtgtacatttttcttttgcctagctctaaggcagaaccatacagggaaggtaattctgggatatgtattttccagctttccattaacataaattggccaaatcctgcagttttttggtatgtattgcatatcatcacatgtcacattttgtgtcaacccccagaacctcttgagatttgagtcttgttatggatctaaataatgagaggttttaggagtagatcttcaggaagatcagcagtcccctgtaaggcagctgtttcaggggaggccattatatactctacaggcaaaggaagactaatttcctcacatatgggataaaggactgatgcttctactagcagaagatgtcacagaatttaggagttcggggtacttggcttcatcagagtctgtccatatatcttcattctacttttcagggccccattccttgccagtcaaggtcctaactttaacataagatgtcctgcaagagtgtgaattcaatttgcattgtaactgagccacctgcaggatatactttgtagaagtctcagccctgtagccacatgatataaggctttctatgaaggcagttatagatttctggcccccttacccagatttgagtagtgcttttaaaactccgagctcatcattttcttttcctgagaaaagaattatccagtgtacctagaaacaactaattaacccattatacaacttatttttactaaaatcttctatggcatccactagttagttacccaaggctttgtcttctgtaggtccttgtctgcagatgatgattttaaatattttgccactgcatgctgtggactactagtagcccctttaccattggaaactggtcattaataccttcaatcaaatcagagaagcaacttcaggttcatatctttaaggacttcttttaaccacttcctgtagcagaaattcagggttcagacagggaaacagaaccactatgagtattgtggaattaggtgtttattagaggaattagactagaaaactaggcaggttgagctgctggagtagggttcagagggaggctgttacataagtcatggaaggctattgcctcttttgtggctttgtttttgcagccaggtgtcttcccaaggctgctgttactcagagggctggcagttgggaagaaaagctggacatgtagtggagaaaaggaagcagagtaagaaagaaaaaggatgaggacaaacttttgaagcctgtagcacagaggtttatattaagaaaagaagatatgaaattgtcttctaggaaatggattagggaaatgtaggattgttcgataggactaatagcctgttgaagttagtgcttatgaatttaaagtattaccaatgtttttctccagctacatggtgaatgtttttctccagctacagcctgcaggttaaagcactgaaggcttagagataggatttaatcaggattgaagttttgccaggttagtgaacagagggagaagcaaaaaagttgagtggttggaacatcgactgtggaatcttcggttaggagggaagcaagaacgggctgacagggacagcaaaaagttggtagaaccagtggattgtaggtcaagagagagtgaaagaagtttggagtcaggagtgtgagtgcttgggaatgaaattagaaagggatgctgttactgataggctgtggcagtgggtgatcattgtagggaggatggcatcattggagaagaggaggtcgaggaatgaagaggtcagaggtttagagataccatctgtatggatattaaaatcaccaatacttattactgggattgcactggagagacagtgaacaaggtactggtattttttaaaaataagggaagtgacctggggtttaatggacaaccagcaatggtagcaggtgacatagtataaaggcataagcttccccacctgtaggcctggtggtatgagggttatgggagagaaaacagctgctatttcagagggttgcaggaggatccctgggagagaaccaggtttcagttaaagaaaaagatgggaacattcagagaagagtttgagaatataggggattttgctgatgaaagtgtcagagaatataatggcgctgattagaagggtggaaaatggagtcagacgaggtgctgtacccagatgcaaggaataagtctgcaggttatgaataatgaccagagtattttaggctttttgtagtgactgaggtaagtagccatgtacagcatgatgtgattagttttaatgattccttaggcaaaaatacggaattgagggagtgattgttttgggacaaagagaggtagagattttgccagaaatatgtggagctccttccgttaccagcattcctttaccagaaggtaattactgtcttgaagttggtattcttctatcgttgtttatattaatatatgaggattacatagtttacatctgtaatcaatactttgcatttttgtgtgtcttaaaatataaaaataacatcttcttcttttgcaatgttgttgttgttgtttttgagttgtcgcccaggctgaagtgcagtggcgcgatcttggctcactgcagcctccgcctcccgggtttgagcgattctcctgcctcagcctctggagtagctgggactgtgggcacgtgccaccatgcctgtctaatttttgtatttttagtagagacagggtttcatcatgttggccaggatggtctcaatttcctgacctctttatctgcccgccttggcctcccaaagtactgggattataggcctgagccaccacacccagcctgcagtgtttataattaatacatttttaagatttactggcttgttacatgtacttctactttatttactttcactactatatggaattccaatatgtgaatatacagtaattctatttatccattctcccattggtagatataagttgttcccacattttacctattacaaatgatactgcacataatgtttatgtacacagtgagactttttctggagtagatacctacaagtggaatttctagataatgcttgtttgttcgttttttttttttttttgagacggagtcttgctctgtcgcccaggctggagtgcaatggcatgatctcggctcactgcaacctttgcctcccaggttcacgccattctcctgcctcagcctcctgagtagctgggactacaggcacccgccaccacacctggataattttttgtatttttagtagagacggggtttcactgtgttagccaggatggtctcgatctgctgaccttgtgatccgcccgtctcagcctcccaaagtgctgggattgcaggcgtaagctaccgcgcccggcctaagcatattttcatgtacttatttgccatctgtatatctgctttgatgaagtgtctgttaaaatttgttaccacttaaaaaaatcaggttgtcggctgggcccggtggctcacgcctgtaatctcagcactttaggaggctgaggtgggcagatcatgaggtcaggagttttagaccagcctggtcaacatagtgaaaccctgtctctactaaaaatacaaaaaattagctgggtgtgctggcaggcacctgtaatcccagctacttgggaggctgaggtgggagaatcacttgaacccaggagggggagattgcagtgagctgagatcgtgccactgcactccagcccaggtaacagtgcaagactccgtgtcaaaaaaaaaaaaatcaggttgtcatcttactgagttataagtttctttatgtattctggatagaagtcctttatcagacagatgttttgtaaatatttcctcccagtctgtggcttgccttttcatttactggactattattttttttttaagtgtagttttacatgcggtaaaattcatcctttttagggtatcattctatgagctttgacaaacacatatagtggtgttatcaccaccacaattgaggtttagaacatttccatctcctcaaaaagttcccccgtgtctctttatcatctgtttctccttgcctccctcagcccctggcaatctatctcctttctgtccttataaatttgccttttccaggaagtcatatgaatgatatcatactgtatgaagccttttttgagtttcttttcagttacttagcataatgcatgtgagattcatccatattattgtttgtatcagtagtttatttttattttgtcgtcgtattccattgaatggatgtacctctgtttatctgtttgccagttgaaggatatttggcttgttaccagtttttggtgattataaacaacattgctataaacattcatgttttgatttttggatgaacatacatttttatttcttttggataaatgcctgggagtgggattgctgggccatatgtaggtatggtatgtttaactttgtaagaaactaccaacccatttttctaaaatatttgtaatcattcccgccatcactgtatgagagcagcagtttgctctgcattctggccagcactttgtattgtcgtttttatttttgtttttaattttagctattctgataggtgtataatggtatccctttgtgacttaaatttgcatttttccaatgactgatgatctcaaacatcttttcatttgtatttttaccttccgtatatcttctgttggtgaaggatttgttaatatcttttgcccattaaaaaaattggattgtttattttcttattattgagttttaagaggtctttatgcattctggatacaaatcctttatcagatatgtttcacaattattgtctctcagtatatggcttatgtttttattttgttaaagtctttcaaagggcagaagttttaaattttgatgaagtccagtttatcaaatttttttctgttacaggtgatgctttttatgtcatatcatagaaatctttccttaaccgaaggggacaacgattttctcctgtgctttttttctgggtgtttgtagttttatatcaattaccttatgatccatttcatattgatttttgtatatggtataaagtaatggttggtttcttttcacctcttttctcttcctccatccactgcctcttccttttcttccttcttcattttctcaacacatggttctggaacaattgaatatccatatggaaggagaaaggggaggagggggaggagatgatgaagatgattgagttacattggcacgttggcacattattttgtctcattgacctatatgtctgttcttactttagctctatgctgtcttgattaactataggtttaaaatctatagtaagttttatagtgcaaatctttctatttttcaaaattgttttggttcttttgggccctttgcatttccatatggattttaaatatctatattatatatagataatatagaaatatgtagatatctagaaatagacaaggttatattatatataatataatctttttatatagatataaaaatgctgctggaactttggtggggcttgcattaaatctaaagagcaattttaggagaatggacattatagcactattgagttttctgcttcacaaacatggtatatatccctttattcaagtctctctaacttctgtctgcagtattttatagttttcagtgtacaagtcttgcacatattttgtgaaatttacccctaaagtagatagtatgttttgatgcttttgtatttgtattgtttattggtagtctctagaattaaatgaacttttatatattgacctttttcttgtgatctccttaaatgtttgttagagttcactattgcagctgtcttcttagtgggaaggcttttcggggttaattaacttcatttaaaaaatgtatatatgatgccattcaggttatttgtcttcttgagtgtactctggtagtttgtatctttcaaggaatttcagttaaattgttgaacttggcataaagctcttcataatattcctccattcttttaatgtctgcagaatccttagtggtgtctcttccttcattctgatattggtaaattgtattttctctcttttatttctaggaagcttgtctagggatttataaactttattgatcttgtcatagaaccagctttctgtttcattgatttttttaaaaattaattatttttctcttccaaactaattgtgcgaaaagaaaaaaaaaagctaaaaaatcaaaccaaaagaaggggaaaaaaagaggaagagaaacatagatcaaataggacaaacataaatcttataatgacctggtagatatagacccaaatatatcattatccacattaaatgtaaatgaagagcacaaagatcatttacaaaaagttgattgtatattgagccataaagcaagacacaacacatttcaaaggattgaaatcatatagactgtgttctttatttacaatgggatagtgttggaaattaataaaaaaagaataactagataaattgccatttattttgatagtaagaacatttttctgttttgtttacagccatgataaagtaaatggactggatttaccctgctactataaatacctagaaaatcaaacaaaatttatgacataacagttttcagatattggataataggcatcccaggactgtgatctgaagaagggaaactaggtcagccctaggattgtactagatcatggcccagaaacagattacaggcctagttctctctcagagttgagaaaacgaatggaggttgggagccaggaaagctcgaatttatgaagcagaataccaaagaagaaggagctggagagaaaaaagaggggcggggagagaaggaaggaggagagggagggattccatgatctgttgaggactatccctggagtctttggttaagtaaaaactgatctgtgtgtgtaaaaaaggaaactactcaaagctaaggaaagaatccgaaaaacacagaactcagaatagtttgtattcccaccagtgagagtggaaagaccttctattgcataagacatctggtatagttctcaaaaggaaaccattcataagtaattattacctaagtaatgggaatatactataaccttacactaaaactttaaaaagcctgtaagtaagcctcaaagtgaaaaaaaaacaaacaaactagtcctggttaaccttccctcacgacagaatagagttcaatactatttaagatcatacaccaaaataaacttcacaatgtgcagcatctaataaattatcagatatgcaaataaacaggaaatattatctataaacaggagaaaaatggatcagcagacacaaacccagaaatggtaaaggtgatggaatgagcagatgatgtcattaaaacaactattaacatgatctatatgcttaagttgtaaagaaaggcataacaagaataaagcataaaataggagagatacaaagagatccaaatacacttcccaaaaattaaaaaaaaagaaaagaaatatataaaatgaaaactacactgcatggggttaatagcaaattagagatgtaggacaaacaaacaaacaaacaaaaaaacccagggtcattgaagacagcagtagaagtccaaaataaagcagagaggaaaaaaagacagagtagaaataaacagagcatcagcaacctgtggggtaatactttggaagtttttttattgtttatattcaaaattgcaatgggtttttgacttatcaaaatcaaatactcatctttgtgttttccctactcatgggaaattcgagagtcttaggatactctgattccttatacgtatatgagtatatcaacatatgtgtatatatacatacacacgtgcacatttacattaatatattctatgccatcattttcttgtgagtcttgtttgctcattgtgacttactcctgtctttagcactttttaaaaactcttcattccttgctctatttctgagttactctggaatgattttccttgtgcttgaagaatataccttttagaacctcattttggtagatgttagatactatattccatgccagtaagatccttctgtggctgtgaatgtttggttgtcttcatttctagcatctgtgaatttctctttattttgtccttggctacacatttaaaatttttgttctgattttattcagcatttctgtgtatttgtttatgcagtatgttttagtggttaagagcacatttttggccaacattttgtgttgtttgtcttttgaattttcaccattttggtgggtgtgaggtagtttctgaaacgtggttttaatttttcattggataagtaattttcatttccctgatgactaataatgttgagcccccattttttgtgttttaatgaaatttttttcgtatctctagttttcttctgcttctcacagaactttttttttctttaaattggggtggggtgttcctgaaattttgattcttattttttgttttcttctcatagtagctttgatctgccccatgtgtgtgcctatactggctttctgtgtgtgttttttttctgtttttaatcaccacgaggatcctcactctcttttctttccttaatgggttcagtagtatcaaggttttctccatagcttggactctggagctgcgtctgatgtatttgggtttctctacttaaaagaaatttgaggttactcagtaagggatgaggctggacagactagaggaacctggtgtctggctgctgcccatttatccatagtgtatgaataaatcagagatccagttgagtcggggagagtaggtggagcattgttagcttagtacttacttggatccaggtattcatctagaaatctcatttagggttcaggaggaaacattggtatacactgaactgaggaaagtgcagagtttgcacattttccaggaatgagcctttaattaatactgtacgccgtctctactaaaaatacaaaaattagccaggtgtggtggtgagtgcctgtaattccagctacccaggaggctgcggcaggagaattgcttgaaccccggaggcggaggttgtggtgagccacgattgcgccattgcactccagcctaggcaacagagcgtaactctgtctcaaaaaaacaaaacaagacaaaacaaaaaacctttgtctttggactcaagctatcatagtctaagtttgtatctctcagtagaaagatccatataattgaatttttaagtttttacctattgtgtcaatgcatcagttgtgtttaggaaatattagtattctgaatagtttctcacccagatattaatttttttttttggtagatgagactcttttaaagaatatctttctaaaatatatatctacttggggtcctcacttcaaataatttaaaaaaccatttcctaatcaataatctgttaccttttataaatgatttttcagcaaacattgaggagaatgtgctaccttaccatcaaagaaatggctaccatctctgaggatgtgataattgtcacaagcaggtatgtaaatggtcaaaatctaggatgagatacttatatatttgctgtttgctttctgttgatttcattttttgaccataagaaagccaataggaatttaaaagaatataatatcttaaagcattcttttctaaaatgaagttttcatcatgtgaaagccatccttatctgataaagcaaaggaagaagttacaaaagataatactgatagatttgagtgcatcaaaattttcataaaaatggataaaactaaaaagtaaaagataacgtgcactgaaataaaatatttacaacaaatacatcaaaggctagcatctgtaatatataaagaacttttaaaaagaaacaagtgataattcatcaaataaccaatataaaggatctaaacgtctttagatagtcgttctcactagtaaccaaaaaacataaattaaaaattcaagaatgaggtataatattttttactcatcaaaatggcaaaaaagcaaacaggcagcattcagtacttgtgtaagggagacatactcttgtacaaaggagacagagtaataaattgattcaatttttctagaaagtaatttagcaacatttattgaataattgaaaggctttatccctttgacctagtaaggccacatctgtggaactatccttggaaaataatcagacataacacagaaaaacttatatatattgatgtttgttgcaacaccatttacagtagaaaaaaggacaaacaacttacgtgtctaccattgataaaattatttaattaaccatatcatcatattataaaatattttaaaatttggagatatttttgaaacatctgatataaataagtcttcataaagtgctaaatgggggttggagtcaatctacgtattccatatagtctcactttaaagaacattttatgtgccagacatggtggctcatgcctgtaatcccagcactttgggaggccgacgcaggtggatcatctgaggtcaggacaagaccaacctggccaacatggtgaaactccttctctactaaaaatacaaaaaaattggccgggcgcggtggctcacacctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggggacagagcgagactccgtctcaaaaaaaaaaaaaaaaaaaaaaaaaaaaaaatacaaaaaaattagccaggcattggtagcacgctcctgtaattccagctacttgggaggctgaggcgggagaatcgctggagcctgggaggtggagattgcggtgagccgagatcgtgccactgcactccagcctgggtgacagagcgagactcagtctcagaaaaaaaaaacattttatgtatatatataaaaaatgtggatagaagttatacagacttatctctggatagttgggattgtggctgatatttattttcttttaaactttttataatttgcaaatgtcctagaataagtatatataatttatagttctaagtgtgtaatgaacattatttttaaaatagttgcctttttaattactataactcattgaagtgaatctggttttgtataacataataaattgtagaggagggtgcttgtgtttaaccagtagtagtatggaatgtagtttcaattaggaaagctttcagctgaaaataacagaaaagcagatgtaaacagtgacataaacaagatgggagtttattttttctcatataatcgtaagtctagaggcttggagtagctggtgttggctcagtcattcagcagtgtcagggtagtgtctcttgaattctttggacattctccattgttgcaaaatagatgcccaaattactggcaatgtaccatattcaaggctagaggggtcctgggaaggaagccagggaaggccacaccatctgcctctttcatcaggaatctaatatcttttcccaaggcaatttttagatttcacttggcacaactgtgttatatgactatccttaggaagccaggaaagtgagtatttagtattttatagcccaagtattagggacagaaaagggagaaggggttgaaaatggatgtcggattagttaactaatggtgtctaccacaagtaaaaaaacaaacaaatgaacaaaaaaacccagaaaaccttcagttagattgctagattcactaatattttgaaaattttaaaataaattagttgttgactgagagttttttgtttgtttcttttagcgctgtcaatacttgcctctgagttttgctaggctaccttgaattatggtgtatttctattaatagttcattttaagtgattagtagttgtggtaggcaggataatagtgacccaaagatgtccacgtcccaattcctaggacctgtgaatatgtacattacatggcaaaagggaattaagattgcaaaacagcagatagggagattattttggatcattcaggtgggccctttaaggactacacttcttaaaaatggaagtgggatgcagaagaggcgtcagtaagagatgtgatgatggaaacaaggtcagagatgcagtgttgctggatttggagatgggggaagagggccatgagtcaaggaatgtggtaacctctagagactggaaaaagcaaggattcacccttctagcctccggaaaggactgtagccctaccgatatcttgattttagcccagtgagacaagtgttggacttctaacttttataactgtaagataaagaaatgaatgttgtattttcctctaagtttgtggtactttgttacagcagcaatagaagactaatgcagattttggtacctggaagtggggtgctgccgtaacaaatacctaaaaatgtggaagtagctttggaattatgcagtgagcacatctggaagaattttgaggtgcaagatagaaaacgcctagattgccatgacaatagaaatatggatgttaatgactctattagacttagaaaaaagtgagcagcaggatagagaaaacatttatcatcttagagaatacctaaatcattgtgaacagatggtggaaatgcattaaaggtgctggctcagaggaaaatgttgggaattagaggaaaagggatccctgttatagtggcagaaagctcatcaggcttgtatactgcaattacatggaaaggaggacttacaaacagtgaacttggatgtttaactgaagagatttccaagcaaagtgttgaagttatggcctagttatggcctagtttctttttgccactaatagtaaaattgaaagtagagaaataagtcaagaagagacctgttaaacaaaaaggaaccagggcttgatgattttggaaattcttagtctacccaagtggctaagggtgctaaagtcaggagtttcacggtcaggaaaacgtgctctaaagaaaaagccaaaggagtcactgcacaaccttttgctgaaacctcagaaagatgaaaaggtcagagcattcactcacacaaaacactgaagagatcaaggggtgtgactcatagattcccttagcatctaagtagaagccagaaatagagatgggattatctaggcaagatctgtggaggagcctcttgtctaatggagtgagtctctgtacttatacagtagacccacaaggtttttgagaattctacgtcagcagcaactcagagctagagagagaggatgaagtgaaagactcaaagaggaggcaaaattcctcttcatctgtggacctatggaattagaaaagaaatgagaggatgaagtgaaagaaggctatcagagccccaaattctataggcaggaaacaagccgatgaaactactcagctttaaatacacgctggttaccctttatgaaaaaggaaggaagactctgagggcaaaagggcagtcctgtagggtggaactgagaactttacagaattctgcccgtgcagagacctattccaggttgcctaactggatttcagaattgcttgggaccaatgatgtcttccctttcactttctttcattttgaatgggaatatctgtaactatatcctacggcagtcccgtccttgtattttgggagcaggggatttcttttctaattccgtaggtccgaagatggagaggaattttgcctcaggatggattataccaagagtctcacccacaccaaatttagattttgataataagattgagatttttgagtccatgagatttagatgagattttggactttgaattgatgctgcagtgtgttgagactttggggggatcttggaagggggtgaatgaatgtattttgcttgtgaaatggacatagccctaatgacacagtgattttagcccagtgagacttatgttggacttctaatctacagaactgaaaataataaattcatgttgttttaagccactaattgtggtaatttgttacagcaggaatagaaaactaatattatagatgacctttctgtatgcatagaaaatttgttggcttggcaagaaaccatggagattaaaaaaatctgaaggcacatacttcacaaaagaatatatgcaaatggccaataagcacaatgttcttaacattattagtcatcagggaaatgcaaattaaaatcttagtgagataggctgggcacggtggctcacgcgtgtaatcccagcactttgggaggccgaggtgggtggatcatgaggtcaggagatcgagaccgtcctggctaacacggtgaaaccctgtctctactaaaaatacaaaaaattagctgggcgtggtggcaggcatctgtagtcccagctactcaggaggctgaggcaggagaattgcttgaacccgggaggcggaggttgtggtgagccgagatcatgccactgcactccagcctgggcgaccgagtgagacttcgtctcgaaaaaaaaaaaaaaaaatcttaatgaggtacagcatacccactagaatggttacaacaaaaaagcttgacaataccaaaataaaaaagcctattccaatatcgaacatttggaacaattgaaactcccatacactgtagataggaatgtagaatgatacaaccaccgtagaaaagttttggcagtttcttataaagttaattatatacctgccctgtgaccagtaataccccttctaggtatttactcaaggaaaatgaatacatatatggccacaaaaaagactgtacaagaatgtcataacagccttatgagggttcttcaaaaagtttgtgggaaatgtgtgttatgaaaaaatatccatggagtttgtattagtccattttcatactgctataaagatactacctgaggccaggcacagtgcctcacacctgtaatcccagcactatgggtggctgaggtggggcggatcactttaggtcaggagtttgagaccagcctggccaacatggggaaaccccatataaaaatacaaaaattagcttgatgtggtggcacacgcctgtagtctcagctactcaggaagctgtgacaggagagtcgcttgaacctgggaggcagagattgcagtgagccaggatctcaccactgcactccagcctgggtgacagagcgagattccatcttaaaaataaataaataaataaatatatatatacacatatatatatatacatatatatatatacacatatatatgcatatatatatatacgtatatatatatacacacacaaacacacactatccgagactgggtaatttataaaggaaaggggtgtaattgactcacagttccgcgtggctgggggaggcctcaggaaacttacaatcatggcagaaggggaagcaggcacatcttacatggtggcaagagagagaaaagagtgaaagcacagcaaaaactgccatttataaaactatcagatctcatgagaactcactatcacaaaaacagcatgggagaaactgcccccatgatccaatcacctacctccctcaacacgtggggattgcaattcgagatgagatttcggtggagatgacagagccaaaccatatcagaattcaaaatttttttgcactaaaatataaactcatgactaacttgttaataacatgtccgaacagtaactagcttgagacactaatacatccgtttgaaaataatccatttcagagcaacatcaattctgctaaaattgaaacaagaacaaacattacatttatggtgaactttgggtagaagaatggtgaaattatcgatgtgttacaaaaaagcatggcaatagtgacccaaagaaatcagcagtttacaaatggataagttgtattaagaagggatgagacaatgttaaccatgaagcccttcgtcttcagcagcagaccatctacatcaatttgtaaaactgatgattaacagcagcaatagccaatgtatggacacctcatttggttcagccttacccaattctgactgataaaattaaagttgagcaaactatttaatggatgtcaaaactattgcatctagattggctgcaggcaagagcagagctttaagtggaagttttaaacaagtgagatcaagatcctgagacatttccttgaggaattataacgggagaagaaatgtggctagcagtccaatcctgaagacaaagtatgatcaaagcaatagctaccaagaggtggaagtggaagtggtccagtcaaagcaaaagtggacctgtcaaaaacagggcaacagtttttggagatgcttgagggattttgcttgttcactttctggagggccaagtaatgataatagcttattatgagagtatttagagaaagttggccaaagctttagtagaaaaacacttgggaaagcttcaccagagagtccttctccaccgtgacagtgtgtctgttcatttgtctcatcaaacaagggcaattttgcaagagtgtccgtaggcatccaccttagagttcttatctggcttctttcttttgcttcctaatcttgaaaaaaatctctaaagagcacccatgtttcttcagttaataatggaaaaatgggtgagcgtgggggatgtggctgggtgggtgccggggcttcacctccaaggcagtggccggatcatgattgaggtgattgagcccctggagcctctagtgcctgtggattttggcagtctcgaggcagtggtccggttggagaaagacatcatcttcgcccatgggctccaccccatggacaccgacgggtggagcccatggagtcggtcctggagggcagatgtctatacctgagatctaacaatgtagtagaaggcaactgtgctgaagaattactacaaaactcccattgcgtcgtgaaggagtattttgtggccccccaggtaatatctctttgccaaagctggatgaacaagagcctttctcacacagccgagtagctcattctggaaagggggtactctctgaatacgtggaagcatgaggaccatattttcttactgtgaacactaattttcctgctttttccagtcacctgaaaaaatggatgcttaagcatttcttttctttttttttttttttttgtttttgggatgaagtctcgctcttgtcccccaggctggagtgcaatggtgtgatctcatctcgctgcaatctctgcctcctgggttcaagcgattctcctgcctcagcctcctgagtagctgggattacaggcacctgccaccacacccggctaatttttgtatttttagtagagaaggggtttcaccatattggccaggttggtctcgaacttgtgacctcaggtgatctgcctgcctcggcctcccaaaatgctgggattacaggcgtgagccactgcgcccggccagcatttcttaatagcagactcttctgaagacagaattgggaaatatctggcaccaacaaggcaatgagttcctgatgctaactgaagtaaaaggaaagcaaaagtcagcttccaaggaaatagcttccaaggtattcacttaacaggcctgttcagtatggaagacactatttatccccctttaactctcgccaaaggactataccaactgcatgaaagtgaacttttacatctacttaaatggtagatggagcaccttgatcactatgtgacaaccttggttgtcatttttagttgctatttgaattgatttgagcagccctatcttcaccggacatacctgaatttgttcctaggtacccactttgttcctagaaaagggctaactttctactatggtctgaagagtgttcaaagtagactagagcttgggaactcctaacctagaaccatctgccatcccacaaagtgattagatgcaaaagggatactagtcatacctagtgtttctctttctgaaaagagaacttatcctaaaagtagccatgggcctgggacaaagtagccctttccacccccaaaatgattattagattgacgtgagtccaagattgtggagttttttgttttttgttttaaaacagataccaagaataaatgaaacctatttagggattcattctctaattaatagattctaagtaatagaatcggagagagactttttcctctaaccaaactgccaaagttgtttttggctaagaatttcccaatgatctttgcactgctgctcatttcttttatttttctgagatagggtctctctctgtcacccaggctggagtgcagtggtgtgatcacagatcactgcaacctccaacttctgggctcaagttatcctcccacctcagcctcctgagtagccaggactacaggtgtgtatcaccgcctccagttaatttgtgtgtgtgttttttttaaatagagatggggtcttgttatgttgcctatctggtcttgaactcctggcctcagaggatcctctgacatgccttggcctcccaaagtgctgggatcacaggcgtaaaccacgatgcgtagcttgttactcattcttaaaagtctgtgtttatttttcccattcccttcttttatctgcagtccttcttttttctttaaggcagcttaatttacaagcttggccttgagttaaaagagaaccccgaacgttgaagttgaagttctcaaaccaacatcagagcaactatcttaatccccatataaacaaagttatctactcctggctccttaaaaaaataataataatgtaaaaatgactgcattgacatgcttacattcccagcaacttcaattgtttagggatggactaaatgactggtatcatcactttaaaatgtgtcttgaacttgatggagctatgtcgataaataaaatttatagtttttgtgggtttttttttttttgagacacagtctcgctctgtcgcccaggctggagtgcagtggcgcgatcttggctcagtgcaagctccgcctcccgggttcatgccatcctactgcctcagcctcccgagtagctgggactacaggtgcccgccaccacgcctggctaatatttgtatttttagtagagacggggtttcaccatgttagccaggatggtctcgatctcctgacctcatgatccgcccgcctcggcctcccaaagtgctgggagccaccgcgcccggcctatagtttttgtttttgttttgagacggagtcttgttctgtcacacaggctggagtggaatggtgtgcccttggctcactgcagcctccgcctcccaggcttaagccttccaagtagctgggattacagctgtgtgccaccacgcccagctaatttttgtatttttagtagagatgtggtttcaccatgttggccgggctggtctcaaactcctgacctcaagtgatctgcccgtcttggcctcccaaagtgctgggcttacaggcgtgagctactgtgctcagccgttaggtttattttttaattccatttttccacagattttttgaagtcccctcgtatttgtgatagccctaaactggaaacatcccaaatgctcatcaaagaagaaggaacaaattgtggtatattcatgcaatagactattactcagcaataaaaggaaaaaattgctgattcaggcaacaacatggataaacttctaaaacatttatgttggaaagaaaacagacacaaaagaatatatgctggatgattctcttcgtataaactccaagaacagcccccaaactcatctgtggtgatagaagtcagaagtctactgggttagaggaaattgattggaaatgggcatgagggaactttctggggtgatggaaatgttcagtatttttattttggatggaggttacatagatgatcacaattgccaaaactgatttagcataatatttcagttgtccattttattgtataaattacagctcggtgaaaaaaaaaaagagatgtagttagtgtcttaactaactaaatgtatattgacaacctgattttactgttctactcattacaagaaggcatacccttatgtgatggcacccacccagtgaaagtctggaattgagtcctgagagaattgaggaattgagaattgagagaattgaggaattgagaattgagagaattgagaattctggaattgagtcctgaggaatgatccatcactcacattaggaagtactctggggagtgggcatcagtatgtgagaagttacgtcccggtttcagaaaatcaaatgaaaaattcaaagaccatggtttaggaagaaataaatgggttgtagaaactgttatcagctaggcagttttgaaatcaattgtgccgataatgtgtggattcgggtagggggagaaagatactttgtgcttcctaaggaaactaaatgctaagttcatccacttagtaagaaatatacaagcccgaaacaacttttctatttgaatggtgcagctgttcctgaataattacttctgaagatttactgccaggaaatggtttagaacaagaaaatgagatactattatgacttaaccaccactgtagtgaaactcctctcaaagatttccagtaacttcttacttagttaattttaaaagttaattttctgtccacattttacctgacctctttcccagttttaacatggttaaatacttcctggagttgtaccatctttggctttcagaaaccatagtcctggatttcctctcctctttgatttctccattttatcctatgatagctcagaagtggctggttttcttctgcctgtcatctaaatattggtattccctagggttcatatcagtgctgtagttctttcccaaactcatcatgctctttgataccctttatatttgtacatgcttctccctgtgcctggaattattctgttgccttttccacatagctcaaatacatgtcattataggtactgacttccttcttcttctttcttgacagattagtcattgtcttctctgttgttctcttttttttttttttttttttgagaggtagggtcttgctatgttgattaggttggtcttgaactcctgacctcaagcagtcctctcatctcagcctcccaaagtgctggaattacaggtgagagccactacccctagcctcggttgttctaacacttgatttttttttttaacctctgttctagtattttaatatattgtactataattatttgcatagtttttctgccttctgaattattaattctttgagagaaagaaacacatataactttgtatcatcaatacctggaaaagtgctttgtattattagacatgcaataaaagtgttgcatgagttaaaagataatccattttctctcttcaagcaagggagttggaatcagaaggattatttatttccctctctacctcaggaaagcactcacacaggcagaagtggagaaaggtgtgttaatgtgtgttgagaaacctttctgtctcctacttcccttctctttttcctgcccagtttgcaagccaactttcctgatttatttggattaacacttattttattttaaaatgaaattggggcagacttttcaggaaagatgatgaagtgatgccacgtctcaaaacttccttctctaaagcctagtgaaatgaacaacagtgaataaaagggaaagccaggagacttctaattctagccaagatgaaataaagctactggagcccatctttcccagtgattacaaataataaataataataataataataaataacaaccctggacaaaaaaacaaaaacaattacctgaagcctccaaatagtaaatatagtaggtgaattagggagagaaaacaatacttaatgaatgaccaatatagcaacagtgagtttcatggttaattttcatctttataccttgagtttgacccaagggcagactgaatcagggaactatatagtaggtgtggtcaatagagactgagaaagaagcccatctctctggcctgagcacagtttacaaaaaaaaaaaaaaaaaaaaaaaggttggtggtgactgcaagctggagagctgggggagaatccttgtttgtttgtttgtttgtgtttttcttgttttctttcccgtcctgaggtcagccctagttgtggaacaactttactaggatacgacagcaatgttgtgagcacttaaaaccctcggaagaaacctaccactgagaaaagggacggctgttgggtgaagagtgggggaaaagccacatcattattttttctttctatcttttcttacctcttcatcatgaaggtgggcccacttgcatagtacagggagctgaaactcttgagagaaccccatatttctggctgacgacctgggaaaggtgtctttgactgccagatggtatgggaaaaaagatatgaggaaagacatggaggaatggataatttaccaaagcactacatgtatggactattcctaaagaagcatagcaaaagctttgaagtataaactgacattggaatcaatatgcacagaaggcgaggcagaacttgtaatctgaaactaactgggttgattccttgctaaaacaaaaaagtcagtagtccccagaggcttttaataggatccagagtctcatgacataatcaaaatatgcaggatacaatccaaaaccagtcaaccaggaaaggaaattgattccattgaaccaatgttaatctctacaagtgtgtcattttggggttggtatctgttgattggaaaaaacttggaaattttcaagggaaaagataatcaatagatacccccaaaatgacccagttgtagggattcttaaatactttaaagcagctactgcaaccatgtactataaaggcagacactcttgaaatcaatggaaagaggaattctcagcagtgagctatatatacaaaaccaaatgaaaattctagaaatgacagactataatatgtaaagtaaaaagattcattagctcagacgtggaggtgtggctggcaagatggccgaataggaacagctctggtctccagctcccagcgagatcaacgtggaaggcgggtgatttctgcatttccaaccgaggtacccggctcttctcactgggactggttagacagtgggtgcagcccctggagggcaagttgaagcaggatggggcattgcctcaccagggaagtgcaaggggttggggaactccctcccctagccaagggaagctataagggactgcaccttgaggaatggtgcacttcagcccagatactacgcttttcccatggtcttcaaacctgcagaccaggagattccctctggtgcctacgccaccagggccctgggtttcaaggacaaaactgggcggccgtttgggcagacaccgagctagctgcaggagttttttttttcatacctcagtggcgcctggaatgccagcgagacagaactgttcactcttctggaaagggggctgaagccagggagccaagtggtctagctcagtggatcccacccccacggagcccagcaagctaagatccactggcttgaaattcttgctgccagcacagcagtctgaagttgacctgggatacttgagcttggtgtggggggaggggtgtctgccattactgaggcttgagtaggtggttttccgctcacagtataaacaaaggtgcccagaagtttgaactgggcggaacccactgcagctcggcaaagcctctgtagccagaccgcctctctagattcctcctctctgggcagggcatctctgaaagaaaggcagcagccccagttaggggcttttggataaaactcccatctccctgggacagagcacctgggggaaggggcggctgtgggcacagtttcagtagacttgaacgttcctgcctgctggctctgaagaggacagcagatctcccagaacagtgctcaagctctcctaagggtcagactacctcctcaagtgggtccctgacccctgtgcctccttactgggagatacctcccagcaggggtcaacagacacctcatacaggagagctccagctggcatctggcaggagcccctctgggacaaagcttccagaggaaggaacaggcggcaatctttgctgttctgcggcctctgctggtgatacccaggcaaacagggtctggagtggacctccagcaaattccagcagacctgcagcagagggtcctgactgttagaaggaaaactaacaaacagaaaggaatagcatcaacatcaacaaaaaggacatccacacagaaaccccatctgaaggtcaccaacatcaaagaccaaagatagataaatccacgaggctgaggaaaaaccagtgcaaaaaggctgaaaattccaaaaaccagaatgcctcttctccaaaggatcacaactccttgccaacaagggaacaaaactggacagataatgagtttgacaaattggcagaagtaggcttcagagggtaggtaataacaaactcctcagagctaacggagcatgttctaacccaatgtaaggaagctaagaaccttgaaaaaaggttagaggagttgctaagtagaataaccagcttagaaagaaaataaataacctgatgtagctgaaaaacacagcatgagaacatcgtgaagcatacacaagtatcaatagccaaattgatcaagtggaagaaaggatatcggagattgaagataaatctaatgaaataaagtgtgaagacaagattagagaagaaagaatgaaaaggaatgaaaaaagcctccaagaaatatgggactatgtcaaaagaccaaacctacgtttgattggcgtacctgaaagtgatggggagaatggaaccaagttggaaaacactcttcaggatattatccagaagaacttccccaacctagcaagacaggccaacattcaaattcaggaaatacagagaatatcacaaagatactcctcgagaagagcaaccccacaacacataattgtcagattcaccaacgttgaaatgaaggaaaaaatgttaagggcagccagagagaaaggtcgggttactcacaaagggaagcccatcagactaacagtggatctctctgcagaaaccctacaagccagaagagagtgggggccaatattcaacattcttaaagaaaagaattttcagcccggaattttatatccagacaaactaaccttcataagtgaaggagaaataaaatcctttacagagaagcaaatcctgagagattatgtcaccaccaggcctgcctttcaagagctcctgaaaggagcactaaatatggaaaggaaaaacaagtgtcagccactgcaaaaacataccaaatggtaaagaccattgacactatgaagaaactgcatcaactaatgggcaaaatagccagctagcatcataatgaaaggatcaaattcacatataacaatatcaaccttaaatgtaaactggctaaatgccccagtggaaagacacagactggcaaattggataaggagtcaagatccattggtgtactgtattcaggagactgatctcacatgcagagacacacataggcttaaaataaagggatggaagaatatttaccaagcaaatgaaagcaaaaaaaaaaaaaaaaaaaaccggttgcaatcctagtctctgataaaacagactttaaaccaacaaagatcaaaagagacaaagaaaggcattacataatggtaaagggatcaatgcaacaagaagagctaactatcctaaatatatgaaatataaatgcacccaatgcaggagcacccagattcataaagcaagttcttagagacctacaaagagacctagactcccacacaataatagtgggagtcttttaacaccccactgtcagtattagacagatcaacgaaacagaaaattaacaaggatattcaggacttgaactcagctctggatcaagcggacctaatagaaatctacagaactctccaccccaaatcaacggaatatacattcttctccacaccacattggacatattctaaaattgtccacataattggaagtaaaacactcctcagcaaatgcaaaagaacagaaatcataagaaacagttgctcagaccatggtgcaatccaattagaattcaggattaagaaactcactcaaaccatacaactacatggaaactgaacaacctgcccctgaatgactactgggtaaataatgaaattaaggcagaaataaataagttctttgaaaccaatcagatcaaagatacaacgtaacataatctctgggacacagctaaagcagtgtttagagggaaatttatagcactaaatgcccacaggagaaagcaggaaagatctaaaatctacaccccaatatcacaattaaaagaactagagaagctagagcaaacaaattcaaaagctagcagaagacaagaaataactaagagcagagcagaactgaaggagatagagacacaaaaaatccttcaaaaaatcaatgaatccaggagctggttttttgaaaagattagcaaaatagatggactgctagccagactaataaagaagagagaagaatcaaatagacacaataaaaaatgataaaagatatcaccactgatcccacagaaatacaaactaccataacagaatactataaacacctctatgcaaataaactagaaaacctagaagaaatggataaattcctggacacacacaccctcccgagactaaatcaggaagaagttgaatccctgaatagaccaataacaagttctgaaattgtggcagtaattaatagcctaccaaccaaaaaaagcccaggaccagacaggttcacagccgaattctaccagaggtacaaaaagcagctggtactattccttctgaaactgctccaaacaatagaaaaagagggactcctccctaactcattttatgaggccagcatcatcctgataccaaaacctggcagagacacaacaaaaaaagaaaatttcaggccaataaccctgatgaacatcgatgcgaaaatcctcaataaaatacgggcaaaccgaatccagcagcacatcaaaaagcttatctagtatgatcaagttggcttcatccctgggatgcaaggctggttcagcatacacaaatcaacaaatgtaatccatcacataaacagagccaatgacaaaaaccacatgattatctcaatagatgcagaaaaggcctttgataaaattaaacaccccttcatgctaaaaattctcaaaaaactaggtgttgatggaacgtatctcaaaataataagagctatttatgacaaacccacagccaatatcatactgaatgggcaaaagctggcagcattccctttgaaaacaggcacaagacaaggatgccctctctcaccactcctattcaacatattattggaagttctggctagggctattaagcaagagaaagcaataaaggtattcagataggaggaagtcagattgtctctgtttgcagatgacatgattgtatatttggaaaaccccatcatctcagcccgaaatctccttaagctgataagcaacttcagcaaagtctcagggtacaaaatcagtgtgcaaaaatcacaggcattcctatatatcaataatagacaaacagccaaatcatgagtgaactcccattcacaattgctacaaagaataaaatacctaggaattcaacttataagggatgggaaggacctcttcaaggagaactacaaactacttctcaaggaaataagagaggacacaaacaaatggaaaaacattccatgctcatggataggaagaatcaatactgtgaaaatggccatactgcccaaagtaatgtgtagaatcagtgctatccccattaagctcccattggctttcttcacataattagaaaaaaactactttaaatttcatatggaaccaaaaaagatcccacatagccaagacaatcctaagcaaaaagaacaaagctggaggcatcacgctacctgacttcaaactatactacaaggatacagtaaccaaaacagcatgatactggtatcaaaacagatacatagaccaacggaaaagaacagaggcctcagaaataacaccacacatttacaaccatctgatctttgacaaacctgacaaaaacaagcaatggggaaaggattccctatttaataaatgatgttgggaaaactggctagctatatgcagaaaactcaaactggacccctttcttacaccttatacaaaaattaactcaaaatggattaaagacttaaatgtaagacctaaaaccataaaaaccctagaagaaaacctcggtaataccattcaggacataggcatgggcaaagacttcatgactaaaacaccaaaagcaatggcaacaaaagccaaaatagacaaatgggatctaattaaactaaagagcttctgcacaatgaaagaaactatcatcagagtgaacaggcaacctacagaatgggagaaaatttttgcagtctatccatctgacaaagggctgatatctagaatctaccaagaacttaaatttgcaagaaaaaaaccatcccatcaaaaagtgggtgaaggatatgaacagacacttctcaaaagaagagattatgaaataaagctcatcatcactggtcattagagaaatgcaaatcaaaaccacaatgagataccatctcatgccacttagagtggcgatcattaaaaagtcaggaaacaacagatgctggagaggatgtggagaaataggaatgcctttacactgttggtgggagtgtaaattagttcaaccattgtggaagacagtgtggcgattcctcaaggatctagaaccagaaatacctttagagccagtaatcgcattactgggtatatatccaaaggattataaatcattctgctataaagacacatgcacatgtatgtttattgcagcactgttcacaatagcaaacacttggaaccagcccaaatgcccgtcaatgatagattggataaagaaaatgtggcacatatacaccatgtaatactatgcagccataaaaaaggatgagttcatgtcctttgcagggacatggataaagctggaaaccatcattctcagcaaactaacacgggaacagaaaaccaaacactgcatgttctcactcataggtgggagttgaacagtgagaacacatggacacagggagaggaacatcacacaccggggcctgtctcggggtggggggctagaggagggatatcattaggagaagtacctaatgtagatgacaggttgatgggtgcagcaaaccaccatggcacatgtatacctgtgtaacaaacctgcatgttccgcacatgtatcccagaacttaaagtataataataataaaaaaaatcattggttcatctcagtagcagaatggagatgtcagaggaacaggttagtgaatttaaagataaaccagtagaaataaatcccaactgaaaagagagagagaaaaaagaaaacaaaaataaacagcctcactggcctgtgagactgtatcaaagggcctaacatttgtgacattgaagtccctgaagaagaggagaaaggtattggtgcgaaaaaaaaatttgagaaaataatgactgaaaacttacaaatttggagaaagataaatttacagactcaagaaactaagtgaaacttagacaaggtaaattcaaaggactctgctctcagtcacttaatgaaactgctgaacaccaaagatgaggaaaactgttgaaagcaccaagaggaacatgattcattacatatacacatcactgtgggtttctcatcagaaaatctggaagtctaaaaacagtggaacaccaactttaaagtgctgaaagaaaggaagtgatgactcagaataccatatccactgaaaatatcttccaggaatgaaggtgaaataaagacttcctcagatgtaggtaaactaaaaggtatttgtcaccagcagacctgctctacagtaaatattatagtaaatgaagttttttcaggctgaagggagatgacactagattgatcccaccaaaacaacatatggatagtacttaaagaaaacaacaacagctgaaaacaactgtcaatccagaattcgatttccagtgaaaataactttcaaaagtgaaggtgataaaaaggcaatttcagacttaaaaaccgctgaaagaatttatctctgacagagtcacattaattataaaagggatttttttcaccaggatgaaaatgataatgaagatatggatctatgcaaagaaatgaagaatactggaaatgttaaactgagtagataaacaagaaattttccttgtttacgtaattttaaaagttaattgactgcttaaagaaaagaatttagtatggagtttataacatatgtaaaataaaatctgtgacaaaaatagcatgaggcaaagaagagaaatggtactttattactataaagtttgtatcctctttatgaagtgttttagcacttgaagaaaatctaataggttaaagatttactgtataaagccaccactaaaataacaatgcagaattatagctaataagccaacaaaagagttaaatagaatcataacatatattccacccaaaagaaggttggggaggaaaagaaaagggaacaaaattcaggccaggtgcagtggctcacacctgtaatcccagcacactgggagaccgaggcaggtggatcgcctgaggtcaggagttggagaccagcctggccaacatggcgaaaccccatctctactaagaatacaaaaattagccaggtgtgatggcacgtgcctgtaatcccagttactcggagaatcatttgaacctgggaggcggaggttgcagtgagcccagatgatgccactgcactccagcctgggtgacagagcaagtctccatctcaaaaaaaaaaaaaaaaagaaaagaaaaagaaaagggaacaaaaaccagatgagatgaatggaaaagaaatagcaagatgacagactccaacccaaccatatcaataattacattaaaggcacctattctaaacacttcaattaaaagggaaagatggctagattggattttttttaagagatggggtcactcagtgcagtgacatgatcatagctcactgcatctttaaacccctgggctcaagcggtcctcccaagtagttggaactacaggcattagccactgtgcccagctcagattggatttcttaaaaaagccaaatccaactttatgctgcctataaaaacataccttaaatataaagaaacaaatagattagaagtaaaaagatgaagcaagatataccatgctaactgtaatcacaagaagctgtatgtcttcagataatgtagactccagaataaataatattactagggataaaggggtcagcttaccaagaggacaaagtaatattgtttatggagctaataacagagtttcacagtgcttgaaacaaaaattggtagaattgaaaggagaaatcaacagatccacaattaaagctggaaatttcagtactcatctctcaaaaacatagagcaagtatacagaaaaattattaaggaaaaacaatttgaacaagaaaactgagactctttgctgatgacattgtctatgtagaaaatttgtggaatccaacaaaagctacaggaagtaataagtgagcttagcaaatttgcagaatacaagatcaatatgcaaaaatcaattatgttgtatatacttgccaagagcagttgtaagttgcaattaatcctgtttacagtagcatcaaaatatgaaatactttggggtgaatctgatgaaagatgtataagatatatagactaaaaactacaaaacattggtgatagaaattaaataagacctaaataggggccgggtgcggtggctcaaacctgtaatcccagcactttgggaggccaaggcaggtggatcatgaagtcaagagatcgagaccatcctggccaacatggtgaaaccccatctctactaaaaatacaaaaattaggtatggtggcgcgtgtctgtaatcccagtacttgggaggctgaggcgagagaatcacttgaacccgggaggcagaggttgcagtgagccgagattgcgccattgcactacagcctgggcgacaagagcgaaactctgtctgaaaaaaaaaaaaggaaaggaaagaaagaaacaaaatgctagtaattaaaaacagtagcagagatgaagattgctttcagattcattcgtagacttaacacagccaaagaaagaataaatgtacctgaagataggtctataaaaatgcctaaactgacacacaagaagacttcctaaaaaagaatttcaagagctgagagaatatcaaacagactagcatatgtagaattccaggagaagggctaggcgtggtggcgcaaacttgtaatcccagcactttgggaggccgaggtgggtggatcacctgaggtcaggagtttgagaccagcctggccaacttggcaaaaccccctctctattaaagatacaaaaaattagccaggcatggtggcatgtgcctgtagtcccagctactcgggaggctgaggcaggagaattgcttgaacccgggaggcagaggttgcagtgagccgagatcacaccactgcattccagcctgtatgacagagtgaaactctgtctcaaaaaaaaaaaaatgataataataataaaattccagaaggagaaaggagagagaaagcatttgaggtaataatggccatttttttccccaaaattaattacagacaacaaaatgcatgtccagaaagctcaaagaacaccacatgggacacatacacatacctctaggcatatcagtgaaactgccaaaaagaaaatttaaatagaaaattttaaaggtaccccccccaaaaaaggacaaaacattatacaaatagaaacagattatagtagactgtttttttcagaaaacatgcaagctagaagacaatgttgtgtcaactgataattttatacccagtgagactatctttaaaaggtgatagaaaagtaaagacttactaatttatgagacagcatcttgctctgttgtccaggttggagtgcagtggcatgactcctgtgctcaagcagtcttcctatctcagcctcctgagtagctaggactacaggcgaacactactatgcctgactaattttttatttttgtttttgtagagagaggtctcattacgatgctcagactggtcttgaacttctggcatcaagtgatcctcctgcctcggcctcccaaagtgctgggattactgggatgagccactgtgcccagcctaaagactttcttacacaacaaaaactgataatttattggtagctgtcttactctgcaagaaatgttaaaggatattcttcagatagaaggaatatgataccaagcagaaacttggagctacacaaaaagaacactggaaacaagccagggcaaaatcacattcacttttttctttttgaaaaattattctggacaatagctgtatgtctaaaacaaaaaatagtagtgtaatgtgtttaaagcatatataaaaatatattagaacaattgcacaaagaatagaaggaaagtattgggaatatacccttgagaggttcttattctagccatgaagtgatactcttagttattaagtaaagatataaaccctggggcaacaactaaaaaaaatttaaagaagtataaacaataaactagtaaaggaagtaaaatggaataataaaaatagttggtaccaaagttattaaaggaaaaaagtgttcagttaacccaaactcaggcagaaagggggcgggggtagaggagatgggcagagaaacaaagaccagatggaacaaatataaaactagccagaccacagactgatttgaggaataataaaactgtagtctcctgcaaaacaacaacaaaaacaaaaacagaaaacaaactaacaagaccacagatttcaatccagtcataatcagtaattatattaataatggattgtctaaacacaccagttgaatgacatgtatggacttctcgttagttgaagacaatgaaggctgtatactaatcaatgactcaaaatctccctaaatgataagaaacaattttacaactacagttgttcttggtaaaactacatcctcagagttatttcagttcagagaatactgaaaagtatgaaaccactttgagtaaaaagaaaaactgccaaatgccagtatggtaattcctcatccctcccctgaaccgcaccccgccccccgaaccacaccccccaccccccgcatccccaaagtctttggggcaagcagtggccaaccactaaggttgtagatagatagaagagggaggttagcaaccaccaggcaggaacaacaactagaaagattaaagttgttgctgtgggtagtgactatctggggctggtgtcatgaagacggtaaaaagaattgcccaagatgggtgtaggtaaagaaagacggattctttaaaaaagtggaaacatgttgctagggtgcaatggcccagtcagcaagagtggagctgacttcagggagacaaaggcttgcctgggattttataggatggtgctcttgctgtgctgaagagggctttgtgcagtactgataacaccaaggttgcagttagctaacttgcatttttctattagctgatggtctagtgataagttgggcataggaagattgtgaattatttgtgcaggagggctatgtgtcctagaccatgaagaaaggccgacttacagcttatctgcgttctctttttgcttttccttggtcctgccagcctgacttcttttccctgattaggactccacagttgtaattcagaaaatactaaaaagttagtggggaagataagagcatttactataggaaacggatttcaaagtgtacttgatttaaagatttaagcacaatagaaaagcctgggcaacatggtgaaacctcatctctaccaaataaggaaaatacgtaaattacgtgggcatggtgggcatgcttgtggtcccagctactcaggaggctgagatgagagaattgcttgagcctgggaggtggaggtttgccatgagccagtatcgtgctactgcactccagccttggcaacagagcgaccctgtctcagaggctagacatacaatttaaagagaaatactcaacataaaagggcaaatgtaatttaaaaggaccaccacaacataaagggacagtgttccaaacatacacttctccaggagaaaaaaggcaaaaaggaaaaaagaagtgccttttggcaatcaggtgtcaatgggaaaaggaaggaaaggtggatatttagggtctttcaaggtctaagtgtaagagttaaagaaagaggaaagaaacatgaaaagcagctcaacagtcaaagataggtttattttggagaataaacatgagagggacttctggccgatttcgttcaggagcgctctctcttatagactaagagtattcattagccaggcatggtggctcacgcctgtaatcccagcactttgggaggccgagttgggtggatcatgaggtcaggtgttcgagaccagcctggctaacaaagtgaaatcctgtctctactaaaaaatagaaaaaaaaaaaaaaaaaaaattagcctggtgtggtggcaggcactcgggaggctgacatctctctggcccgaggggaagttgtctcggggctggcatgtctctggtcagggaggggtttattttatggttggaatgtttctggttggagatgtcatttgtgatttatggtcatgctgaatttgggggaaaaaaggcaaatcactacataactacatatcagaatctatagactatatagcactgcaagatgactgtagttaacagttatttattatgtattttcaaatagctcagagaggattttgaatgttcccagtaaaagaaatgataaatgtttgaggagatggatgtgctaattaccctgatgtgataactatgcattctatgtatcaaaacatcactgtgtaccccatcagtatatacaattattatgtgtcagttaaaaataaattattaaatctatatggtgaattaaaggagtgatcaaagaaaaactcattgcagtaaataccttttatcaatgaaaaggaaggaataaaaagtgaattaaattcttagctcaaaaaaactaggtaaagaacaacaaagtaattcaaaagaaagcatatgataggaattagtatagataaaaacagaaattaatgaggaaaaaatagaaaaacatatctaattattaaatcaaaatcctatttttgaaaaaattaacaatataaataaacccgtaagctaagttggtaaaaaaaaaaacggagaaagcataaatatgcaaaataaatgacaagggagaaacagaagaaatgtaaaaatcaaaagacaaatttgtagtctttgaaataaatttgaaacctagatttaatggataattttttaggcaaatacagcttgtcaaaaatgacccccttttttttttaatggggaaacactagaggcatttccactaagatcaggaaccacagcaaggatgttcattatcttcactgctattcaacattgtgctggaggtatttagcaatgcagttaggcaagagaaaccaagttgaaacataagaatgagttaacaaagaagtaaagctatctgtttttagatgatgtgattgaatacctaggaaccccagataatcagtaataaaatgaactcaataatttagtgggacagcaggatataaaattcatatataataatcaatagtcttcttatttctcaaaagaagatatacagacagccaacaaacatatgaaaaaatgcccaacatcactaatcatctaggaaaagcaaattaaaaccacaatgagataccactttatttctgccagaatggccgtaattaaaaagtcaaaaaacaatagatgttggcatagatgtgataaaaagggaacattattacactgctgatgggaatgtaaattagtacaaccactatggaaaacagtatagagattctttaaagagttaaaagtagaactgccattcgacccagcaatcccactactgggtatctactcgaaggaaaagaagtcattatatgaaaaagacacatgcacatgcatgtttataacagcacagttcacaattgcaaagacgtggaaccaacctaagtgcccatcagtcaacaagtagattaagaaaatgtagtatgtatatacaccatggaatacagccataaaaaggaacaaaagaatgtcttttgcagcaacttggatggaactggaggccattattctaagtcaagtaacttgaatggaaaaccaagtatcgtatgtttaacttacaggtgggagctaagctacaaggacacaaaggcaaaagaatgacataatggactttggggcttggaagaggggaaggttaggagggggtgagggataaaagactacatattgggtaccgtgtacactgcttgggtgatgggtgcactaaaatctcagaaatcaccactaaagaacttatctatgtaaccaaaaaccacctgtacccctaaaactattgaaataaaaaagtaaaaaaaatcaatagtcttcatagaaacagcacatagaggacataatagtagatagaaccccatttacaacaacaaccaaaaagattaaacactcaggaatacatttgacaataaatgtacaaaacttagaaaaaatattaagccccttactcttgtctgaatgtttgtgtccccccaagtatgtattttcaattcctaacctccaagttcatggtgttgggaagtgaggcctttgggggtgattagattatgaggatggagcccttgggattggaattagtgcccttatgaaaagactgcagagagctagctagtctcttctaccatgtgaagacacagctagaagagatgccatctgaaccaggaaacaggaccttgccagtcaccagatttgccagtatcttgatctgggacttcctagactccagaattatgaaaaataaatgtttattgtttataagaaacctagtctgtaatattttgttatagcagcccaaatagactaagatattcctgaaagactcaaagtatacttaaacaaatataaagataccttgttttttgaaaaaaaaaattgttttatttttcaatttttttccttgagacaaggtctcattatgttgcccaggctgtcctcaaactcctggctcaagcaatcctcccacctcagccttctgagtagctggggccgtagcatgcaccaccatgcccagagttattgcctgttttttaataggccaactcaatgttataaaaattttattcctccctaaactaatttataaattcaatggaatcccaatgaaaataccaacaggagttaggcaggttggtactaaagttcacgtggaaaatataatgtaagaatagctgggaagtcactgaaaaaggaaaaccatgagggattgggtagaggggagaggaagctagctctactagtcagtaaatctaaggcgtgtacaattaaaacagcatggtactggcacatgaacagactaacagaccgtggaataaaattgtgtggtgactctataatgtggtcaccttggtcagactgatctatgtttttcagatacaatctgatacaaatggaaagtacagaattagacccatggaatagactaagacagcatcccatctgtaccccaaatgtgaattagagaccctggttcctggggccagtgtttttcaggtgtgaaaagacagaagcatttaactcattggcccttgattcctgttggttgaggattatctttagcacagaaataccccacacttcaggattatatatttctgagtgacacgttggcaaccacaggcagctgacactcccatgtcagagaagtcagggccacaaactgagccagtttgcatatttggaatgatgatcactgttaggtcactttggattcttcattctagtgaaggtaaggaaagtgctaccgtactcatagaggtcattgaccttgattcctgtcaggagctaggatcatttctgtataatggtggcagaaaggactctgtctagaattcatggtattcccttgagtatattttggtgctttcttgcctctgacagtggtggtaggggtagagaacaatcagtggttcaatcagggtgcacccaacacagggcttacatcctttgggataaaggtttgagtcaactattggagaagtagccaaaaccaggtaaagtgctggccagtggggaaggaaatgtagaatgggtggttttaggaaggagatgatgaatatcaattatggccttggaattagttgtagcagcaaggattgaactatgttccactcaccttcctttatttagtcttttgtagaaatagtgattgctaccatcttgaagcctccatgatagattagacttaatggaggacatgaacaaatttgagggatggaaagggtagactgtattggacacctcttttgagccacttcacatggtctcaggccttatctgtgattccagctgtggcatcatgagcaagtcttttggggctcagctcactggcattgttactgccttacttcaggtatgcactgagtgttttttgcctactcagattcacttgcagctcacgtgtatactccccagaagtatgggggaattaatactctggggttaacgttcagccaggggctaacagttagtggttctgagatgtatttcataaggctcctcggaagattgctcattaaataaccagtggccagcatcagtgacccactcaaggaaaggtctttatattgtttttacctccttccctgttcatttccctgtcattcacttcaccgtctgaacaccttcctaaataaactacctttatgcaagcctttgctgtcaggacagccaaagctatgacagaggtatagaacatgggttgacaagctatggtacatggccaaaaccatgtaaataaagtttttttgttgtctttttttttttttttttttttttgagatggagtctcgctctgtctcccagggtggagtacagtggcatgatcttggctcactgcaacctccatctcctgggttccagtgactctcccacctcagcctcccgagtagctgggattataggtgtgggctgccacacccagctaattttttgtgtttttagtagagacggggtttcactatgttggccaggctggtcgcgaactcctgaccttgttattcacccgcttcggcctcccaaagtgctgggattacaggtgtgagccaccgcgtctggccagttttttatatttttagtagagacgaggtttcaccacgttggtcaggctggtcttgaacccctgacctcaagtgatccacccgccttggcctcccaaaatgctgggattacaggcgtgagcaccgtgcccagctgtaaataaagttttgttggaacacagccacactatttcttaatgtattgtgtataactgcctttgtgctgcagctacagaattgagtagttgtgaggagatcatataacctgtaaagtctaaaatatttacagaataaatgtgccattcctgtgcattgatttcccagtgctgctggaacaagttaccacaaacttagtaacttaaaaaatctggtggcttaaaacaacacaaattcttttacagttctggaggctagaagtctaaaatcagtttcaccggtttgatgtcagaagtataggcagagcaggttccttctgcaggctctagggcaaaatctgttttcttgccttttctagcttctggaggctacttgcattcctcgaatcctagctcccctttcccatcattccagtctcttgattcgttgtcacatatgcttcctgtgtcaaatctccctctgccttgctcttatggggacacttgtgattacatttaggactcacccaaataattcaatataatttccccatctcagtgtctttaacttaatcacatctgcaaagtaccttttgccatataaagtgcatttaaggatctagggagtaggactttgatgtctttgggggctgttgtttagcttaccacaggcttctgtctggtccctaaagatttacatccatcctacatgcaaaacacattcaccatattgtaaaaatcttccaaaatctaaacccattgcattaactcaggtctaaaatctcgttaaatattataactcaaaagtcccaaatctcataatctaatcatctaactccagtataggtgagtttctgggtatgattcatcccaagacagaattcctctttatctatggacctgtgaaactagcaaacaagttatgtgctgctaaaatactgtggtgggacaggcatagaataacaattatatacattcccattcagaaagggagacaatgagaggaaagaaaagagtcactagcaccagacaatttttaaatttaatcaggtaaacttttaggtttcaagggttgggaatagtccctgtggcacccagctccactctatgggccagagggttgtgtatgtattgtgtatggctgtttttatgttacagcaaccaaatcaagtggttatggggtagtcatatagcctgcaaagcctgaaatatttactagattgttccctgtcagaatgtatgcttgttgagggcaggagtctttgtgtcttttgcttgctaaagtatcctaagtgtctggaacagtgtctgacacttaacagacactcattgaaatgctgaactaaaagaaaaaaatttaagcaatttaatagagatgagagggcaaaacttttgacattgctgaagtagtaaccctatttatagataaaacattaaaaaagagaacttttaaaaacatagctacgtattaaaataaatctacatattaaaatagcatactgtattccaataaaaattgtaacagaatgactgacaccaacatgcatcttggttaacttgtactgtggagagaaacaagtaatttttaagacttctggcagaaaaagctagtcatttaaaagtgagaaaaactaagtccgacttcagccattcatggcagttttcagtgtcagaaaagaatggggacagtatctgcaaagttttaagaaacagaacatgtgatacaagaataatacagctaagcgaattgtcattcaagtacagggacaacaagcagacttccacactggaaagaattcagggaccataacacctgtgagcttttcttgaaaaataaaattaagcattgaagttatattaaatcaaaagagtgaattctgtaatagaggggctacaggaaatgaattaccagtgagcattgaatgtattcaattatagaagtagggttaaactactgtagaaattatgattaaagatagaatgtaaatgttataatccatgataatacaaaaagaataatactaacaaaaatttggagatacacgggagggcagatgagagaggagaaagcttacgtacattaatttttttgctttcatagcttaactcttttatctaaagttttatggcagcgacaaaaagaactagaatgtaaatctcccatatttcagagagaaaacacattcacttaggaaaacaaaagacactcttacatctgtattgtccaataagatagccattagatacatatggctattatagtgaacattaattgaacttttgtaaaattgaaaattcagttcattagtcacactagctatatttcaagtgctcattagacacatttagcttgtggctactatgctgaatgatggaacattttccatcattgaaaaaagttctgttggataacactgccttataggaaacaaagaaagtactaaaaatagagatgtaacacaaaacaaattcatagaattaacaccagacattgcctattaaaagaaatacagattagtttaaaaataaaatacagctaactatatgctacatattgtgatgtatataaaacaaggcaaagcaaaatttgaatataaaaggaggggtgaaagcatataaggcaaacactactgaaaggaagcttgggtgaaggtattaataattagaaaattgaattaaatgcaaaaagttttgaaggagacaagaatgaggtactttatccaaaatgaggaggaactgtcatgaattatttattaatgtaacaccaaagtacataagccaaaaatcacaaaaaatgtaaatagaaacaaaatagtatcagcctttgttttaaaaagaaggaaaaacctaagggtaaaaaagatatgaataatatacttgatacagattgattaatacttatgaaaaccttacctttataatagaaaagtcacctttataagtattcatggaacacttacaaattattcagcattcagcccctgaaaacctgttaattctagaatgtggaaatatagtagagacttattctgtcattacaatgcaatcaaatgatacatttattttgagaagaaaatgaacagatagtacccagatatgtcaaaatggaaaaataaaaagaaaacctcaacttttgggacagtatataagtaaaaattgaaattacagaatatttttaaaatctaatgatgaaaacctatgagttcaactaaagctatggtcagaggaaaattcatagtccttggcacttaaattactgaacgagtgtattgttcagggctccccattgctggcagtagaatctagttcatagatcctcttggaaatccggaaaaccaagcttgcatctgacagagccagaaagagtgcatcagggaaaaatgcccacgctacaaaattttttggtgcaggacacttccaaaaaaagtcttttttttttttttttttttttttttgagacagggtctcactctgtcacccaggttggagtacagtggtgccatctcagctcactgcaacctctgcctcctgggttcaagcagtcctcccacctcaacctcccaagtagctgagactacaggcacaccccacaacaccagtctaatttttgtattatctgtagagatggggtttagtcatgtttcccaggctggtcttgcactcctgagctcaagtaatcctcccaccttgacctcccaaagtgctgggattacagacatgagccaccacacctggccaaattgctttcctaattgaaaaagaaatgaaggactatcagtcaaaacttcttcctcttggtttcctaatggagggagtcagagttgtagaccattttggattatgtgagaggagttgaggaagtggagagattgatagcagtagtataaatgcatggggagctaaagaagggagggtaaaaggttaaaaacctctttaaagcatggacatggaattttgtagctagttcacacctctgcctgtttttgaagctcagcagaaaggtctgaagccattgataattttagaaagccatgccaaagagagatacctcttgagttaattatttttgttaatttatttttaaaagttatgtctagtctgatgggattttaggatttgggggtatgtcagactaggacgctttataccattgtccttagtttatcttttatgctaattatcagtatctaaaattatggggaaggggttgttttgtttacgtgattatctttcttcctcccagaatgataagttccatgaaggcaaaggactttttgctttttactaattttgctcattgctttattcttgaattagaacagtcttctacgcagtagtcttagcacatatacaaagaatatgctccataaatatttgttgaattagtagctgcattaagataattatgggacaattggaaattggctaggggtgaactccatgggagagattttaattgatcttatgttaaccaatttgatttttcttagtctgactaaagacatgactggaaaagaagatgtataccgaggcccggccatcagagctctctgcaggatcaccgatgtaagttatctgtttcactgagttaccaaatggaacactatgtttatctgcaggtggccatgtagatttagtaggatttcctagtctgactttgtgaattttcagtataagagaaacatgatcaccagaaaggcttttgtggctccaggctttcttttgtcttcagatttttttcctttatttatgttagtccattttctctctttatttgcccccttgaactgttgtagtgagggtacattgcttgcaggaaacaaaaacccattcaaatttatcttaaaaagctttattataggacacaaatctcagaatttgaggtgaagcttataggtagacaccagggcaagaaattgggcagctttaagaattcaacagcagattttttttctttttcttttttgagtcggagtctcgtgctttcgcccaggctggagtgcagtggcacgatcttggctcactgcaacctccgcctcccgggttcaagtaattctcctgcctcagcctcctgagtagctgggatttgaggcacccaccaccacacctggctaatttttttttttgtagcagtttgaacaaactgaaaactttattcttctgtgtgagctgaactcaagtttcagaataatcatcgccatgtgggaggctttttgttaaaatgcagaagaaatctcaaaatactgtatttatatctgccttccactgctgccaatatagtaagcatctcctacacaatcaacaataaacagcaaatgatgcagttcatagagtattttgcacttggaaaaaaatatatatctgaattgtaaaaagaagtgtttggattttgtatgtcttttttattattgttaaaatactaaatgaaacttctcagcctggcatcttttcctctatctcaatagcttatcctagagccagaaaaagccttgaggagacaatgtcttctggcttccagataaaacttatccaaattttttggcaactcatccctaatgattttaaaatttgaaaaggcttgtctttttgtctatccttaaaagcaatatcaagtattatgtcctaagggggatctaaggagtgggggaaatttattgttcctcctcaccacagtacagtccacaaccactggctggcccacaggtggctcagcacttccctagtcagggtgtcccacctctaggaaagcgccagcactgaaggtcacccagtgtcattctttgtatgcagtacactcttggccaccaaacagtattgtgaaatacagatcattcagccgctaccaccatcactactcctacagggcacaagaaagcaatctccaatctcttttataaataaacagtcctaacttctaggctcagagatgatagataaaacttagctgttgcaattatataattccctgacatgaaattttattggatttaatatctacatgatatagccatttaagagtataacttgaggaaaaaggaaagatctacctgatcaaaaaacatgttggggtggcctatcagaatcttaaacttcccctttagcatctataacgaagacatagatgaagtgcattcattccataattactgagctcctattatatgccaggcactgagcacctgctcatcagctcattgacaatagccatgctcaagatccacactcctcatgtaactttctgattataattgatcttcccagataagatttccccaacaggagcgataatccagttcacttggtggctgtaagtataaaagaatgcactggcattctattatgtacattaacttcctatgagtttgatttaatgtgacaaaacatgaacacctttgtgtggactgacccaaaatcacacttctagaactgcaaagccaaggaccgtatccatgaccttcatgctacaccaacttggagccatcctttttgacttctctcataactcacttctattccaagaacaacaagtcttcctccttacttcctaggacatttgctttggtgtctcaaaataatggatagtcagggacattggagtttggatatgcctatattaagaagtcttccaagtggggtaaatgaagattttcctagggtatggtaagactgcaaggaatacccaggcaatatcctcaaatctgtctgaggagagttttaaaggaataaatttccagatcttcaacttccctatgaaatattttctaaaaccaggccgatgcccagctaatttttgtatttttagtagaaacagggtttcaccatgttggccaggctattcactgtggtgatccatcatgtactagacacaggccctcttattgaaacatttaagagagagaatctgattagtcagcaataggccagtagcttatatccacctgtgtctgagtcaggtgtttaacattgatccagttcattatatctggagggatgagatcatgtagtatgttaggctgtctctttctgggaactctgagtaggaagggtaggccaggcattaccaagcaaattgaataatagctatatacccatgcttgggtatattttaggtgtatgtttgtaaccttcttaagttgtaaaggttgagcaggaccaaattatacatctgataaatctggattctagaaggagtaatagaaatgctttaatattttttggtgcactgttgttctgttgtgattgttttttattttttgcattacattggtagcagcgtgagacttgaccatgctagtgctagcaataaaactctttttttcatctgaatattgctctcagtctttttactcatctttatctgccaccaccttcccagtgctttttcccagttaaagttaaaaagaactgtatttccagaggattttatgttgagggctcactatagtagtacactacacatttaattctttatgtatctcagataatcagggattacgtttgatttctaggactctctgggatctgtatataatatgtgcccttcacatagaggaatcttcataacttcaaaagcaggctccatctccatataggaatttctttatgactttcctgatgggttcagcctctgcttgtgtatttcttccaaactgagattctccattttgagacagtttatttcattgttgaacagttattcttctttatatataatcttaaatgttctttcttaaagcttcaacttcgttgtttgggttctgccctttgggatattattactatattatcatccttttagtgcattctgaatatttgcacagaaacaaatataagattggtttttgaaaattattttgaagcataagagtaattttgcataaacatgtttttccttaacaattttttctttttgaatgttattagggaacaatgttgcaagccattgaaagatacatgaagcaggccattgtggataaagtttccagtgtatccagttcagcactggtatcttccctggtaagtgaacaagcagcttcctagttcttaagcatggtacagttttgagttgcgaaaacaaagtatcactatgattgtctcacaaatgaaacagttaaaaatatgtatacacctctattactttatccaagtgtgttttatctagagcaggggtccccaccccagggcttcagaccagtactggtctgtgacctgtcaggaactgggctgcacagcaggtggtgagtggcaggcaagcgagcattgctgcctgagctccgcctcctgccagaccagcagcagtgtgagattctcataggagctcgaaccctattgtgagctgcgcatgcagggatctaggttgccggcctcatatgagaatctaatgcctaatgatctgaggtggaacagtttcatccaaaaactatccctctgccctctgtccatgggaaaattgtcttccataaaaccaatccctggtgccaaaaaggttggagattgctgatctataggatcattgagcaattaaaaacataaaatgttcgtatgtttgaaaggttttggaaatctgaaagttatgttgtacacataataaaagaggggtaagtgtggggtatgggacaggaaagaaacctaggacccttttctttcatttaaaatcttctttatgacctgcctttatgacttctactacttgtctctttgtcctctgctttttctggtgccctttgtctacgtgtatccttcaatccaaagtttcctgtcccacttctgaatttcctcccaggaagtggtcttttttttagtaatacatttttctttccgtttttcagcagaacacaatttatacattaaaacctatcacattgcatttgattaacgtcagttacctatatgtgaatgtgtaagacatctaaatacaagagttcctgattctggaatataattggctgagttttatagcagagaatatactagtactctctttcttccaggggagtttcctggaagtaaagcttgttatgataacgttatttaagcaccgttctgttgactgtccatccctatcctgttcttcctctttcattacttccttttacacacctctcccagcttacatatactcacctttgtaacaggtatgggagaaaatacttctggtttatcagttgctccaggagtaaagacacaaaatagacttataagagctacatagttttcttcctcttgggaaatgtctgtgattttcaaagaaaactaactcatgtttctaagcttctagtgaccaagcattatttattctcattttttttttctgtatttagcacatgatgaagataagctatgatgtggttaagcgctggatcaatgaagcccaagaagctgcatcaagtgataatattatggtccaggtattgtcattgaatcacattagcttgtctcaggatcagcattctttaaacctgtattgtaggggcagtgtattgattccctagataaacattaactaaaggcaaattaagcagctactagtacgtattctgaagtaggaatctcactaattatgattactgccatttgaatactgcccttcaggtgtttcatagaagctagatgaccctttgtaggaatatttgggaaagattgttatattcagtagtagattgagatgctcgtggcagtcttttatttgaaaaataatttgtgtaaaaagataattccaagttctgaggccttgattataggcattataaaaatcatacggagcagcttttactttatgaaactttgaaaccattttgtcaaaaagagctcttttgatatttattaggttattcttaagaggaataagattaaattcttcactggaaattgtgtgtaaagtaccccattttatttgagagggtgtttatgccctcttgatgtttataacttctatggtaacatattcagttattaggaaacagagtagtcatttttcccttgggaaacactctcattctcctgactctgatcatgtgtttttatacaaagtgtcaagatgatgacactcttgtagcctgctttaggagattaatcctttaattactaagatggccacagatgatgtaaagccactcgtagagacagatagcaccagtaaagccctggacccgagagcgtgtgtactgaggatgtgtgagccagtgttgagcctgctagagccatcttcaggttgtatgtcacctcctttatgcctgccagtctgaattgacagcttctaggggtaaattagaaacgtttaatcttttcagtcttgcctgtgtttagttcagtgtgaaaaaaatatttgtgtacatgtgacctgggtattttaaagaaatctttaatctagttccgtgtaattctatttttgtgtaaatattttgacatctttctaatccatgtgctaccttctttttcatgttctttagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatgggtaagtgtcttcacctaaacctgggttattttccatttgcgaagttaatataccttagagtttatttcctttttgaattttttttggggcagtgctaactttacagatgagttcaatgtttttcaattttttaaaaaaattatggaatttcaagtcacactttttttaaccttactgtatgctcttgtatatgtacttaattattaatagcacattaacaaactgatattgaacaaaaaatatatgcattgatcataagatatatagataattaaatatgaaagttggcagggacattaagaattatcctatcccttttatttttataaaagagaatgttgaagtactgcatttagtgatttgcctaagatcattccacaagtctgaggcacataagatgtgaccaaatatactttagcagtctttcgaaggctagggaagggcaggaatgagaaatcttttgaggtatagtaagctgggcatggatctagggagcaaagaagaccccttccccagcctgaaggcttatggctgagctctaaaacaaagatttcttatgtggcctggcaaactgaggtgtaacacagagaaagatctctagaatctgccactactactaatgccctgctgaaaggggaaacctgatctgttcctcagatcatttgtaaacagcagataactgaatttaattaaagctgcagcaaagtcctgacccagatcaactattagctgctaaaaatgaaaaaggacctgcacttttctaatgataagtattagttacatcagtgtctactgcacctttataagcagtgtctagcaaacaatcaaaaaatacagaggcagtgacatgtaacccataaacaagagggaaaaaaatagtcagtagaagctgacttacagatgacccacatatagaaattaggaggcagtgactttagaaattactaggcagtgacttttaaacaacttctctaaagtgaacaccaaaggagttttgtaaagtgaacttttgtaacttttgtaaattacatctttccactaaagagtggaaaagatggacaaaatgtgtaaatgggtaaggaattcaatagataaatagaaactagaaaaaaaatcttgaaccaaaaaatacaatatcaaaaataaaaatttatttgaagcacttaatagcagattggacacagtggaaaaaagattagagaacttaaagacaagtcaatagaaattgtccaaactgaagcatagggagaaaaataagaaaagaaaataaaagaatagaacatctgaagcctagggaatatatcaaaaagtctaatacttgtgtaatgagtctcagaaggaaaggaaacagaatggaatagaataaatctttgaagagataatggatatgttagtccattttcatgctgctgataaagacatacccgagactgggcaatttacaaaaggaagaagtttaatggacttacaattccacgtggctggggaagcctcacaatcatggtggaaggcaaggaggaacaagtcacgtcttgaatggatggcagcaggcaaagagagagagcgcttgtgcagggaaactcccatttttaaaaccatcagatctcatgagacttactgtcatgagaacagcatgggaaacacttgcccccatgattcaattacctcccacttggtccctcccataacacatggaaattcaagatgagatttgggtggggacacaggcaaaccatatcaatggatgagaattttccaaaatgaatgaaaggggctgggtgcggtggctcatggctgtaatcctagcactttgggaggctgaggcaggtgaatcgcttgagctcaggagttcaagacaagcctgggcaacatgacaaaaccccatctctatcagaagaaaatacaaaaattagccaggcatggtgacgcaggcctgtggtcccagctactcaggaggctgaggtgggaggatcggttgagcatgggaggctgggaggcagaggttacagtgacctgagatgacaccactgcactccaacccgggtgacagagtgagatccccatctcaaaaaataacaacaacaaacccaaaatgaatccaagatggccagtgacactcaagtaggataaataaaaaccacacctaatcataacctagtcatatatattacaagtaaaaagttgaaaaccaaaagagaaagaatgaaagaaaagcttgaaagtcgcctttttttaaaaaaaagacaaattagattcattagattcagggaaacaaaaataagaatcgttgacttctcattagaaaaatggatacgagaggataatggacatcttaaaattgttgaaacaaataactgaaaatctggagttctatactctaaaagtattcttccaaatgaaggtgaaattaaaacattttcaaccaggaaaaaacaaaaacccgaaaggatttgtgtctgcatacctgcatcatgaaggatgctaaaaggagtttttccagctaaaaagaaatgatagtagatggatgccaggatcttcaggaggaatgaaggacaagagaaagggtaaatgtgtaggtaaattaaaaggtaaatatgtaggtaaattataaatatatacaatttttactaaaaccagcagcaaattatggggcttatatatatgtagaagtgaaatatatgaaaatagtagtataaagggcatgagggagaaaaatggacatttgtaaagtttttgtatcatgcagtagtatattatttgatgatacactgtgataaggatgaatattgtaatctcttgaggatgaatattataactaacaaaaaaatctttgtaaaacatatagatcttaaatgtcaacagagaagataaaatggaatatttaaaaatattcagttgagcttcctccttccaataatggtgtagcttggccagcttaatcctcctgcaaataataattgacattagtacaaagctataccttcccaaaatgaagataacccacaacagtatgaaaatattggggagtggtgaaaagcaagcaaaaactggagggaagcagttgatgcctgaaagacaaaagctatactgggtgaaatttgtggggtttttttgctattctcctgagggcattctgtaattcctcagtgtaggatgacagaaagctacagtatttctggacagagtggtcaaaacagtttgaggttggaagagtaactgaaaacttagagtggaaaacctggaaaagagggagccataaaaggaatgagtctcaaaatgaattttaaactctgcaaaaatcactggctgaccaactgaactacatatatacaggagaatactctaggagacctgccaaaagcagtagttgtaagataaaagaattgaatggagaattcagctgcaactcactatggaggaaataaagtttggagtttgatcccagccaagcttcttgctaaagaaactccatgagttctagagtctttacagtatatcattacaatgtttaatagatggtaaaaattgccagaagtacaaagaatttggaaaatgtgactagtagccaagagaaaaagcaatcaatagaaactaaccctgatatgatccagacgttggaattagcaaacaaaaactttgtagcatctattataaatttgtccatgactttatttatttatttatttatttatttatttatttatttatttatgacagtctctctcactctgttgtgaagcctggactgcagtggcgtgatcctggctcactgcaacctctgccttccacgttcaagcaatcctctcacctcagcctcccaagtagctgggactacagggatgcaccaccacacctggctaatttttgtactttttgtagagatggggttccgcagtgttgcccaggccggtctcaaactcctgagctcaagcaatcaatctgcctcagcctcccaaagtgctggtattataggtgtgcaccaccacagccagccttgtccatgactttaatggaaaatagttaccatgaatgaacaggggaaatggaaacgacaaaaagagctaagtagaaattctagagcttaaaaatactctgtcaggattcaaccagagaagtagaacctggaggatataaatatgtagagatttgtttattgattatgtaattcgggggccagctaagcaaatctaaaattcataggataggctgtcaggaagggaagattgcagggaggctggaactcaggggcacaggccaaagttgctctccgtaggtgaaatttgtcatttcacattttactgtaaacagcaagataaaactgggtcacatcttcatttttggaattttcctcaagtaaatatccaacttcatcgtttacaagttctgcttcacaaataactacagggcacaaattcactaagctctctgccaatacataataacaaggatctaccttactcaagtttacattaatgtgttttttacttccttctgagccctcactacagcatcttttaagtccagatttctgtaggcagttcataagccctgaccagcagtgtccttaagaaccagatcgattgatctttctttctccttccttccttccttcttccttccttctttctctttcttttctctttctttcttttctttctctctctctttctttttctttctctttctctttctttctctctctctctctctctttcttttttttatttattttaaagtcttgctctgctgcccaggctggagtacagtggcacagtctcagctcactacaacctccgcttcctgggttcaagccattcatatgcctcagcctcttgagtagctggaactataggcatcccagcactttgggaggctgaggtgggtggatcatttaagatcagatttcttataagtctcttcaaaactaggcttcctccatcatgctcctcaaaattcttccaagcttccacccagtgcctaattccagtcagttctacaatttgaggtatttgtcgcagtaacacttcacttacaggtaccaaaatctgttagttttttttattgttgccataacaaattaccattaaatgtaatggcttacaacaagatccatttattatctcagatctgtagattagaagtctgacacaggcctcatggggctaaagtgaagatgttggtggagtgctgttgcttactggaggctttgaggaagaatccacttccaatctcatttaagtcgttggccaaattcatttccttgagactgtaggttgtaggtctctgtttccttgctggctttcagctggaggttagtctgtgcctctagaggttgcctgtattccttctcatgctttcaatgagcaactaaaggcctctctttgagtcccttgcatgttgattcatacgtgtcagagccagcaatagtgtgttgagctgcactttgaatctctctgatttgcctttctgccacatttcttctgcctcctctttcagcacatctgctttaaagtgctcatgtgattagattgcacctacctgggtaatttaggtgacaatcttaattatatcagcacagttcctttgccatgttgtaacgtaacatattcatcagttctaggaatgaagacatagacatctttggggagccattctgccccagcaagtgcaataactgaatcagataatttgctgaatggacttaacagcagattagagatggctgatgagagagtcaaagagagttagtgaatttgaagatagagcaggagaaagtagctagtttgaagaacagagagaaaacagattaaagaaaataaagagcctcgaagaactgtgggataagatcaagtggcctaacacatatgtaattggaatctggaagcaaaggtgatagaatggagcaaaaaagatatatgaagaaataatgaccaaatatttcccagtatgggtttattctagtagtataaggttgatctaacagtaaaacatagcataatatacctcattttaaaaatacagaagagtcttaatgccttaatgggtgcagaaaaaagcggttgataaaatttaatggcaattcatgattgaaatctctgccaccaggactggaagggaacatgattattctgacaacagtacaaaaaaactccactaaactttatacttattggtggactattaaaagctttcccctagagattgtgaatgagacagacaaaaatgcctgctatttttattttttaaatagtattttgctagaaggcttactttgtgcaataagtgaagaaaataaaatacctaaaaatttgaaaggaggacgtaacactatatttggagataatatggctatatatataggaaatgcaaaataaactgtacattatctattagagctcatatgtaaatttaccagtgttgctggtcaatatccgaagtcattttatttcttattccagcaacccatcaaaaagataaaattttgtaaaaatggtacaatttataattatattgaaatcaaatccttgggaatgtatctactaaaatttgtgtatatctctacacagaaaattacacaatattaaagtatgacctaagtaaatgaggcatataacatttatggaatattcaatattgtaaagatacatcttcttaaattgacctatggattccacaaacccctaattacaatcccaattggcttcttataaataaccaaacagaaatgcctacatttgtgtgttaaaagacatacagttgatccttgaacaacatgggtttgaactgcatgggtccacttacacatggattttcttccacctctgccacccttgagacatcaagacctcctcttccaccccagcctactcaatgtaagatgatgaggatgaagacctttatgatgatccactttcacttaatgaatagttatatcttctcttccttatgattttcttaatattttcttttctctagcttactttattgtaagaatacaatatatattacatataacataaaacgtgttaatgaactatttttgttatcaacaagatgattaatagtaggttattagtgatattttgggggagtcaaaagttacatgtgaatttgcagctacatgggggttggcactgttaaccccatgttgttcgaggatcaactgtacaagatgcctatagtactgttattcataattgccgcaaatttttttttttttttttttttttttgagactgagttttgctcctgttgcccaggccagagtgtaatggtgccatcttggctcactgcaacctctgcctcccgggttcaattgattctcctgcctcagcctccccagtagctgagattgcaggcacgcaccaccacaccctgctaattttttgtatttttagtagagacggagtgtgaccatgttcgccaggctggtcttgaacttctgacctcaggtgatccacctgcctcggcctcccaaagtgctgggattacaggcatgagccaccatgcccaaattgccacaaaatggaagcagtccaaatgtctatcagtgccagaatcaaaaaataaattgtggtatattcatatagtcagatagtatacaataatggaaatgaacaattactgttaaatacaatcacataaatacatctcaccaagaagtcatacacaaatgaatacattttatatagttccatttatgtttattttagacttaacataggcacaactaacctgtggtattgaaagttagtatagtgattatctctgaggtaggagcacattaattttgtagtaattcacgtatgattttcatactgtcatgtgtaacaccagattaaagggatagtaaatatttatttttccatataatttttgcaggtcaggggtttgggaatgtcttagctggatggttcttatttggggtagaaaagttgataattctgaattgatgtttacaaataatttttttttaattagaagctctaaaattccagaggatgacaacatgagaaataatggtgtagaaggtggtattagtttatggccataccaccttaaacaagccaggtctcatctgatcttggaagctaagcaaggttgggcctggttagtacttggatgcgagacaatctggtaataccggatgctgtaggctttaaaaaaaaaggaaagtggttggccgggtgtggtggctcatgcctgtagtcccagcactttgggaggccgaggcaggaggatcacttgaggtcaggagttcgagaccagcctggccaatatggtgaaacccccgtctctactaaaaatacaaaaattagctgggtgtgatggtgtgtgcctgtaatcccagctattcaggaggctgagcaggagaattgcttgaacccaggaggcagaggttgcagtgacctgagactgtgccactatactccaacctgggcaacagagtgagactttgtctcaaaaaaagtaaaaaaaggaaggtggtattagatggaagtaaaagtatgctgtgtatgtgtgttgtcatcttgtatgggaggaaaatatggtaataatataaaactttattgtaatattatagatatagctaatataatatttaattatataaagaatgtaaattgaatgtaaagctttcaaaatgtcgaagaaaatggagtgaggaaaagttgattgaaaattgataaggaaaaaattgattgaggtaaagccttcaaatagacaacaggaaagaaatcggttagaagtaagtgtaactgtatgtgttatctcttgctatgtggtatattggaccaaaaattcacagcttataagtaatacttactattccctagttgctatggtcagggatctgagagaatctgtccagtttgattcaaggtccctccctcgtatgagtttataatcaagtcgttggcctagcctgcagtcatctgggcctggaggatccacgtaattttacttatatagttgttgacaagcctcagtttctccctggctgttggccagatgctttagtttctcactttgagagccttccctccttccttccttccttccttctttgcttccttccttccttctttgcttccttccttccttccctccttccttccttcctttttttattatactttaagttctggggtacatgtgcagaatgtgtagaacgtgcagttttgttgcataggtatacatgtgccatggtggtttgctgcacccatcaacctgtcatctacattaggtatttctcctaacgctatccctcccctggcttcccacccgcgacaggccccggtgtgtgatgttcctctccttgtgtccatgggttctcattgttcaactcccacttatgagtgagaacatgtgcggtatttggttttctgttcttgtgttagtttgttgagaatgatggtttccagtttcatccgtgtccctgcaaaggacatgaactcatccttttttatggctgcatagtattacatggtgtatatgtgccacattatctttacccagtctatcattgatgggcatttgggttggttccaagtctttgctattgtgaatagtgccacaataaacatacgtgtgcatgtgtctttagagtagaatgatttataatcctttgggtatatacccagtaatgggattgctgggtcaaatggtatttctggtttaaatccttgaggaattgccacactgtcttccacaatggttgaactaatttacactcccaacagtgtaaaagagttcctatttctccacatcctctccagcatctgttgtttcctgactttttaatgattgccattctgagtgccgtgagatggtatctcattgtggttttgatttgcgtttctctaatgaccagtgatgatgagcttttttcctgcctgaatgttctcacagcatggcagctggcttctcccaaagcaagggaattgagagaaagagtgagcctgatatggaagttgcagtgttttataaccgaatctcaaaagtgacaggccatcacctctcatgtattcctttggtcacacagacaaactctggtgtatataatgtctacacaaggatgtggaattgtagaagtggatattttggggggccatcttggaggctggctagaacacaaaatataacatttatcataatgaatgtaattgaatttacatattaaaagaggctcagattgggtaaacaaaatgaaacaagagacctttatgcctttagaaaagacacaaacaaaatgacaggaaacattgaaaataaatatataaaaaatgtatactaactatacactcacacacataaaaaatgccatgtagcaatattaatataagccaaaataggaatcagtgtgtagtgcactaaaaatgacaaaatgggccaggcatagtggctcacgcctgtaatcctagcactttgggaggccaaggtgagtggattgcctgagcccaggagttcgagaccagcctgggcaacatggaaaaaccctgtctctactaaaaatacaaaaaaattagccaggcgtggtggcacgttcctgtagtcccagctacttgggaggttaaggcacgagaatctcttgaacccaggaggcggaggttgcggtgagccaagattgtgccacaacactccagcctgggtgacagcgtctctgtctcaaaaaataaataaataaataaaaatgacaaaatggaattttgtattttgacaaaagtaatggtctaaaaaaatataacaggaatgaacttgtatatgcttaatattaacaatatatagtttcaaaatatgcacatcaaaatcttaatacaggaaactaagtcctcttgatctcttcatggagactttaacacaactgtctcagaaactgagaaatcaagtataaaaatgtaagactgtaactgatttgtatgttactgataacaaaattgacctcctatttagaaccctgcatctaagagagaatatacagtattaattctttctaaaattttaaagtgaaaactgtacttatagaaaactgcataaaacataatagttgtgtgtccaatatatacagttgctatgaaacacccttataatgaccacatgtattaggaagtagcacatttctttgtaccccagaaatgctttatatatcctccttgatcatgattatttacccccagagcaaattactatcctaatttcatatcaaatttttcctgggtatgcatccctaaacagtaaagtttagttttgccttgttttgaatgctctgtcaatagaatcatgttatattttgtgtcttcttttttttttcttctagtgaaagtatagagatttactgcaaagagaaatgtacaaactcaagaaaggggagtgtgggcatactcaagagagagttccatacaaggggggtttggggctgctacctttatgggttgctttaactaaggggtagaatatttatgaaaatctctaggaaaaggtggcgatgtctctgaactgtagtgccacccactcatacccaatgcgggtgttcttggaactgtcatggcaccaatgggtgtgtgacttagtatgttaatgagcatataatgaggtcctaggtgaaatctaggtcaaatccagtgccatattgggtctggttggtcttagccagctctgttcacatgttgttcacttaccagcccatagcctctagtcatgtgaaactgctgcctggagttttctatactcaggtgaccacccagtattattcctgtctcattttatccccctcagagacttccatcccttattcttaagggttgatgagggaggaggacagttttctatatctgcttcctgctgatttaggggcattggccctgcctggcaccagcatggaaacctctggctgcctgctctaagggtcccaagggtgggtcatcagaagagtctgcatctgaggcagggattgcttggaatccttgcatgaccatcattttgacgtggaactttgcaacctagaagacataactttacaaagaggttaaacaagcaaggactaaaaaccaataataagaggatagctactagaagtcctagggaaggtaggaaccatgtcacactaggtaggtagcctttgatggggtcccagatggcttgcatgatagagttattgaaattatttagctggatagcccgttggtaaatcttttgaacttgtagttcagctaatactgaactgttagtataagaacagaagatggggcttattgcagcgcaagcccctccgagcagttgatgctttggcccagttagggcctcatgcagtggcttagtaatgagctgaaatcctgggatccaaatcgtgccatacctaggaaagttatgagttgcttcttcatttgtgaaggtctcgtctttaagatagcctcctattgtttgacagacaagatccggtttcctgggcttaggatgtatcccagatattttatttccattttagaaatctgggccttagatggagagacctgataatcttctttctcccaggaagtttaggacttgaatggtattcttatctgagttctctttagtggaactatatacaaggatgtcatccacatcttggagtacggcttccctttctacctctagctcccttaattctcatgccgaggcattgctgaacaagtaagggctatccctaaagccctgaggcagtactgtgcaggtgtactgctgggtaataatagtttcaggattagtccactcaaaagcaaacaaatattgagagtcagtgtgcagagggatacaaaaaaaaaagcatccttgagatcttataccatgaaccagcccttgctctaatgtcccagcttcctacactagaagcggcaaccatttcctacaggtttgctgttagggctgtttggtccttgggcgaagaatccccctgggtgtcatttgggcctgctgtctgtcccattgtttgccatgctgagtcctttcagcctcttcagccctatccctattattgaataacctaaaagctacatgaaacatgtgagtaataggcatttgggatcccaaagccaatttctgcactttcctcctcatgttcctcctgatgtcagatgctgatagactaataaagtatgtccttagaaaaatttggccagcatcaatattgggttcaatgttagcatatattttttagggccttcacaaggctcccctggaacacagcagggttttcatcttttctttgagttatttcccttattttattatagctcacaggcttagtggtacctttttttcattcctttcactaaacaagtcatcatgtgatttttttttttcttagataagcctggccctgttgataattccaattagggccactgttaggcacagacatggcctttacagtatattgttcggggtcccaagccaacaaggtgtcagcataagcctgggcctgtgcccaaatacactgcttttcctcaggggtacaacacatggacaagataatatgaatatgtccccaggttaactcagatgagagtgagagagcccagaacccctccataactttagttaggtcctctgaaaattggcccaacctctgtctgcagtaggctagatcagacatcgaaaaagatacacccagatagtcccagcacccccactggccacctccctaagtgggcataacttagaatggtcaagaatgtaggaaatgcactgtgggcaaccctagcagggctctgctccttctgtagagaagggtgtgaaggttggtaaggagatggactagcaggagtctgggggtacatttcccaaaagggggatcgtgcagggtatctggtgtcccatttggttcccctaaagggctgtgagcctaacaaaggcagcagttcccgcgagggtcaaggttctgataaagagccgtgaaggcttgtattaatacatatgctacttcagtccacttcttctgatgtttacaaaaaagatttaattccaagatggtattgcattttacggtcctagactctggccattgcaccccattttctaaaagagagttacccatagccttgacttgtcctcggcacgacctgaaagagaaaagaacagtatagtttcctcttcggagggactagttccagcatttacaaaatgccaggtgaatgagctggtggttctaatgtggctgtggatgctctgggctaggtggccataaagatgatactggtggactgcagtggagtccccagatgccaatgggacctcagccccagccagtgtccaggctcttgacaccagctccatggtcaggccggggagacagttgtccatgttcccttggctggctgccttggtgtccaggtgtccctggagccctagtgttgcccaggcgtccatggcccctggggctttgctttcaaggttgagtaggatgagtgtggacctagtttgaaagcagcaagcctgccaaaatccatctgaatatttattaccaagtaaaacttcgtagtagagataattcagcatggccaaataatagccaccttgaagggcccccttaaaacaataggcctagatttggcattccagcggacctattttgctgtgtccagagttcactaaacttttgtgtgaagtatgaggaagaagcatgagaagagaaaaccacaaaagcagggtttaaagagagatgggaaagggaaaacagttcccaaccaaggtcagtgtcttagcgcagctggtcccttgggagaacagaagacttcccaggaataagtcataatgctccttggcagctgtccagccactgggacatgggattttaccctactcaccctcattagcctcttgcccaggaggcccatggcacctcagagctcaggtgtaggtcaaagccttcccacctccatttgtcactgtcagggcgaactgcgttttccagctggaggaagcagaggcactacggctgaggggagtcaggctgtaggaacaaggaagaaagtagcagtaactccagagaacgagaagactccaattaaggccccaatgggacttaccaactgctggtggttctaatgtggctgatgatgctctgggctggatggccataaagatgatactggtaggctggagggggggggtccccaaatgccgatgggacctcagcgccagccggtgtccagactcttgacaccatcatgagaaggaattcaaggatgagtcagaaaatagtgaaagtacagagattttatttcaaagcaaaaagtgcacactcaagggagtgtgggggtactcaagagagttgcatcttgttttgttcatttagtattttcttctaagatttcacccttgtttttgcttatagcttttgttcacttaaattctattttatatttccttgataatttcccagcttataacttttgagatgtaactcataaaccataaaactcaccttttaaaagtatatagttaatttttagtatattcacaaaactatgtaaccaccaccactaattccagaccatttgcatcacctcacaaagaaagcacccaacccattaacagtcactctgcattctccttttccctctcgccctggaaaatacaaatccatttttttgtctctggatttgcctgttctggacatctcatataaatggaatcacacaatatgtggccttttgtttctggcttctttcatttagtataatgttttcaagattcgtttatattgtagaagttatcagtacttctctttatggctgaataatattacattgtataaatataccgtattttatttatccattcatctgttgatggacatttggctcgtattcattttttggctattaatgaataatgctgctataaatggtcatgtgtaattttttatgtgacaatacatttcagttctttggggtacatacctaggatcagaactgctaggtcataatataactctgtgtctagctttttgaggaactgccaaactgttttccaagggggctgcaccattttccattttatcagtagtgtttgagagcccaatttctccacatcctcaccaacacttgtcattgtctgtcttttttattatacccaccccagtaggtgtaaagaggttgtgtgaatctagttgtggttttgatttgcattaccctagtgatcagtgatgttgaacatcttttcatgtgtttattgccaatctccatatcttctttggagagatgcctatttaaaatctttgcccatttaaaaaattaggttgtcttttattgttgaattgtattagttctttgtatatgttggatactaaacccttatcagatacataatttataaatgtttcctccaattctttgggtcatctcttcactttcttgatatagtgttctttcaaacacagaagttttacattttgataaagtctaatttttctgtgttttgtttgcttgtgcttttggtattacccctaagaaaccattgcctaattcaaggtcacaaagatttacacctgttttcttcaaagagtttattatagttttacattttacatttgggtctttgatccattttgagatcatttttgtgtatgctgtgggatagagattcaacttaattctttgcatgtggctatccagttgtctcagcaccgtttcatgaaaaacgatttgttctccattgaattgtcttggtgtgcttgtcaaagaattgtgattttaatttctaatttcctaattactaatgagtttgacaacttttttctgtgtttactatccatttggatatcctttctattgaaatatttgtttgagttttacccagtttttaacttggttttctgctttgttcccattgattttctaggagttctttatgtcttctaaatgtgagtccgatgttgattgtatgtgttgcaagtagcttttcccatactctagcttgtctcttccctttcttggtgtcttttgatgaacagagctccgtaagtgtaaggtagtcacatttatcagtcttttactttagaaataatgtgtttggtgtcttgcataagaaacattttcttaccccaaattcacaaatatatcctctgtactattttccataagcattatagcttcaactttcatattttaggtttgtaatctacctggaattgtttcatttttttttcttttttggatatagtataaggtagcaatttaatttctttcttctccatatgaaaacccaataatctcagcaccattagttgaaatatgtgtctatacccactactgtgcaatattagctttgttataaatcaggtgtctttatgtggattggtctatttctggactcatattcaccactgctttttatttctgtttatgtgccagcaacactccaccttattataatagctttctttatgttagtgtagatgtatgctagagaaaatcttcctcccttacttttctgtaagagtattttccagctcttgttttgcatcattacttctctgtgtgtgtctatataatttcatcagggattacttaaccttcccttcagtggagtttgcctcttcctaggagattctcaccaaggccattaataacaaccaaggagttccaacctggccagtcttattttccagatattttattcattgggactttagggctatttcccagttgcagttagtgattagccatcctgatgactgggcatgctgccaaaatgccaaaatgagtctttcacctctggtcctttgctttacttccagaaaactgcagtagaaacctgacctgatgtccagttttctgtgacagtttttatgtaattaagcgcaaatggccaagtagaattcatacaaagcctactagagtaatattcattggaggaaaacttataaagcctggagtaataccagatgcacttgtccccacattgcccattctttctatgtcagtgtatagaagtctaatgacattttcatactatgagatagggcttacaaccttgggctttatagtttttaaactgcattaagtacagaagctgaagctactcactgttgtgatcaggtgggatacaagagcagcataatgtggcatagttttggtgtaagcccaattttgacaacctagcataaattttgaggggaagtatcccttccctggtataatcagaggctgtgacccagatcttacaggtatatgacatggcatgccagtagcaggaatctttgtcagcattcacggttagggaagtatttaatatcagccttcccttggcatgatgaaaagtctggcgtgtttgctatattttttaaaaaagataccccttatcaaatcataaaagttctttttattcctagtttattgattttttatgatgaatagatttgtttttaattttaccatgcttttcctgccattagggaaagaatcatttgatttttctttgttattattataatattgtttaattttaatctgttcatattattttctagttttgtactaccttgagaaatttggactcttttttttttttttttgatcattcttgggtgtttctcgcagagggggatttggcagggtcataggacaatagtggagggaaggtcagcagataaacaagtaaacaaaggtctctggttttcctaggcagaggaccctgtggccttccacagtgtttgtgtccctgggtacttgagattagggagtggcgatgactcttaacgagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaattttttgttagtacagaacaaaatgaaaagtctcccatgtctacctctttctacacagacacggcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccgggcggggggctgaccccccccacctcccttccggacggggcagctggccgggcggggggctgacccccccacctcccttctggacggggcggctggccgggcggggggctgacccccacctccctcctggagggggtggctgccgggcagagacgctcctcacttcccagacggggtggctgccgggcggaggggctcctcacttctcagacggtgtggctgccgggcagaggggcttctcacttctcagacggggcggttgccaggcagagggtctcctcacttctcagacggggcggctgggcagagacgctcctcacatcccagacgggggggcagggcagaggtgctccccacatctcagatgatgggcggccgggcagagacgctcctcactttccagactgggcagccaggcagagaggctcctcacatcccagacgatgggcggccaggcagagacgctcctcacttcccagacggggtggtggccgggcagaggctgcaatctcagcactttggggggccaaggcaggcagctgggaggtggaggttgtagcgagccgagatcatgccactgcactccagcctgggcaccattgagcactgagtgaacacaactccgtctgccatcccggcacctcgggaggccgaggctggcggatcactcgcggttaggagctggagaccagcccggccaacacagcgaaaccccgtctccaccaaaaaaatacgaaaaccagtcaggcgtggcggcgcgcacctgcagtcgcaggcactcggcaggctgaggcaggagaatcaggcagggaggttgcagtgagccgagatggcagcagcacagtccagcttcggctcggcatgagagggagaccgtggaaagagagggagagggagaccgtggggagagggagagggagaccgtggggagagggagagagagaccgtggggagagggagagggagagggagagctctcctgaacatttaaagaagtagagaaatttggactcttacattcataaaaataggttatagatggggtaaaggcttaaataaacagaacctcaaattttcatctagttaaaactaaacataagaaaaatacaatcttttgataggaaaaataaaatattgatagtttttacaacaaaaatttaacgtcttttacgattaaaaaatacataaagttagacaaaaatagactgggagaaaaatatttgctacacatacatttgctactcatggagaactagtatccaaatatataaagaactcttacaaatcaggagaaaagatatcctgatggagaaatttgggattaacgcgcagctccagatgaggaaatgcacctgccaataaacaaaaataagcatcacctcactattgattagagaaatgcagactaaaacaaggtgacattattttttcatctatcaggttgaacaaatttaaaatgttttgtagtatctagtgttggctagaacatgggtattctcataccacattgctgagaatataaattggtagaaatactttgtaaggtaatttggtagtgtctattaaaaagtaaacatggccaggtgcggtggcacacacctgtagttccagctactggggaggctgaagtggaaggattgcatgaggccaggagttcaagactagccccgccaacatagcaagaccctgtctctaaatttttttttttaagttagccaggtgtggtggtgagcacctatagtaccagctacttgggaggctaaggtgggaggatcacagaaggccttcaaggttgcattgagctgtgatcacacctgtaaattgctactgcactgtagcctaggtgacacagtgagacccgactcttaaaaaaaaaaaaagtaaacctgtacagtgtttggaatccagcagtttctcccttgcatatctgctgcagagaaacacttgtacactttcacaaggaaacatatacaaatatttcaattccagtattacttgtaatatcaaaatattgagagatgtctttaacatcctttgaattaacgattggacaaaatgtttagttgtattatgggatgttataaaatgtttaatcaggaattaattattgtttcatgaaaaaaaaaactgtgtgaagtaaatatacagccaatgccatttctgtaaaagaaaaaactacacactgaatatagtttctccttgtgtgtatatgtgtgtggcggggggtaaatatttttttatattgggaaagataaataacaaattctcattatagtcattatctttagggagctgggagaagaggactgcattggggaagattgtcaaagaggactgtctccatgttctaagctttttttttattattatactttaagttttagggtacatgtgcacaacgtgcaggtttgttacatatgtatacatgtgccatgctggtgtgctgcacccattaacttgtcatttagcattagatatatctcctaatgctatcccttccccctccccctgccccacaacagtcctcagtgtgtgatgatccccttcctgtgtccatgtgttctcattgttcaattcccacctatgagcaagaacatgcggtgtttggttttttgtccttgtgatattttgctgagaatgatgatttccaatttcatccatgtccctacaaagaacatgaactcatcattttttatggctgcatagtattccatggtgtatatgggccacattttcttaatccggtctatcattgttggacatttgggttggttccaagtctttgctattgtgaataatgctgcaataaacatacgtgtgcatgtgtctttatagcagcatgatttgtagtcctttggatatatacccagtaatgggatggctgggtcaaatggtatttctaattctagatccctgaggaatcgccacactgacttccacaatggttgaactagtttacagtcccaccaacagtgtaaaagtgttcctatttctccacatcctctccagcacctgttgtttcctgactttttaatgattgccattctaactggcgtgagatggtatctcattgtggttttgatttgcatttctctgatggccagtgatggtgagcattttttcatgtgttttttggttgcataaatgtcttcttttgagaagtgtctgttcatatacttcgcccactttttgatggggttgtttgtttttttttcttgtaaatttgtttgagttcattgtagattctggatattagccctttgtcagatgagtaggttgcaaaaattttctcccattctgtaggttgcctattcactctgatggtggtttcttttgctgtgctgaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccctcttgaattaatttttgtataaggtgcaaggaagggatccagtttcagctttctacatatggctagccagttttcccagcaccgtttattaaatagggaatccatgttctaagttttaaaagaggaatttaaatttaaaaatttaaaggtgaatattgtacaattaaaatttttattcaaaagcaagtattatattttcatttgcatttaacattaacagaatgatttttgtagtaacaatatccaactggatattggaaagcattttaggactatagagaatagagccttctgttagtttcttgaatagtatttttcttttcttttcttttcttttttttgagatggagtctcactctatcgcccaggctggagtgcagtggtgccatctcggctcactgtagcgtccaccttctgtgttccagcgattctccttccttagcctcccgggtagctgggattacaggcatgcgccaccatgcctggctaatttttgtattttcagtagagacggggtttcatcatgctggccaggctgttctcaaactcctgacctcaggcgatctgcctgcctccgcctcctaaagtgctaggattacaagcgtgagccaccacgcccagctgaatggtattttttaatataatagaatttatgatgggttaatattaaaggataggaattatatgtaatttataaactgcttttaaaatgcaagagttttttattactgttgagtgttggctaatagctatggttctaatcaatcatagtttgttgattggaattgaaagaagttacttttggtgccacttatagataggaaggaaaagattcacatttaggatgctgtaaatacttattttttagaaaatttttccataagttggctgggcacggtggctcacgcctgtaatcccagcactttgggaggccgaggtgggcagatgacgacgtcaggagatcaagaccatcctggctaacatggtaaaacgctgtctctactaaaaatccaaaaaattagcccggcgtggtggcgggtgcctgtagtcccagctactcgggaggctgaggcaggagagtggcatgaacccggaaggcagagcttgcagtgagccgagatagcgccactgcattcctgcctgggcaacacagcgagactctgtctcaaaaaaaaatttttttttccataagttattggggtacaggtggtatttggttacacaagtaagttctttagtggtgatttgtgagatgttggtgcacccatcacctgagcagtatacactccaccatatttgaagcctttaacccttgcctgcttcccactctccccccaagtcccaaaagtccattgtatgattcgtatgcctttgagtcctcatagcttagctcctaatttaagtgagaacatacaatgtttggttttcaattcctgagttacttcacttagaataatagtctccaatctcatccaggttgttgtgagtgccattaattcattccttttttatggctgagtagtattccatcatataaatataccacagtttccttatccacttgttgattgatgggcatttgggttggttccatgattttgcagttgcaaattgtactgctataaacatgtgtgtgaagtatcttttttatataatgacttcttttcctcgagtagatactgcgtagtgggattgctggatcaaatggtagttctacttttagttctttaaggaatctccacactgtttttctatagtggttgtactagtttacattcccaccagcagtgtagaagtattccctgttcaccgcatccatgccaacatgtactgttttttgatttttttgattgtggccattcttgcaggagtaaggtggtatcacattgtggttttgatttgcatttccctgatcattagtgatgttgagcatttttttatatgttcgttgctcatttgtatatcttcttttgagaattgtctattcagttccttagcccactttttgatggaattgtttttttcttactgatttgttagagtttgttgtagattctggatattagtcctttgtcagatgtatagattatgaagattttctcccactctgcggggttgtctctttactctgctgactgttccttttgccgtgcaaaagctctttagtttaataaagtcccaactatttaatctctgtttttattgcatttgcttttgggttcttgatcattaaatgcttgcctaagccaatgtgtagaagggtttttccaatgttatcttctaggatttttatagtttcaggtcttagattttagtccttaatccttcttgagttgatttttgtataaggtaagcgatgaggatccagtttcattctgctacatgtggctagccagttatcccagcaacattagttgaaaagggtgtcctttctcaactttatagttttgcttgctttgtcaaagatcagttggctgtaagtatttgggtatatttctgggttctctattctgttacattggcctatgtgcctgtttttataccagtaccttgctgttttggtgactctggccttatagtataatttgaaatcaggtaatgtgatgcctccagatttgttcttttagcttagtcttgctttggctatgggctcttttttggttccatatgaattttagaatttttttttctaattctgtgaagaatgatggtggtattttgatggttttgatggggattgcattgaatttgtagattgcttttggcagtatggtcattttcacagtattgattctacccatccatgagcatgggatgtgtttccatttgtttgtgtcatgtatgatttctttcagcagtgttttgtagttttccttgtagaggcctttcacctccttggttagatatattcctaagtattttattttttttgcagctattgtaaaaggggttgagttcttgatttgattctccgcttagttgctattggtgtatagaagagctactgatttgtgaacattaatcttgtattcagaaactttgctgaattcttgtatcagttctaagagatttctggaggagtctttagggttttcaaggtaaatgatcctatcgtcagcaaacagtgacagtttgacttcctctttatcgatttggatgccctttatttcttgggcatccttgtctgattgctctggctacaacttctatgttgaagaggcgtggtgagagtgggcatcgttatcttgtttcagttctcagagggaatgctttcaacttttccccattcaatattatgttggctgtgggtttgtcatagatggcttttgttacatcaaggtatgtccgttgcataccaatttcgctgagagttttaatcataaagggatgctggattttgtcaaatgctttttctgcatctattgcgatgatcatgtgatttttgtttttaattttgtttatgtgatgtatcacatttattgacttgtgtatgttaaaccatccctgcatccctggtatgaaacccacttggtcatggtggattatccttgatatattgttggattcagttagctagtattttgttaaggattttagcatctgtgttcatcaaggatatcagtctgtagttttctttttttgttatgtcctttcatggttttggtattagggcaatactggcttcatagaatgagttcgggagggttgcttctttctctgtcttgtggaatagtttcaaaaggattgggaccaattcttctttgaatgtctggtaaaattctgtgaattctgtgaaaagtctggtcctggactttaaatctgaatctccctcaagtaaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattctagttatacattcttctaaatttttttcaaagctttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtcttttggttcgtctgtgctctgcccccagaggtggagcctacagaggcaggcaggcctccttgagctgtggtgggctccacccagttggagcttccctgctgctttgtttacctaagcaagcctgggcaatggcgggcgcccctcccccagcctcgctgccgccttgcagtttgatctcagactgctgtgctagcaatcagcgagattccgtgggcgtaggaccctccgagccaggtgcgggatgtaatctcgtggtgggctgttttttttttttgtttgtttttttttgtttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctgggctgttttttaagccggtcggaaaagctcaatattcgggtgggagtgacccgattttccaggtgcgtccatcacccctttctttgactcggaaagggaactccctgacccttgcgcttcccaagtgaggcaatgcctcgccctggtttggcttgcgcacggtgcgtgcacccactgacctgcgcccactgtctggcactccctagtgagatgaacccagtacctcagatggaaatgcagaaatcaccggtcttctgcgtcgctcacactgggagctgtagacgggagctgttcctattcggccatcttggctcctccttctcaatcattctggacttttttttgttggtaatttttaaattaccatttcaatctcgctgcttgttattggtctgttcaggggatctaattcttcctgatttaagctaggagagttgtatttttccagcagtttattcatttcttccaggttttctagtttatgtgtgtaaagatgttcattgtaggtttgaatgatcatttgtatttcagtggtgtcagttgtaatatcttctgtttcgtttcttaatgaagttatttggattttctctcttcttggttgatcttgctaatggtctatcaattttatttatctttttgaagaaccagctttttgttttatttacctttggtatttttttgtttgtttgtttgtttcaatttcatttagttttgctctgatcttagttatttcctttcttctgctaggtttaggtttgggtttggtttgttcttgtttttctagttccttgaggtgtatccttataatgtcagtttgtgctctttcagtctttttgatgtaggcacttgaactttttgagcttttgaacttttgagcttttgatggagggctatgaactttcctcttagcactgcctttgctgtattccagaggttctgataggttgtgtcattattgttcagttcgaagaattctttgatttccatcttgatttcatgttgacccaatgcttactcaggagcaggttatttaatttccatgtatttgcacggttttgaaggttccttttggagttgatttccagttttatttaactgtggtctcagagagttcttgatataatttcaattttcttaaatttattgaggctcgttttatggcctatcatatggcctgtcttggagaaagttccatacactgttgaatagaatgtgtattcagtggttgttggataagatgttctatatatttgttaagtccatttgttcgaaggtatagtttaaatccattatttctttgttgactttctgtcttgatgacctgtctagtgctgtcagtggagtattgaagtcccccactattattgtgttgccatctatctcatttcttaggtctagtaatacttgttttataaatttgggagctcaagttttgggtggatatatgtttaggattgtgatattttcctgttggacaagggcttttaccattatctaatgtacccctttgtctcttttaactgctgttgctttaaagtttgttttgtctgatataagaatagctacccctccttgcttttggtgtccatttgcatgaggtatttcataaaggcacccctgtactttatgagagtatgtgttaggtgagtctcctgaaggcagcagatggttggtgagttgttatccattttgcagttctgtatcttttaagtggagcatttaagctatttacactcagtgttagtattgagatgtgaggtactgttgcattcatcatgctatttgttgcctgtgtactttggtttttttgttttttgtttttgccttttaacttatatttttgttttataggtcctttgtgatttatgctttttaaagaggttctgttttgatgtgtttccaggatttgtttcaggatatagggctccttttagtagtccttgtggtggtggcttggtagtggcaaattctctcagcatttgtttgtctgaaaaagactgtatctttcctttatatatgatgcttagtttcgctggataccaagttcttggctggtaattgtcttgtttgaggagactgaagataggacccaatcccttctagcttgtagggtttctgctgagaaatctgctgttaatctgataagttttccttgataggttatctggtgcgtctgtctcacaactcttaagattctttcctttgtcttaactttaggtaacctgatgacagtgtgcctaagtgatgatccttttgcaatgaatttcccaggtgttctttgtgcttcttgtatttggatgtctaggtctcttgcaaggccggggaaattttccttagttattcccccaaatacattttccaaactttcagatttctcttcttccttaggaacatcgattattcttaggtttggtcgtttaacataatcccagacttcttggagtctttgttcatattttcttattcctttttctgtctttattggattgggttaatttgaaggccttgtctttgagctctgaatttctttcttctacttgttcaattctattgctgagactttccagagcattttgcatttctgtgagtgtgtccagtgcttcctgaatttttgattgttttttttctttaagcaatctatttccttgaatatttctcccttcacttcttgtatcattttttggatttccttgcattgggctttgcctttctctggtgcctctctgattagcttaatacctaacctcctgaattcttttacaggtaaatcaaggatttcttcttggcttagatccattgctggtgaactagtgtaattttttttgggggggaggtgttaaagagccttgttttgtcatattaccagagttggttttctggttccttctcatttgggtaggctctgtcagagggaaggtctaggcggaagtctgttgttctgattcttttgtctcatggggtgttgcttggatgtagtactctcccccttttcctatggacgtggcttcctatgagccaaactgcagtgattgttgtctctcttctgggtctagccacccagcaagtctacccagctccaagctggtaccagggattgtctgcagagtcctgtgatgtgaactcctgatctcaggtgatccacctgcctcagccatccaaagtgctgggattacaggcatgagccactgcacctggcctcagttctttaactttatgctctttcacttaatataatatttttgaggttcactgtgttgtagcatgcatcagtacttcattcctttttatgactgaatactcttccatggtacggctagaccaaattttgtttacttgttcattaattgatgggcacttggttttttcattagttgatgggcacttgtttttctttcccattttcatctattatgaataatgtggctctgaacattcatatataaagctttgtgtgtacatatatttttccattttcttgcaaagatttctataaatagaataactgggtcatatgatgagtttatgtttaacttttaaagaaattgccaaactattttccaaaataaccataccatttctattatgtatgagaatttcagttttctatgtctttatcaacacacttatacattgttggtgtgagtgtaaattagttcaaccattgtggttgaacttacctatgtaacatgtaccattagctatgaacaaaccttcacatgtacccctgaacctaaaattaaaagttttttaaaaatcacgcatgggtgttagattttgtcaattgacttttgttcatctatgaagataattatgtggtttttattctttatattattaatgtgtgttagatttttgtcaatggatttttattcatctgtgaagatgattatgtggtttttgtcctttatattattaatgtaatatataatgtgattttctggtgttaaaccacttttacgttcctgtgattaatgccacttaattatgtatataattctttttacatattactggattcagtttgctgatatttgttaagaatttttgtttttggtagaagggagattgtactgtaattttcttgtgaaatatttgtcatgcttttttatctgaatagtactagcttcatagaattagttggttagtaaatgttcttttctcatttattttctgaaagagttgtgaagaattggtattattattattttaaatatctgatagaattaactggtgagaccatctggatctgtggtttttttttttttgaggtgtgatttttaataactaactcattagaaattatttagattttctgtttctttttgagtcatctttagtagtttggtatttctaggaatttttccatttcatctaagttatctaatttgttgtcatacaattgttcataatagttcctcataattattttcatttctttagtgtcagtagtgatgtgttccctttttcatccctggttttggtaatttgtgtctttcctctttttttcttggttagtttagatgaaggtttgtgaattttgttgatcttttcaaagaaccaactttgggtgtcactgattttttttattattatttttctgtgttctagtcaattaacctgtgctctaatatttattatttcctttcttctgcttgctgcaggcttactcttcctaatttcttcatgtggaagcctaggttattgatttgagacccttttttgtttttgatacaggtttctaaaataaatttttctccaagcattgctttagttgagccctatacattttgatttgttgtgttttcattttcattcaacttcaaatattttctcatttcccatttgatttcttcttgatccctgagttacttggaagtgtggtgtttaattttgaaatatttaaggatttccctggtttcttttctgttgttgatttataatttaattcagttctggttgaacaacatactttgtatgatttctgtcattttaaatgtattgagatttgttttgtgacttggtatttaattcgttcttggaaatgattagcactgagaaagaatttgtatttttacagttactgggttgaatgttttctataatcagttagcttgagttggttgatcatgttgttcaagtcttctgtatccttgatgattttctgcttagttgttctatcagttattgggtgggactagacatctccaactattatttttatttttatttattttatttcaataggcttttggggaacaggtggtgtttggttacatggataagttcttcagaggtgatttctgagattttggtgtacccatcacccaagtagtgtacactatacccaatgtgtagtcttttatcccttactcccctccctctcttccccccaagtccccaaaatccattgtatcattctcatgcctttgcgtcctcatagcttagctcccacctttaagtgagaacatgtgatgtttgggtttcctttcctgagttacttcacttagaataatggtctccaactgcaccctggttgctgcaaatgctattatttcattccttttaatggctgagtagtattccatggtgtatatatgtgtgtgtgcgcgcgtttgtgtatatatatatatagagagagagagagggcgcattttctttatttacttattgattgatgggcatttgggctggttccatatttctgcaattgtgaattgtgctgctataaacatgagtgtgcaagtgcctttttcatataatgacttcttttcctctgggtagatacccagtagtgggtttgctggataatggtagatctactttttagttctttaagtaatctccacactgttttccatagtggttgtcctagttcacattcccaccatcagtgtagaagtgttcccttttcaccatatccacaccaacatctatctttttattttttaattatggccattcttgcaggagtaaggtggtaccacattgtggttttaattttgcatttccctgatcattagtgatgttgagcatttttttcatatgtttgttggccatttgtatatcttcttttgagaattgtctattcatgtccttaacccactttttgatgggattatttgtttttttcttgctgatttgtttgaggtccttgtagtttctggatatcagtcctttatcagatgcaccatttgcaaagcttttctcccactctgtgggttgtctgtttactatgctgattatttctttcgctgtacagaagctttttagtttaattaagtcccatctatttatctttgcttttctcgcatttgcttttgggttcttggtcatgaagtctttgcctaagcaaatgtgtagaagggtttttccagtgttctaggattttaatggtttcaggtcttagatttaagtctttgatccatcttgagttgatttttatataaggtgagagatgaggatccagtttcattctcctacgcatggctagccaattagcccagcatcatttgttgaataggatgtcctttccccgctttatgttttgctttctttgttcaagatcagttggctataagtagttgggtttatttctgggttctctattctgttacattggtctctttgcctatttttataccagtgccatgctgttttggtgactgtggccttatagtatagtttgaagtcaggtaatgtgatgcctccagatttgttctttttgcttagtcttgctttggctatgtgggctctttttttggttccatatgaattttaagatttgtgtgtgtgtgtggttctgtgaagaatgatggtggtattttgatgggaattatgttgaatttgtagattgcttttggcagtgtgatcatttcacaatattgattctactcatccatgagcatgggaggtgtttccatttgtttgtgtatgatttctttcagcagtgttttgcagttttccttgtagaaatctttcacctccttggttagatatattcctaagtattttattttattgcagctattgtaaaaggggttgagttcttgatttgattctctgctggctcactgttgctgtatagcagtgctactgatttgtgtacattgattttgtaacctgaaactactgaattcatttatcagatctaggagctttttggatgagtttttagggttttctaggtagacagtcatatcatcagtgaacagcaacagtttaacttcctctttaccaatttggatgtcctttatttctttctcttgtttgattgctctggctaggacttccagcactatgttgaatagaagtgatgaaagtgggcatccttgtcttgttccagttcttggggaatgctttcaactttttcctgttcagtataatgccaactgtgggtttctcctagatggcttttattactttaaggcacatcccctctgtgccgattttgctgagggttttaatcataaagggatgctggattttgtcaaatgcttttttggcatccattgaaatgatgaagtgatttttgtttttaattctgtttatgtggtgtatcacatttattgacttgcgtatgttaaaccatccctgcatcactggtatgaaacccacttggtcatggtggatatctttttgatatgctgttgaatttggttagttatattttgttgaggatttctgtgtctgtgttcatcagggatattggtctgtagttttctttttttgttatgtcgtttcctggttttggtattagggttatactggcttcttataatgatttaaggaggattcactctttctctatcttttggaatagtttcaataagattagtaccaattattctttgaatgtctgatataattcagctgtgagtttatctggtcttggacttttttttgttggaaactttttattaccatttcaatcttgctgcttgttattggtctgttcagagtttctatttccctcctggtttgatctaggagggtttgtatatttcccaggaatttatccatcacttctagattttctggtttgtgtgtataaaggtgttcatagtggccttgaatgatcttttgtatttctctagtattttggttttaatatctcccgattcctttttaattgagcttacttggatcttctctcttcttggttagtcttggtaatggtctgtcaattttgtttatcttcaaagaactagctttttgtttcatttatcttttgtattttttgttgttgttgttgtttcagtttcatttaattgtgctctgatcttggttatttcttttctcttgctgagtttaggtttggtttgttcttgtttctctagttcctggaggtttgaccttagatcatctatttatgctctttcagactttttggtgtaggcatttagtagtatgaactttcctcttagcaccttttttgctgtatctcagaggtctgtatatactattattgttcagttcaaagaattttttaatttccatcttgatttcattgatgacctgacaatcattcaggagcagattatttaatttccatgtatttgcctggttttcaaggttccttttggagttgatttccagttttattctactgtggtctgagagtgtacttggtataattttaattttcttaaatttattgagacttgttttgtggcctgtcatatggtttattttggagaatgttccatgtgctgatgaatagaatgtatattctgcagttgttgggtagaacgttctgtaaatatctgttaagtccatgtgttgtagggtatagtttaagtccgttgtttctttgttgactttctgtcttgatgacctgtctcgtgctgtcagtggagtattgaagtacaccactattattgcgttgccgtctatctcatttcttaggtctagtagtaattgttttataaatttgggagctccagtgttaggtgcatatatatttaggattgtgatattttcctgttggactagtgcttttatcattatataatgtccgtctttgctttttaaactattgttgctttaaagtccgttttgtctgatataatagctactcctgctcacttttggtgtccatttgcatggaatacctttttccgcccctttaccttaagtttatgtgagtccttatgtgttagatgagtctctttaagacagcggacttggttggtggattcttttttttgagacagagtttcgctcctgttgcccaggctggagtgcaatggcgcgatcttggctcaccgcaacgtccgtctcccaggttcaagtgattctcctgtgtcagcctcccgagtagctgggactacaggcatccaccaccatgcccagctaatttttgtatttttagtagagacagggtcaccatgttggccaggctggtctcaaactcctgacctcgtgatctgcctgcctcggcctcccaaagtgctgagattacaggtgtgagtcaccgcacctagccctcttacattcagtgttattactgagatgtgagtgaggtactattctattcatcatgctagttgtagcctgaataccttgttttttatttttcattgtgttattgttttataggccctgtgagatttttttctttaaggaggttctattttggtgtatttcaaggttttgtttcaagatttaggactccttctacagttattgtagtgctggcttggtggtggcgaattctctcagcatctgtttatctgaaaagaactttatctttccttcatttatgaagcttagtttcactggatacaaaattcttggctgataattattttttttaaggaggctatcgataggaccccagtcccttctagtttgtagggtttctgctgagaaatctgctgttaatctggtaggttttcctttatagcttacctgatgcttgtgcctcacagctcttaagattctttccttcatcttgactttagataatctgatgactaaatgcataggtgatgatctttttgtgatgaattttctggctgttctttgagcttcttgtatttggatgtctaggtctcttgcaaggccggggaagttttccttgattattccttcaaataagttttccaaacttttagatttatcttcttccttgggaacaccagttattcttaggtttggtcatttagcataatctcaaacttcttggtaccacccagttggtagtttttttatcctcatcctctcccaccctacaccctcaagtaggctccagtgcctattgttcccttctttgtgaccatgtgcactcaatgtttagcttcccttataagtgaaaacatgcagtatttggttttctgtccctgtgttaatttgcttaggataatggcctccagctctatcgatgttgctgcaatggacataatctcattcatttttatggctgcatagtattccatggtgtatatgtactacgttttcttcatccagtccactgttgttgggtatctaggttgattccatgtctttgctattgtgtgtagtggtgcagtgaacataggagggcctgtgtctttatggtagaactgttagtccaaactgtaccattttgtaagccccttgtcatttcatagaccttgatcaaagtgaaacattccttgggggactgggccgtgagaaacatcctgcccgactgcctgactttcttatcacattctgctgggaaaaagtccaaggaacatcactgtcacatcctgccagaacaagggccaaaccacctcatcatgggaacatcttatcaacatcctcccgggcagcaagccataaccctcagacccctccctcccaggcctaaaattgccccagcctgtaagcagaggtgggccctggcattaagctggtgccccgcctctgcaggtcttatgctggacataaaacctgcattgctgtagagccgccaactctctctcagtctttctttaatcctcgccttctcatcaaaacctaagaagaacaattcatattccttcgggttcgtatttagtaatgggattgctggattgaatggtagttctgaggtctttgagaaatctccaaactgctttccacagtggctgaactaatttgcattcccaacagcagtgtgtaagcattcccttttctctgcaacctcaccagcatctgttactttttgactttttaataatagctattctgactggtacaagatggtaccaagcatatgaaaaaatggtcaacatcactaatcattagagaaatgcaaatcgaaaccacaatgagatacaatttcacaccagtcagaatgactatttttatgctttcaacagtttcactctgatgtgtatatatttgaatatttttgtatttattctgcttgagactttttgagcctcttgggtacataaattaatgttttttctaaatcaaacttatgaggttttcagccatggtttcttcttatgttctttttcccctttgtgtctctcttttcctatgaaaactcctatcatccaaaatgttggtacccttggtcatgttacacaggtctccaaagcactgttcatttttcttccttctttttttattttcatcagctggtttatctcagtagatctacaagttttcttattctttcatctgcctgtgcaagtctgctattgaactttttctggtgaatttttcattccagtcattgcactttgcaaatctagaatttctatttggtttcttaaaaaaaaaaatcatttctgtcactttattggtagtctcataagacatcttgttgtacttccctttaaattaaatattttagtttcctttagttctttgaacatatttatattagctgacttaaagtttttgccagtaagttcaacatctgggcttcctcaggaataaattctattgactactttttttcccccatagatgggtcatagttaagtatttctttgtgtgtctcataattattttgtcagaaacattatattttaaatattataatgtgacaacactggtaatcagaccttccctttccctatccctggggtttgttgtttttgttgttgtttgtgaccttcctggactatttctgtagtctttattctgtatcttgtatagacactgaagtctttgtttgattagctgagtcacaaataataatttgacagattttcttaaatgctttaaaccagtatgtctcccatcattttccaacgggtgctgtgtatgttggggcgtgctttccatgccccgggagttcacagctctgccttagccttcacttcctgctttgtgcagagcctcagagtcaagcaaaggttagagagcggagctctgtcaggtctttagtggctgtttgcttagccctgcacatgcacatgaccttctgtatccccagaaatattttagaaattttcaaagccccctaaggacatctcatttctcaaattttccttttaagttttttggccagcctcttgtttgcccctgctaaaattgctgcttctggcagctgcaagattaaccaaatactactgatttttttggacaaactccctgggcatagggcttttcatgctgaatgagctcttgagtcaggtgaagtaaagattagcttgtgaatagggcttttctaggagcaccagacaggtcacatagtgacagttctctggggatgagattttggcccagagctgcttttgtagctaggctgctggcattcacagttactgtggttctgaggctgctggtttccaagactgctatggaactgggaagaggtgcatggaaattgagaatgagtaggttaaaacaccagaaacttcaccatttttactaagattcagctacttttcttaaatagatgttcaggattgttgcaaatctttgattaattttttagagttctgcaaaagttgattttgacaattttgccagtgttctaattgctttgtgatgaaatgaatttttagaaatccctcatccaccattccagaagtgcctctcaatctgcctgtgcttttaatccctatgcatattgcctctctatttgatatctaaataatggcctataaatatttattggcagccatgaaagtccactgtttgatttcattgagagctgcttgcgaaataaacatgaaatggttatttatgaagctgcttcagctatcatccatcttcctaactgcactgcaagagagttggcacctgctgtttcaggtttgttttatatttgatggctggcttttatgttcctaagtttttgctttaagtttcataggtctacagaataggtattaagaatgttttctgaacactagctctgtgtatatatagcctttgcattctgatagcttatatgtagatagtttattttagttgttccttactttattactttttttaatgtttctatttctccatataaaacttttgaaagaattttatttatatgtacatagtttattaataatagttctttattgcttttttttaaagtttctgtttcctcgtatgaaacttttgaaaacattttacagttttccttggtgtttaaaaagcccatttgttttcagaactgtcaatatttctaccatttagttcaggtattaatgggtattctaatttttttttaaaaagagcaaactttgtttcttatttaagtttttataactgaccaaaagtgctttttctttttttttttttctttttttttttttttttgagacggagtctcactctgtcactgaggcaggagtgcagtggcacgatagctcggctcactgcaagctctgcctcctgggttcacgccatgcttctgcctcagcctcccgagtagctgggactacaggcgccccaaaagtgctttttctattttgatgttacatttttcatgtaaatttttgatgctgtgataaaatgtatgcatattttgaatgtgattcattatgtactatattttcagctatatggtatatgatgagataaggaatattcacagcatatataggtaatagtcactgtatctatatctgtattttacttcttcaacttttctatagttctcttaagccaggagtattcacggtatgtatatgtaatattacttaatgttacatattattattattatttttttttagttcttcaacttttctgtagttctcctaagccagccttgagatatgcagctgtgaggaccttgaacaaggtaggtgtttctttgctaattattgacttatatcagtatttaattgagaaacattaaatgtgaagcatttggttttctctccaaggttagtatatgtgatttatgggcttcacctctacaacacttcacttgtatttgtggccttgagtatgctcatttttattattatttagctgaagattataactcatttctgacttctaagcattttatattcaagagccacactgtccaatatggtggccattagccaccagtggctatttcaatttaaattaattaaaataaaaaattcaaccctcagtcacatgagtcacacttcttgtactcacagccacatgtggtcagtggctgttggacagtgcagatcttgaacatttctgtcattgaagaaagttctcttgcacagtgctggtctacagcagccctgtccagtagaaacccactgtgaatcacatatgtaatattaaatttcataataaccacattaaaatttttaaggtaaaattaattttaatagtatattttatcataatacatataatatgtcatctcaacatgtaatagatatttttacatatctcaagtttttgacatccagtatatttacatttacagcatactcagtttggattagccacctttcaaatgcctggtagtcacatgttgctgttggctatgttattagacagtatagatttagaggatataatacagaaacacagaataaattaaataagcatagaaaatgtaaatgaaagttaaatgtaatagaagacttgtcataggcaatacataattataaattaattgtgtaaacagtcgaagaaaagagaagtttagagcagccatggaagaaacctttatagaacaacaatttaaatggttttttatttatttattttttttggagacagagtctcactttgtctcccaggctagagtgcagtggcacgatcttggcacactgcaacctccgcctcccaggttcaagcgattctcatgcctcagcctcccaaatagcagggatcacaggcacctgccaccacgtccggctaatttttgtatttttagtagagacagggtttcgccatgttggccaggctgctctcaaactcgtgacctcaggtgatctgcccacctcggcctcccagagtgctgggattgcaggtatgagccaccaagcctggcctaaattgtttttaaagagttgatacaggtctacaatccctcatctctaatcttggggccagatgtgtctcagaatttgcttttagttaaattttagaaaggttatatggtgttatctcttatttactaaccccagtgggcctggggcagcatcccaccattaaaaaacattaatatttttgcacaaaacatatgactatccttgtcaagtggtataaattaagaattaaagagtttcgcattagtttgggtcatgttttgctgttaaatggattttcatcccagtgctctgctttccagagtgttttcagattttccaaattgtgggtaagggattccataccaatattgggatagacaaagaggtgggacaacatcaacaaaaacaaggatgcaggagaatggcagaccatgtagtaaccatagataatgcagtttggctggagtttgcgtcttgaaatgcagcagtattttttaactgataagatattaacagtctttgtcgagcactgactactatgctagatcctgttgtcagtactcctaacatctaatagaatagacgtatatgaacacacgtactataaggaaatacaggccaattataattttttaaaaatggtaatgttagaaaggttagaggaacctaacaaaagagagtacgatgctatactctggccgttgatcatttattaaaagatataccttgttaactggagccattctttttgtttttgaagcaattacttttaacttatcctgtcctctttggattgccacttacctcaattaaaatttaagttctggcctttatcaaaagcaatttgcttaattttttttcttgcccttccacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtaagagtttaaacatgatcatattttctcccagtctgttggctgcctatttattttcttaacggtatcatttgagaagcagaagttttaaatttttatgaagtctaatttatcaatttttttctttcatagttattactgttccctaagaaacctttatctacttgttttctcatgctttaggctaaatgctttatggttttagattttacattttaggcaatgatccaacttgaattactgtttgtttggtaagttcagtattttttccatacctatatctactgtattccaccataatttgttggaaagacttccttttccctgttggagtgctttggcacctttgtctacaaagcaaatacccatatattttaggtatatttttgggctttgtattatgttactgaactgtttgtcaatccagtaccagtaccacactaatattgattaatgtagcattatggtacctcttaagtagtgcggtcttccaactttttcttttttaatattctggttcctttgcatttcctatgaaatttaggaccaatttatcaatttctactaaacaagcctgctaggattatgactgggattgtgttgaatctataaatcaatttggggagaactgacatcttaacattatttttctatttcatgaatatggtatatctctccctttagatcttctttaatttctctgagcagtgttttgtagtgtttactctagaggtcttgcaaatctgttgttaaatttatatctaaatattttatgcttttgatattttattaaaatttttattttattgtttactattaatgaaaaacttttaaaaaatacttctccatattaacttggtatcctgtaaccttgctgagtacttttactggttctagtcatcattatacgtattccttgagattatctatataaataattgtgccatttgtgaatagaggcagttttacttctttatatccaatccaaatgcctttcctttgtttttcttgcctaattaaaaaagtacttccagaacagggttgaatagaactggtgagagtatgtcagagatgattttaaaaaaataaataaataaatttcagttaaaagaataaaagtagaaacattttattgcttcattctttttttatactcagtcaagtaatataactaaccctatttactctctacttagtatgcatccagacttttaaaaaacaaactttacccatgtattcaagcagacagttttgtgcatctggtgtagcagttgctgttctagttttttcaaattgcatttgtaggagtgagttttttgctaaagacgtgtatttgttattaagataccttggctttgattttgagtgcctgtggtagtgggatcttcgtatgacctcttgagcagtacacagggtcagtggtctctatgattcctcagtgacttagggtacaggcattagttgaggttgtggtgaagtttagctggggatctggacacatagtcagtcagtctttgggctccagtagtggcagcagtacaccaaatgtgcctatttttaggcccagcttacactggctccagtgtttgtgggtactagagggctatccttgggcctcaaggtggcttgctagaaagagatactgagagcagtgagctcagtgtgtgagtgggttctccggcccctggcagctggggtggtgtgggtgatgggcagtagtgatgttggagcaacctacagggacacaagcagtcttatgttggtgttggcagaagctgcaatgggttgggtaggctgcattttccgcattttctttaggatttttagtcttttgtttccttaatttttttgtatattcaggatattagctctttatctgtgaaagatgttatgaatatcttctcccggtttgtcatttgtcttttgacttttcttatgatgtctttggacatgcaaaagtgttattttttttaggtagtcatatttgccaaccttttattttatttgactttgaattcataattaaaaattatattcccttcaaattttagagtaattcactcatgttctcttctaatacatttatagtttcatattttacatttagatctctggtccattgaatttttttattatatatgctataaacagattcaatcttatccttttccattgactacacagttagttgccccccaaaattctatttaaagccaggtgtggtagctcacacctttaatcccagcactttgggaggccaaggcaggggcatcgcttgagtccaggagttcaagaccagcctgggcaacatagtgagaccctgtctctacaaaaaaatacaaaaattagtcagacatggtggtgcacacctataatcccagttacttgggaggctgaggtgggaggatcacttgagcctgggaggttggggctgcagtgagctgtgatcatattgcactctgtcctgggcaacagagcaagatcttctgtattagtatgttgtcacactactataaagaaacacctgagactgtgtaatttataaagaaaagaggtttaattggctcacagttctgcaggctgaacaggaagcatggcagcatctgcttctggggcagcctcagggagcttttactcacagtggaaggcaaaacaggagcagacgtcttacatggcaggagcatgaccaaggggggtgtggaggagtgttacacacttttaaatgaccagatctcacaagaacttactatcacaagaacagcaccagcagggaaatccgcccccatgatccagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggagtgcaacggcgtgatctctgctcactctgcaacctccccctcccaggttcaagcgattcttctgcctcagcctccccaaagagctgggattacaggcacccgccacccgccaccatgcccagctaattttttatatctttagtggagacgaggtttcaccacgttggccaggctgttctcgagctcctgacctcaggtgatccacccgcctcgacctcccaaagtgctggaattacaggcatgagccaccatgcccagccacatgtttatttttctaatgaactttagtatcaagttgtctagcttcataaaaaaccctgttgacattttctgttgggatcacgttaaattcataagttaggggagaatacatatcctgatgatgttggaacatcctaagaacaaggatgtcttttaatttgttcaaatctgcttttatgcctttcaagaatgttttataaaaaatatttttatattagttttgaatggttttaaaatgcttatttctaaataacttacctttttcattgctattataaatgttttttattccattttatcttctacctggttatcatttatgtatatgaatattactggttttgcatgttaattttatatcctgctaccttggtgaattatcgagttagttttattattcattctctagggttttcatatataccatcatgtcatctaaaaataaagatatttttgtttgttttgtcttctccgattcttgtttctttgttttcccttatctaattgcattggctaatatctccagaataatgctaaataattgtggagatagtggcatccttgcatcacttctgacctcaatgggaatgcctttcagggttccatattaagtaatatgctgtcattaggattgaagtatatatgtttatgttatggacatatccatctgttcctttttttttcaagaatgtttattaggaatggatgttggattttatcaaagccttttcagcattttggatataatcctttgactcatgaatgtgatgttattttatcaattttctaatgctgaaccatctttacattcttgataaaacccatttcatcatggtgcattatttctttaaggtagtgttagaatctattaactaatatatttcttagaatttttacatcggtatttataaatgattttagtctgtaatttttctttctgtacatatataccatctttattaggcttaagtatcattgcttcatacaaacattatggagattttctttcattttctatgctctgaaactgtatatatggatttggggttatccgattgttggtagacaattctaaattctccatgagtctcttctcatttctgcacatcttgcaagttaggcgctaactgccctctgtttcctgctaccataactgtattccctttctataatacaagacatcttctagccttagaagatagagatcatgtctccctctaaaggaaagggaagatttccttgcagccccaggaaatactaatagtatttagagcaaaaagccctctggagcaaaaagtaaacatgtttatggtccaatataataatgttttccttcggaaaaaaggacaggcatacttactccccactgtaaaatgttcaggttccatccttagggttcttattcagtaatgcagcctactgcaagaccaggtattatctggctctctttgcattgcactttgggaattggggctcaggagacccaccccaaaatgctcacactctggctactgctactgctgtgagtagttaactgtctttcatcgctgagccaggagtctcttgttttctaccagcatccatgaaattgtgacaggttaacttgttagccacaagcagggtaaaatctcacgttcttcacacatcttgacactggtctttatttttattttattttattttatttattttttgagacagagtctctctctgtcacccaggctggagtgcagtggtgcgatctcaactgactgcaacctccgcctcccaggttcaaccaattctcatgtctcaggctctccgagtagctgggactgcaggcccacgccaccacacctggctaatatttgtatttttttagtagaaacggtatttcaccatattggtcaggctggtctcgaactcctgacctttggtgatccacccaccttagcctcccacagtgctgggattacaggcattagccaccgtgcctggctgacactggtctttaaaattgtggtaaaattcccctagaaaccattttgtgaagtagttccttgatagctttctctattcttctatggaagtcagtctgttcaagctttttatctttatggttcactttaaaatctttgatgtgatcatttgtctgagacagagggaagggatctgttgaatgaactttatttttacattgctttgtattttcctttgtggtctccttggttatcttccatgaagaacaattattgtcattttaggcaactacaggatcttcttagcttgtagtaagtaggaaagtatgtttagtagccataattataaagatgaatgtcttttctctgtttgctttttataggtggtagttgtacagtcataaaaatgaatattctttttgtttttctacaggtggtggttgtacaggcaattagtgctctctgtcagaaataccctcgaaagcacagtgtcatgatgactttcctctccaacatgctccgagatgatgtaggtagactactttttaatcataggaagttgctgtcttaaattcttaggattgccatgaaataccatagtgttttaagatttccttatcatctcagtatgcctctcaagtagtacactaagtctggttactgtcttattactaaacatgccattgctttgctttccccacttggagaaaaaacacttttgcttctttcataaaaggtgggaaatgaaatttgaatattataagcataaaccttggagtgtaagcatttctccaaaatgtgtccctagaatgaatggcagttttatcttcttttttgccagggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctggtgagtcattgggacactgatattgacgatgctgatcttttgaaatacttaagagagtgataatgaaattggaaaatgaagttgcaggatttattggatggtgggattttagagcatgcttagggcccagatatctttctttgtactcaatttccaccctcatttttgccttagattagacaaataacccttcgctttcagtaagataggaatactatgatggctcatccgttttttcagttatagccgtaagcatgaatgtttgtagaatttgtttatgtgtttctatatatatatttttaagcgacttttcctccctaatctttctttcccttagcatatgaatagatccaaatctctcccattaaagatgtaaactgtctatgagcttttcactagctactgactctatactttccttcccctcggagataaacttgaagtagccgttattagctgcctgcatgaattcattatccatttttctctttaactcagaataatgtagctctcccttaaaaatcctcaagtaattttattgaaaattacttataaactagttgtaaaatcaagttagatactttaatgttcttacctttgtttacactcagtccacttgatgtgctattgactgaacacttcgtgaaaccccatagccttggtttccacaatagcctacatgtttccatcactcctcactcttatttacagagctcctctttccagcaccattccttaaaatattagttctctgtaagattttgacttctcaacatctacattcctcttggtgatcattttcagagctctgctaataggctgtgacattccagtcatgtctctttcctgaacttgtttgtccaaataacttaaagcacttcaaactcaacctgaaattcaaactaacctcacattcatcatccactcagttatcaagatagaatcttgttctgctgccttacagcccctatctgttactttagcaaagcgctttcaattgtgtctccttaatatttcttcattctcttctattttcttggtgctgattgaggctgtcatccgtttcagatccctagctatctgactgcttctagactcacatatatcctgcctattctttacactctgctaaaaaaaaaagaaaaggcgggggggactttcaaatgtacaaatttatctcatatttaatatcctttaataataatgttgagattaaaccataccctaattttgttttattgccagtctctcccttgtctcttcttgctctccaacatgggtcctttgctcagccttgcccaactgtccagtaatacaccacactttcttctctgggcaggggccattcgaacgtgttattttctctgcctctaatactcttatcctgcctttttcctctggctaacagtacttggtcttcagattttagctcaagtaatatgtattaactctttgtcttagttttccaccaccaattcggatttagttcctttctgtgtattcacatagcatcctggatatatttcttccatggacttacctatgatgtcttgtaattgtctctctacatacctatctttcccactagagtgtagctccttgagatcagggacatgtcttttatctgtcccagtacctagcacaattcctgacaaaagtttggtgaacaatgaatctttgttgaatgagaggaattttaataatagaatttctttttatgcttggggctggttgtttgagattagagcttaatgacatcagtgtgatatataaggggttgtggtggggtggagatatagctcctacagaaaatctatatgaatctttttcctcaatttttggaagattttcctattcagagctctcttgggcttgcagaattctatttatgcttaacagtatcaaagaaataagatcaagaaacactcaataaaacaagggagtttatctccactgaacatggggacacttttctaattttttttcaaatggttattggttaactctgagaaaccaatatttatgtaccataattgtatgcttcattatagctgctgtgagtgctttggctaaatttggggctcagaatgagagtcttctcccaagcatccttgtactcttacagaggtaagttaaataatgtcttttctaaaaaaaaataagaattctatatggttaaacagtgaaatcctcattctaccatagggcggatgcactctaagccctaagagtagagttattggagcaagtcaggggcaaatggcaattcctttctctttttagtaattatgtatacctcccaatcaatttgatgtgctattgactgatcacttcatgaaagcccctagccttggtttacacaatagcctacatgtttccatcactcctcactcttatttatagagcttctcttcccagccccattccctaaaatattagttctccatagggttttatttgctaggtacatgtcacatttgattttggctttctctcacatgattttgagaaagtgacttaaatacatttgcctcaatttgtacaacaggggcttacttaaaaaaactgttaggtaattcactatgcagagttaaaaataatagtttttcattgtcttcatgactctatttgatgaggaaaagacttgctttagcaaactgtgattgcatcttataattgaagcagataaattacaagccaaaggttggctagtttacgtaaaacaaattgtcatttgagcaaaaacagtggctggattttgaatttatcttttcagtatccttggagagtataatactcccatttcctaattacagagaagtctaagtcttcaacagggtcatgtagttacagatggaagaaaagactccagactgctatttcatgttcttgtgctcctcgttattttaatgcctacttatgtagtgcttgtgattcacagtagcagtatttctttagtaattcagagcagtacccaagatttgtgaagactttaggagccactgttggctattgttgagcacttttttaaaggtagtatcagatgacgacctgagctgtgtcctttagatttggtagtagagctattggaagtctttggggtactgtgacatgactattctgtttcccctggacaggtgtatgatggatactgatgacgaggtacgagacagagctaccttctatctgaatgtgctgcagcagaggcagatggcactaaatgccacatatatctttaatggtcagtgaaagccaaggatgtacacttttgttcctcaaatggtgtcttggaagcatattttatgatttgcatatgagctaacttcactaggcaaatgcttggtttttgtctttgagtgcacttccatttctagagaaacctgtgtttataggatattttctaatttggtaatgataattcctatgcagcaatctataagaatatagattgggcccttacattttttaggaacgttgctcacttattcctggttctccttgaactccctcttggatgggtttacatttttcccgttttcttatgctatcattgttcccatatagctaagttgctttcttttctgggaggtacatacattttgttgaaaatgtgtatgctatgctcccatgtttccttgaatgaaataagtcagtttataagtttataaggtaatttcaagaatatcctttatttttatatttaggttataaagcttttggttatatttttctcttccttcagaaagcttagataaatattacaaacctgggcctatttggattcgaggattggcaagaggttataatgctgagatttctctatgtttcacaggtttgacggtctctgtaccagggatggaaaaagccttacaccagtacacgttggagccttcagaaaaaccgtttgacatgaaatcaattcctcttgctatggctcctgtctttgaacagaaagcaggttcactctattcgtttttctgtgtataagtagttttgcaaaactaaaaaatattagcatattttctctaatactcatttaattgtcactcttttttttttttttttttttttgagatagagtctcactcccgtcgcacaggctggagcacagtggcgcgatctctagtcactgcaacctctacctcccgggttcaagcgagtctccttcctcagccttccgagtagctgggattacaggcatgcgccaccacacctggctaatttttctatttttagtagagactggatttcaccatgttggccaggttggtcttgaactcctgacctcaggtgatccacccacctcggcctcccacagtgctaggattacaggcgggagccaccgtgctcagccgattgtcaccccttctaaatcttttagatttaagacatatttttattagagtttaaaaaaaactcctggtttttacataaaagcagtaagatgaaatgcactccaaaatgaagggttttttttaatgcaaagcattacagtatctgaagtcagttgccactgtgcatctcagagcagtaatagtgctgtcgcctcctatttttattttctgaagttgataatctctaagttaattgattttgttattggaggttcgtcttaaaagaatttatgggcgacaatcataaaaaatattcccaaagaatatctaactttaaaacttaaaaacaaaaacaaaagaagtcataaatgtttagtggttagaacacaaaactgggaagaaacaattttatgcttattttcaacattttcagtttttctgttgatataagtaatttttcctattttgatcatgagaagatttttaaaataaattgtttttccttttctgagtaatttttgtacattccagtccatttaaagcaaactctatatttttagggcttactttatgattccacaatatatgttcactaaatacattttaatttgagtgtccccccaccagaagtgatagataacctataagtatgatctagtaatagctcattatatatctgctagaaatgtctgctctcctctctttctgtctgcattgctagcttgatagtagtgggagaagttcacttacttgctcatatctgtctttatagaaatcacacttgtggctactaagccagagaagttggctccttccaggcaagacattttccaaggtatgatgatttgatggttagacgtaataatctttcccctaggcattgtaaatataaaaagtctaccagtcttactcaaattgatcggttctcaatataggaaatcttcgtgtggctgaacaccatagggtatagttgctgaggctacctggagtccatgaactttccagtttgtaattgctaattgggaatgtttttcttttctgtatctcgttggttaacagggaactcattgtaaaataagtatttactttctttttttttttttttgctttttgctttcattaatatataagcttacttacttgaaagatgacttcactaaaacttggggacatattagttgaatgttcaactattagtaaggctatggaaactaaagcattttttttttttgagacagagtctcgctctgtcacccaggctggagtgcagtggcacaataccggctcgctgcaagctctgcctcctaggttcacgccattctcctgcctcagcctcccgagtagctgggactacaggcgcctgccaccacgcctgactaatttttttgtatttttagtagagacggggtttcaccatgttagccaggatggtcttagccaggatggtctcgatctcctgacctcgtgatccgcctgcctcggcctcccaaagtgctgggattacaggcgtgagccactgctcctggccaactaaagcattttttaagcatccagactgaagtctttccctgtcttcttcatagcctacgttcttttttcttgatagaacaattggctgccattcctgagtttctgaatataggacccttgttcaagtcttctgagcctgttcaacttacagaagcagagacagaatattttgttcgatgtatcaagcacatgtttaccaatcacatcgtgttccaggtaagataatgcccttggctgctgtagagatttagtataaactggtatgctttgagacaaatatcctttacctataattctagtttctattatagagaattaatttggcagaatttctggttttcttgcttaacaccagagctatagagatcccttcatgtgatgggtaacttttgatggttaaaatctaaaggacataaaactgaaatgtgtgatgaagttggacaacataaagtataaccaattttctaaaatcagcatttaacatcagggtagattaagtgggctattctgagaacttagatttgacagccatcagacttctgccatcttgtttgagacagcagtctcaggaaagagaaaaaactgatgaataatataaacaaaagacctcaagaataaggctctccctgttgccaaaagaagaatcttaggaggagacctaccctgctctgtagagatagaaggtatagtgggttccagagctgagtagtgggttatgagtaggaaggataacttgttatccttcacagcttttccatttactgacttttcagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcaggtactaaccctcagaagggaggagatacgtgattcagaatgcatttccttgtgagctcttcaactcttcaaatgctcagtttaagaatgtgatgcttttctagaatttaatgatgagtgtttgtgtgtgtgtgtttgtgtgtgtgtgaatatatatatttataaaatggtttactgctgcagaaatattaattttaaaactaaatctctgagtaaaatttgctgaacacttaatcttaaaagagaaactgagtgtgtatagcagtagcacaaaaaggaactcaagctttctgttggaataatgtgaccacttgtgagagttcatatacctggtctcctgtgaagaatcttgaccctcttctcctcaaagtttctatctagttagatagaacttggttatgtagtagattgttggcattttaaaatacatcatttttgaaggtcctgtagcataaggctggtgtctgagagcatgtctcagcctagtgagtagcttagccaaccatgtgtgtccacattaagaagggcttttaattccctccttgacccatatgcagtctttgcagggtggagaaatagcccctaaaagacagccaactagtgccaatagtagtatttacttatttggagacttgggaaggtgaatgtcaagtatttattctacttgattccccccatcatcattttcctccttgatttcttctcttctcatgttcagtgcacaatattcgtaactgttacccagttttcacagaaataagcacacacatcacatttatgttttgaacaacttttactgctcgtaagtacaggagaaacagaagttaaaaaattaacaaatactgggaaagttacagagttacaataaatcataaaagcactagtaaatagttatccctggtcatcattcagttacatttggggcttaacctgctttcttttagcccctctccaaactcccttcttagatgttggttcctgggagcccctgtccagtcttatctgtgttgggtgatagactaggctactcagactctagcacgaggtagattcacgttggcaccactgctgtgtctgaatcccagattgttccctctggccctgggtggaactctacttctattctttagccaccctggatccataaccccctgagtaggaaggcactttcctatctggcctccaatatttctcctttgagctcgaggctatctggctttaacctttaattacctcctttatccctttgtgaggtttctctagttccatttccttgtaacttcgctttctctcctggtctgtttttctctccagttagatttgtctgaaatatgtccactagccagtaattaagctggctgtactcttaagtaaagctagttttatttacctttttctaaactagtatttgggcccaatcttaatgtagtcctgtggtttctaccattgtctggagagactctgcacttcatcagttcttttccagtagccatccctccatgtttcaaaattcctcctgctattctacctctcaccaatgtcctgttttttaagggatgctattactttgccacttaatttcagagggaagtgaaatgctgaacccattgaagaatcaatcccttgccaattgagaatactagctcttcccacttccccaggttcattttgctaactaataactcaggtggctcacaccccagaaagtattcttaacggaatctaagaagtataattttataataccaaaatacacaaaacaacaatatagaaattacatatagtataggaaaaaaccaacaacaacaacaaaacatttccaccaagagaggaaaaagaggagaggttttcttgcccctcttcactaaggagttttaaaacatagatcttacaaattagcccagagatttcaacatttggtctgctggctatggactcttttgcttgatggtttgtttgatttttgtttataaaagtttggcatttagggaattgtttaaagttttgttagtagtaagtttatatttgacccatcatatacctacttaaaaaacaaactcctttctatttagttttttgtcagaattctcaaatttttaatccatggccaatctaaagtctatgctgtgcaatggaagaagtgaaataccagggcatagatggtaataggtatctttcacccattccttcctttttgcattttcccatcacagatattccaaattttacctgtcacctcaaggtcttaaacatcaatatgtctcatttcagaaaaataatatttttccttataatcgcagtgaaaaaacagaaattcttggtttgatttccttcaacttgaaaacagtatagcataatagaagggaatatgggtttgatagacagatgaggatttgaatgctggccctgctacatactgactgtgtaatcgtggacaaattatttgatctcttaggactgttataggatgaaatgaaatgaaatgaaatgaaatgaaataataggtaagttgcttcacatggtgccagacacatagaaccttttggtgtttaattctagaattatccactttcttcctttatcctctctaaaatcaagtcttccagagttcaaaagacacataccctctaatctcttccagaaagttgttccatcaattattcctttctttgatctatctttaatctttcctactcccctttactttataaatgtataaaaatctaccctatctgaaaaaatttgctttaacccaacatcaatatattaccataacaccttctcgcaaaggttgggcaatttcttgaaagactatggacatcctaagtctctatgtaactagtcctacttattatctttcgtcctcccagaatttgtcctttacctaaaaagttttagaaaagcctttaaggcaacattccttctaagcattcattctctttcagcagctctgtttcccctgaatatttattgcacccgtaacaatatatattatatacacaacattctaccaattattccccatgtttgacctttttaatgcaactaccaacttaactttttattccactacctattcaaaaccattctaatctttatattgcttttatttatcaggttttattgcatcatatttcttgttatctggaaccatttcaacaaatattaataacttattttaaaacagtctttaatagaaaatattcatactaagatcagctgtaacagtacatgtatgtgagtttattttctctgattttcactggaaatattgcctgccatataatgattcataattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatattaacttggcattctgtactaaaaacacaacttcagttaagtaagatttgcctcagagttttttactttaactcacctccactcacccactgggatccatattattaggctcagtgaagctttgcattcttctaagccaagcatttaatctgaattttaactcaaatactaaaaaaagcagtattggtagaacatttgattcagccaccctttccccttcctttatcactagaatttgcttcagtctggctttaaaatcaatattcctgcagtctaacccattgaaagatctgccaggattctcaatctgagatttccttatttacccactcatttgtcacatacccagtctgccattcctcaaactcactgaaatttccctcatttcctttcaagccatctttctaacctatttgataccccttttctaccccatcatcttcaatgtctctaatttttgttgctgacttgacttaaatgatcctatctctacagaatgcaacttaatcatggtgtacccactcatttctgccttttgccttaggggaaaaacaaaacaaaaccctgctctattggtaacgcccagtctttgttcatctgtccttgaaattgattcacaatgtgaatatgtataagcttcctcatgacccacctccagtgttcagaacacttccttcctgttctcttggtgtccaacatacttacctgcatccttagctagtagaactgacattctgaggattgctgatgaagctcatccttcagactccgcttcataaacctatctctatatgggaccgtttattctcctgactctaagcattcatcaagtgtttccctcaaggagctttaaggaagccaccaaattccctaatgacaagttctttctatatagttttcctctttgccattattccatactgtggatcaaggggcaacaatacccaccctaccaactctgacattcctaaatcccaaagtggtttaaactgtatactgtccccttaatttcaatcttgttaaacagagtaatacttccttctcattttggctctgctaattttgttggagaccacattaaacacatagtaacctatgtccaacccccacacttgcaaattttacattgttaattgtttgctttcaaaatcctgaccttcagtgattgccaacactgccttccatatcagttggggttgctttaccatcaccctctataaggtttcttctttttctgttttcctattcaatgaagtagttaccatgacaggtaaagtgttgttaccccactcgcttgtcgtctaggatttaacttctattccctaaaatgctcctacactcagccatgataccgaacataccactgacttgcccctgagatttgccagtgcccccactttgggaactctgcattccaccttcccctattccatgtcagcccttttactgatgctaagccctgcacaaattcataaggttatctcccctcctacctgcctcctgtcccttcttttaccataaacttccgtcatcaaatttacatcccaataactgccttagaatggctgccagactctctcattccatgtggtatgccagtgtaaatttgcacagtctacacacagtgttgcctcccactgtcatcttccagaaactccttttcatcttcaacatccagtcctgcatgccctgccacctccaagtcaatccacagactcaggaatctttcctgaactctgaccccttcctgccctgccccccactgatgacaccactgccagcttccatgtcctcaacctgctgtactgagtccatctgctgtctcagttcacccctaaccgtcctgtattctcagttctgcctctaaggaacagtggtttcctctctctgttgtgtcctctggcctttcatcgtctcgccatgccctttattgacacacggtcctcaatgtttccaaggtgccaacacctctacaccctgtttctgtggcctcatctcacctctccttcattccttccgtgtcttacccacaccatgctttctcctccatgacctgcatcaaacacttcgccccttttgggcaaaaaggaggattctctacgttcacacccacactcttgctcttggcatgcctcccttgctgcagtacattccctgatcctctcaacaagctcacctctgtaagctgctggcctccataacctgctccaactcattcttcttgcccattggggaacacctctcctctgtcctgctctcccatatgctgcaaactcaccctctgctctcccagctcccagctcctgggcccaggttggtcgtttctcctgctttcctcctctactgcatagcacggtactgtcccacctgcaccatgctgcgttctctcagcaccacctgtgattctgccactggcctaattcgtgttctcaggtgtgtcctcccttcttgacctggccccgcacccactgctccaccagatgcagtcctctctgtgtcacacgtactgcactgaatccacacgctctgctgtccaagctcacgtcccagtggcccaggctatgagtcctttccagggccccacaaccctgactcccctaaaccttcctgattcttttctcatcctttctttcacactgtggaaaaacactctggggagcctctgcctctgaatctcctaccttcttcctgtcaccagagtagttttgtctttgtcactcattcgtgtcccactttctgcccatcctcgtccccccggtacgaatgcacccagtctcaacctgactctcctgccctgcctgagacccagctcctctgctcctcctgggtgctcctgtcagtcccaccctcctcccacctcctccctcctccttaaggcccatgtcttcaagacgctctccttccacactgtctccatttccctttgcaccttccctccccgtgacaacagatcccctgctctctgctctcacccgcacagcccacttcctctgtgtcactgggcccctatcttggcctcactcctccacctgagtcctcgagtctcggaccgaggcgctggaaatcccagctccaccaccatggtcccggtgccttttcggctacatccatttgctcgctgtcatccttgtcctggtctgtcgggaactgtgtttccacacctaacagtcttgaccctgatgcctccatcagccccgctgcacgtgcatcttcccctcacattgtacatgtctgtccggctctccatcctcccgcgtccaccagtgattctcacccgaggatgcaggaccccgaggaagcctatcagaagcatcttttgggctgggtttcttcttttgctattatctgtgttccttttagagattgtttttttcccttactttttctgagctgaacactgctcacccctctgatgattggataggcctgcctgggggtccatgtccccagccctccctcgggtgaaacccacccctcaaccccagataagaatcactgctgtggacggccaccttgactccctggcctttactctcctatttctagcatttagtattttggtatttccaggtacacttcctactcataagaccagcatttccctccccctgcccaacagtcctggcactctccacttggaaccacctcattgtctgccccatttaccccttaacacacatcgtgcccaaaagcccagtctgcatgagagagttgcgcttctgacacctccacaccccaccctttatgccctgacccatctaatatgactcccaggcactcagttaatacctttggcctcaatctaattttcgtaggcccttactactgacatttttccttcatcatccctcctcttttcatatcactgaccaggtgcccccagagagacttcccatttggtggtcatcatcctgtttgtttcccagaaaccagccctttaccttaaccttttacccttcctgagctactctgttttttcttcttttgccggactcagatgtcttctctagcctgtattcatcaacctcaacactcaacatgtaattgtccaccagctcagatgaataagatggtgtctcaatgcctacagcttggcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcctgtccttcattccttgcttatcttacccacactatgctttgtcatccatgaactgcgtcacacactttgccccatctggggtaaagtccctggattctctgcatccgctccctccctcttggcgcctggcatgcctcctttactgcagcgcatccctcctgctctcaacaggctctcctctcttagctgctgggctccattgcctgctccgactcattcttcttgcccattagggaacacctctcctctgtcctcctctcccatgtgttgcaaactcatcccctgatgtcccagcagtcagcccctggggcgcaggttggtcgtttctcctgctttcctcctctactgcatagcacggtactgtcccacctgcaccctcctgcattttttcagcacaatctgtgattctcccactggcctaagtcgtgaactcaggtacctcctcccttcttgacctggccccgcacccgctgctccaccagatgcagtcatctctgcatcacacgtactgcactgaatccacctgctctgcccagctatcagtgtccacatcccagtggtccaggctatgggtaccttccagcaccccacaaccctgactccccaaaaccttctcaattccctttgcatcctttctttcacattcttgtgaaaacactctggggaacatgcgcctgtgaatttcctaccttcttcctgtcaccacagcacttttgtcatcagcgctcactcctgtcccgcctccacctacccaccctcatccccctgccccgccagcacaaacgcacccagtctcaacctgactctcccgccctgcctgagacccggctcctccgctcctcctgggtgctcctgtcagtcccaccctcctcctgcctcctccctccttagcaccgatgtcttcaagacgctctccttccacgctgtctccattcccctttgtgcctttcctcccgtgacaacagatcccctgctctctgctctcacccgcacagcccacttcctctgagtcactgggcccttctctgggcctcactcctccacctgagtccttgagtctgggaccgaggcgttggaaaccccagctgcaccaccgtggtcccattgccttttcagctacatccatttgttagctgtcatccttgtcctggtctgtcgggaactgtgttcccacacctgacagtcttgaccctgatggcctccatcagccccactgcacgtgcgtcttcccctcgcactccacgtatctgcccggctctccatcctcccacatccaccagtgattctcacccgaggatgcaggaccccaaggcggcctatcagaagcatcttttgggctcggtttcttcttttgctattgtctatgttccttttagagattgctttttttttcctttactttttctgagctgaacactgctcacccttcagatgattggataggcctgcctgggggtccatgcccccagccctccctcgggtgaaacccaccccccacctcagataagaatcactgatgtggacagccaccttgactccctatggccacctggactccctgcacttcagtctcccgtttgaggcctggagccttctttttttttttttttttttttttttgagagaagagtttcactctgtcgcccaaggctggagtgcagtggtgcgatctcggctcactgcaccctcacctctggacttcaagcaattctcctgcctcagcctcccaagtagctgggattacaggcatccaccaccacgcccagctgatttttttctttttaagtagagacagggtttcgccatgttggccaggctggtctcgaactcctgacctcaagcgatccacccaccttggcctcccaagcctggagccttcttgtgcttgcatttactgttgaagatcattgttttgaagggccagaatgcccctttatacctgtttttgtttgttcgtttttttactacttctttcatgtgctttttatacttcttacttagcattttttgtgtttttcgcattctaactaacctggtagtcttcccatggaagcactttcttttgcacatttccttttcttctgcacatttccttttcttcctctggcatccttccaccccattcttcccatgcctcgtttctctactccacactcgccctccgactcttgaaaaggatttctcttaaagatctacattgaaactttgacccttcagtacatgaaagcgacctatactctaaacccccttcgtatcggcctgatagcttccacacccgtacaatattttctgttcttattttaatatttcctatccttgaagtttacatactgtgacacaggtggcaagattccacctttaggactgcctccagttactccccactcctcttatccccatcatgcattctttttactgtactatagtattttcattatcttcatactgttaatccatgcatctttcctatcttttcattattattcaggatgttttcatctcatttttggattttcttaaagactctcttagtcctacctggaagctcatttggcaatccattctgcacctctttttctcttctttgacactttgaagcccctgtgccactataatctgtttaccactgtctttctggtgcagtgagcagccctttctagatgtggatgtgcacccttcaattccatttcctggttccctttcccctgtctcagctcagttcctctactcatttctgaacttctttcctcctttttggaatcacatttaagtatactactcaatctacggtgcctctccaccttttttgtttttgcctttttctaatattctactctgatgcatatagttgtcttctgacttgcttcttttctacctcaccctttttcccttccgtatctttggtccatctttaatcatataactcttttcttaatttatgctcttgttcttctgacctcattgtttctgggtttccttattgtgaagctgatttgccctgtgtttacttaagttactctgaaatgttgccaaatccatgcagtgctctttttatttagtgtccatcacttgttttcttccttgttccatatgatacgattatagtggcaaatcttattttttagtatgtcatcctcgcatgacttttcccatcctaaggtaaattttaaatgccttttccctttattctgttgtttttctttttctgccttggaagagcacattgttaaccacccatacactgtgtgtcactcctgtgtattcactaagatcttgctgtcaggcacctccttctgttcgccattcactgctcagtccctttcggtatttcttctttccagcatactgtgctgaactgctttagttctctgtttgttccttggtaggatgcctgccacttgccttgttttatgtccacttcactgaatgtgttgctaatctttctgtccgttgcactttttaatgcaaatgtactttcctggacactgtctctcttatgtccaatttttagttatcattttatcttgtccctttctttctcccttgaagaactgcctacacagttttcttcctgactcgacttttcaagtacaagcaattttcattatcctgtgtgcttgaataataatttttagtagcaaacacttacattgcattatcttaaatttgaaaaagctcttatccatctccctttaaaaaaactcaacctattttctcagtcatcactaaaacactatgataaaagaaaacttttaagtatttttcataatatacaccattttaaaggataatgacctaattatttaacatatcatcagttcattagcagacatgtttgtgtgtaatacaaaatggtctcctactataataaagactataattgcatttgccttctatactgcaaggaacaatggaatgttttcaatataaataacaaatgcatatacatttttaaataaaatataaaaacaagaagttttttggaaatatttacttaccacctgatgagttgcttgaattgtcccgctcatattatggagaagatgacaggaataatgcataacacatttaacatccttcagcatagggaatgagcctatcagcacaagaaccacggcaaaaatatgccatctcaagtaggcttgggtgcaagctaaaagtttttgttagcacaagaatgctaactcactgcaccagattttctaagtacatggtgagatgtatatataatgtaaatcttttcatattaacaagtatttaggctgtatgagcagatagctggtgatatctgaattcctcattctggtctcaataatatttgctgtttcataccttgcatattccaaacccagactaagtcatacatttttttcctccaaccaagcatcttctcctctcccttttcctttttcttttttatatacacaggtcttctcagttgcttaactttcagccaatcctaacattatttcttaacttcttggccaatttaacatcatacttactgctatgtccttttgtaactccctttgaatatctgccctgccatatcgtaaatattctacaaatcatttacccactgactctataataagtgaatgctgaattattctctggatgttaaccttatcatgattcccaaccagtcctcaaccagtagcattcatttgttctacaaagaatcccgatctatacctgtcaatcctcatgtttttaaggtttccaccaatggcttcttatcagggtttatcttaattcatctccttctaaccttccctagcaagcagtcacttaagaaataaatttcccactaagacttcaagtgccagcctatccaacttctattctttttcagactcctgatcttttctcattctgtatacggttcttctgcaatctgacagttctgtttctttaatttatacttgatctgtcttattgtttttccacctactcaaaactgctttctaattcatacaacgtcccatttattgacttgctatcctctgtttcttttttctatcatgagctttggcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtgtattcttagggactcaatgggttcttctggatactcccctccccatgggcactcgctgctcagcccactgccctctgccctgtgccacattctccactgtatttgtctgtgctctcagatctgcctacactttcataggattcttgccactggcctgccctttatgcccatcccatttagcctctctcacctctcaccatactgaccaaacccattacttctaacatttttccaacaaagcttcctgggacagcaaaaccttatgccctggctcttactttgccaccttcttaccttactctctccttgttaatacacaactctgacaaatccccaactctcatttcctaatattcccatttagccctctttaatgcccttccatatctgttgtttttctgcactgcatgttctgccccctacctcattcacacgttctctttccctatttagcatccaacctccatcttttgttctctccttctttgcgatttttgcatataagtctcctcagttgcttctctcacttttggcaagtcctaatatgttttcttaatttctgagtacatccttaatgtccctctcagaacatttttccagatttccctttggaggcttcccctgtatagcctaacctttcatagtgatggatacatattctttttgaggtttcctcccctcatatccccactgtctccctcattcaaaaccagttttctactcttcagataagccttcccttccccttagatagcatctaacctggcttctttattttccatcatgacctttcgcccaagtatggtgccaaatacctccagttagtatcattgacactttttttggtcaatactaagtgatgccttctcgtctggaagcaattttaacttcactattgtacacctttttattttgccttataaaaactatattcagtatccctccttcattcagagactgtgtatgtcagttccatagattcagtactgtcttttggataaacagacccctcacactcaacactcactgttcagactgcacactggatctgagatccacagcttcctgaacagtgacccctcataacctcaattcttacctagccacgttctctccttcctctgtctacttgagtggctgtgactggattaacataaaatcactctaccagagttgctactctccctgtcccagtattcctcatcctgtcatgcttcagtgcccttcctcactggcctgcttactgtgctgcaagttcagcctccagcctcattcatttatcccttcccttttgtaccctccatcacctccattctctccatctctcctctcctttcattcaagtctcttcagttgcttcttttaattttcagctgaccctaacacaacagttgctagcagaggctctttatcagaattgttcctagcctgcctttgtctaaagcagtggttctccaactgcagctggttaaaacaagctgcagggccttaccccaggatgtggtttggatctgtatccctactcaaatctcatgtcgaactgtcatccccagtgttggaggtagggcctagtgggaggtgactgggtcatgaggccagtttctcataaatggtttagcaccatccccttggtgctgttcttgtgatagagttcttacacgacctgactgttttcagtgtgtggtacctcctcccactctctatctttctcctgtgaagtgctggctccccaccattcacctgccgccatgattgtaagtttcctgaggcttcctcagccatgcttcctgtacagcctgtggaaccttgagccaattagacttcttttctttataagttacccagtcccaggtatttctttatagcaatgtgagaacagattaatgcaccctgagtttctgactgactaggtctgggggaggggaaaagaattcatatttctaacagattcctagatagtgccatgtaacacattctaagaagcattgctcttcaacttctccctcaaccaagccctttaattaaaaatctcccactaaggcatcaagagcgagtctactgactcattcctattcaggtctttccttctctcccatatactagtcactgcaatctggccttacacccactgaatttggccagttgggcccattctgagatctggcaggattctccaggcatctttatggcgctgtggtctttcttattaccacgccaccttttcagaatcattatctagtttatttaatgctccccttagctttaacccctcttcatttcttttggcccaaatatgggactgtctctccagtcagtcctgccattcttcaaatgaccttttcatctggagtcaactttaatgttttcttctattccttttctccttgttacctatcttgccctaaagatgtacgctaccttatcttcagcctcccttcttttagctgctgtccatatttcattcagatggactctgtctcctcctgaatggcacttcctagccaaattctctctagtgtctgtctctcatctgtagaaaatcttcacatgacagagtaacttctaagagtaactttaataccgcacttacatgatattcatttgtttctcccctttggtgatttgccctcccttaattatatagagtaaaatttcatctaccatctgtacctggaaacaaagaagtttcacccttgagatgggtttccaacatgatctccagccactcctcttccaatattagtcatccattctacaaactactcaaagatctatcctggtgtctttaagtgctgccctattagggctcatcttaatccatctccttctaatccttctcattaaacttctcacaaaagcttcgcattacttttcaagcacttgttcttcttccattgtatctactgcttttcaaagtctgcaattaagagccaacatttgactgaataaacccacattttttaagggtttacaagatttcccattctgggaaacactttcctcattttacctgtccatgccactccacctacgcttacctactctttgtatagttctccctttacacagtttccagtctctccttatttaatcttacacttatggggccgtatccctccagtcaatacctgccaatcttcaaatgactccgtctcttctgcaggctcttccactattttccccagttgaccctagtagaacaactgttagtcacttgttttttcagctatcatcttgtgtatcattctcatgaatttagtcttttcttcctcgtcacctccacactactctgaaaacacttgcactttcagttcattccagaccttcatagggttcctgccactgcctatggcaagaatccattccatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatgttggccaggctagtcttgaactcccaacctcaggtgatccacctgcctcagcctcccaaagtgctgggattacaggcgtgagccactgcacccggcccatctatagctttttatcagcattcatcagtttataactttcctatcaagcaagtcctttaattagccattccctcaaaagctttaagagctagtctgctgctgcctcctactgaattccttgctccttaaccctttctgtgtatttcccatgcagccgaccatttagacctagacaggataccccattctaaatctttattccacacctgctctgccagtaggcccttccttatgtaatattttctttcctttgcttccagtctcttatttcatactctcttatgacttttggcccagcaatgctgtcttaccttcctgttgatgtgtgtcattccttagtgaccaactccttttcatctgaggacaactctaatgttgctttccagtaccattcctccttccctttctgaatttgtcctagagaaaaactccctcccaccatttgtacagcattcccacagactcaacacgattttccaggtaggtgtgtattgcttattttggcactcactgcccagctttcctcgatgtcctacacactatgctgcacccattgcttctcagttcagtccagacctgcatagactgctgcagttagcctgtacagatccatctcttttgccttctttctaatcttttgccctagtgacatacccttttctttaattattattctaacaaagctttccggaaatacctcataagtgtctcttactttgtcatggtctcccccaggtggttgagacctggcagctccctcccacctttcccactctgccctttgccacactgcattttctgtaccctggcccaactcacatgtccctctcctgtcttagctgccagcatctatcttttctctaattcgctgggttcttttcatacaaatctccttagtggttgactctcattttcagtgaatcctcacaagacaagcttaatttcagagaacagttttaatgcagatcttcagggcattctttcctgattctctttggtatttgccttgctttgtctgtgtaactctcatatttacattatggcagtgcattcagtattttcttgctatggaaaggcccccgcatcttgcctcctcgccccatttcgtcatcctctccagcagcttcgacagattactgcctagacttccttagatccctgtaacctctcattgtatcaatcaaaccatttaagtaaaaaaattcccaggaacattatctctactaacaccattcctatttacttccttaatctctttctctgtatcaggtccttatatgtaagtgtcttctgtctttacctccacataaaactcagcccctgtgcccagtctgtgatctgccttcatacctgatgttgtctctttgtcctcctcatttgctgtagcctctctgcttaattggaaccacactgggttgctataattaatgtctctcctgactcttcattctaacttgatcatgaccttttcccctaccatattctgtatctctttcatggtttaaaaaaaatgcctcacctgacctgttctggccttgtgttaactttcacttctttccccttctctctgaagaaaatcctatcctaattaaaccacagtcgttcttttctcaacccctaatggcattgaaattgattctgcaggcttgataggttcattctttcctatatgggaaaacccactgccatcgtctgttttcagcatattctgttgaatccatctgctctctgaattcagacccattcttcatagtccccaccagtggcttaaattaggcaccttatctagcttatctctaacctttcaatctcttgactgcctcagctcaccagagcctgttggaaaatcatttgaaatacaaggtattttacaatttattcctaaacaaattatcttctcagcacctaggcattagcatgcctcttactgtttccagctgcccggtggactttctggcctctttccttttgcctgtttgtacatcttcctctgcttgccaaagctcttttgcatcttttgagagccagttaaactattatatcgtttcacattttttacagttttcccaggctatttgttaatcccgcaccctcacatggcactctcttaaaacttaaaggatctatggcattgagttgtaaagtcatagatagatcacacacacacacagcccacacacttatttaactcctagacagctcctagagacagagatcatgtctcagtcatctttttatccaagtgtctggcacataagcttatacctttacgtgtaatgtcaacatgtattgacagtcactacatgtgtggatggatgaatggatggaatttaaagtcaagactgagcagatgaaagtcttattacccaatctgtcgtatatggtcttcacatctgagcctgttctttcctctccttgcctatcccccaaataattttttaactctcccaatatctaatattttttgtacctataagctttttccagaccatagacaagatcctaaatgccttttcttcatccctgcttgctaaatcccctccttcaaacatttcagaaaatactgtctttactttttataaagacttcactttccaaaaatgtacccccacctccatttcttattacttaacaccacttgtgtgaaaacatacaactgcccacttgcttttccatttaagacactgactttaccaatagtagaaactcattactgacctactcactttaggctgaaggttgacagataaagcaagttctctctggtgatctgtggacccgccatcagtccacaatctaaagatagtattgagatgctgatgagattggtcaatgttaatctgatgatctgtatgctctttaccacaggttttttttttgtttttttttttggtcaggtcctacagcagtggttctcaaaatatttatttttcaacatttaggcccctttgataggcatggcaaaaagcccccaaaagtacctctctgctgctttcttcataccaatagagaaacagtctgcccatgttatcatttctgtactgctgtaacccacagcgtggaatagactttacattcatgctttgtgagactgccttcctgacccgcttgtaggctgcttttgagaaccactaccccagacaacagggcatgtgtgtttaactggaaaatgtggaacacagtgctgagtacagatggcacttcctaagaaatgatggaaacgtctcccttgcactccccactgatgcaggtttgcctcccttcttctccagttgcaggctcctttagctgcaccatgaagtttacagtccgggactgtgaccctaacactggagttccagatgaggatgggtatgatgatgagtatgtggtgagtcttcccagcatagagactttctttgacaccttcacaacactaagtgacttctgccttgagagaacatttttctaggagcatctgacataaacttaagggatttctattcttctgaaacagatgacaaattaggaggacctggactaaccctcctctgtaactggacagcaccaggccagagagaattgagatttaccacttcatcattaaaacaaactcacccttttttttctttataatagggataattaagagatgaaaataatgacatgattttcattgagatcagttttatttaaaatgatttggggagggggttggttttgttttttggttttttgtttttgcttcagcagctgttagtttatagccagatcatggattaaaaagccttcacagaatggagggaaaactttttttaaaaaatatcaacctcttagtgaatgatcagagggtaccgtgtgcccagaactcagtggtcaagtgtgggtgcaacatgactactctgtacctcagggctacagatgttgatctgaggctcttgccagatgttctgttttcttgctttcctttgctaagggctacaacattagatttatccagactacagaacttaaactattttggtggtagagttttctctaggctccggaggaccatattgactagttcctttatctttgccctataacagaaaggacttttctttactgactgcttattacccactagctggaagatctcgaagtgactgtgtctgaccatattcagaaagtactgaagcctaactttgctgctgcttgggaagaggtgggagatacctttgagaaagaggaaacctttgccctcagttctaccaaaacccttgaaggtgagacccattttgctatcagtatattgcctgataacagtataacacctaacaggcatatttgttactccagaagaactcctttaaaaaaaaaaaaacttcataaatctcttacttaaaaggccagcaccctgtcttcatcatctaattgatcagccattttctagtccagtagtagcctccctctacacatcaccaacaacccccttcaccaacaaacccttccaccccagctcccagcatacactggtgcagagggagatccctgtgctttactttcctaatactgtctcatacatcttctcaacacagaggctgtcaacaatatcatcacatttctgggcatgcagccatgtgagaggtccgataaagtacctgagaacaagaattcccattcgctctatctggcaggtaagaagcttccatcagattttccttccattttcttgcaaagcttaataataggatatagatgggcatcttatgccttgctgttgtcccatcatcccattatatgagtaacaatttgatacccagtcaaaatgaataatttgttttgcatgctattcttggttattcttttaagatgtacatttggcccaaaacaaatctctccaacagataccaaggccaccaccaacattccttttgagtactccaaattggtatttttgaataccttctatgtacctggtttcatgggaatataaaaatatatatatttggaatttatgtttgtttaggattcagtttccacaagtctctggaaaagctaaactaaactaatagaaaggagatgcagggatagcatgataaatttcattatccagtgcttgttttgggttcttaatatggttttccttacttttttctctcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttcaaagttgttatacttgaagttgctaatttaaaaaaacgaattttaaataatcacttaataatcctgctttgactaagacaatgaaatgtggctttaaaaaaaaagtattcagcaccatttgctcataggtctttcagagtttgttcttaaagtttctggaactttcctgtctgtaaagtaacaggaattactgagctacattggaaagcctctctgggacaggcagtggggagttaagcagtcatcataaaggaatcagtgtacattcagcatggtgacttgactacacaacaatcccttcccctctactgtagctcaagagagacatgcttctaaccactgaggtatgaggagtctcagactgttatttgctgttagaattggtcttcccagctaataacagtacatctctggcacagatgctattggtccttaatgtcctgtgattttaggaaatagtttggatttagttcaatttattcagaaaccaaacgtgtttaattagcttcactactctggcagagtaagggtatgctggtttagtatctttataaaatatatataatgtataggtaaatcatagtcttaaatcatacctaaaatactgtatcatttaaaccaatatctattttaacaaaatgtttataactaaaaacagctgatgaaacactaaatccaaaggtatgacaaagaggactcagctctgtgttgcttaaagaacttttaaaaggcatgtgcccataacgtcattcgaggagagggaaggagccccccttctcctcctccttactatagaattcctgttgggggtgggccagaaattagcacttctaaatatttcagagaagtccaaagtgttaaaaaaagtcttttatgcaaaagaacgtctttctgcatcagtgaatagtaatgctcatcagaatttcctaatagcacaaaaaacaaagccaagtctatacatttgatcagatatcaaagtaatgggaggtggactattatgtcaaccttagtcagagctcctgctggcttcttcctatacactgttcaccaatttgagtaaagtggactttgtgagagaattatgtttgatggccaggacctcttttgggcatttcttcctaagtggaatacacaacagataagggagtaggggaggtaatacagggaagctactctttccagctcagaaggagttgatgaagcccatatatgcattcaagaagcccatgggatcctctagctgtggatagtggctaatgtggtcatccagaatcgacactgtggaccgcggcagcgttttcctagtggaagagaacagcacgcaggtgaacttgaggctggagcgggagggatgtaagccagtgggaagccccagtaaatgaccctgtggacacaccacactggaaggagccaccaaagagcttattcaccttctactctgaaattgtatcttaggcagataaacttgccaattccatttatacaaactagtttttaaatgttcataatccaacaaacaacaacttgaaaatataacacttttgcaacaattgtcaaagcaagatgactttcagctccttagagaaggatgaagcatcaaacaagtggatcacacagcaactcactgcccaagcagagataaccaaggatcttcccttaatcccaggaggagatgagacagggggtattttatttaaaattatatgcaagctgtttactactagcttgtatccagtaggccacaggaaggtatggaacattcttatgtgacataatcaagatttcatattctgataccttccaagtaagtacctagagagaatagcaaccaatgagaaggcacttttccacaatgagctcttctcaatctctccttgccatctgctcagcctaaaccaatgaattggctttacaatcagactaaaacaaacaaacactttgtaggtatatccactttcaacctttgactcacatgagagctttttgtacaccaaggaatatgta

SEQ ID NO: 12907 - DNA, 25260 bp, Human; identical to SEQ ID NO: 11985

SEQ ID NO: 12908 - DNA, 85854 bp, Human
ggctaattttgtatttttagtagagacagggtttctccatggtgctcaggctggtttcgaactcccgagctcaggtgaggcgcccgcctcagcctcccaaaatgctgggattacaggcgtgagccatcgtgcccgaccaaacgtacctatttcccccccccccccgcctccctgagacggagtctcgctctgtcgcccaggctggagtgcagtggcacgatctccgctcactccaagctccacctcccgggttcacgccattctgcctcagcttcccagtagctgggactacaggcacccgccaccacgcctggctaattttttgtatttttagtagagacggggtttcaccgtgttagccaggatggtctccatctcctgaccccgtgatccgcccgcctcggcctcccaaagtgctgggattacaggggtgagccactgcgcccggcccagacgtacctattaaagagacatcctggctgggcacagtgggtcacgcctaatctcagcactttgggaggcagaggcgggacaattgcttgaggccaagagttcgagaccagtctgggcaacaaagtaagaccctgtctctacaaaaaaaataaaaaataaaaggtagatccaattcattcaaatagtattcactagcacctacaatgttccgagccaggtgctgagtatcatgggagaaaaaaaaaaaaagccagagtcacagctctggcagggcgtggtggctcacgcctgtaatcccaacactttgggaggccgaggcgggtggatcacctgagatcaggagtccgagaccagcctgaccaacatggtgaaaccccgtctctacaaaatacaaaaaatagccgggtgtggtggcgcgcacctgtagtcccagctactcgggaggccgaggcaagagaatagcttgaacccgggagggagaggttgcagtgagccgagactgcaccactgcactccagcctgggcaacaagagtgaaactccgtctcaaaaaaaaaaataatgataattttgggaggcctaggcggtcggatcacctgaagtcgggagtttgagaccagcctgaccaacatggagaagccccgtctctactaataatacaaaattggccgggcgtggtggtgcacgccagtaattccagctacttgggaggctgaggcaggagaatctcttgaacccgggaggcggaggttgcggtgagccgatatcgcgccattgccctccagcctgggcgacagagcgagactccgtctcaaaaaaaacaaaaaccaaaaaccaaaaaactaagtacgtcttttaatctatttctccaaagaagcttctatattctactttccagccagcccctagaaacaagcagtatacttctacccagatctcaaccacactcccgcccagaagttaactctggggtgagcaaagctggcccccacgttgtccttccgcagaacctttggtagggtaagctcccggggccacttcccgccaacccctccctgcagcccagccccacccgcgcatccccgggcgtggccgagcacggcgcctttaagaagggggaggcgcccaagaggaaagacaaagcccctggccgcgcgctcaccctccccctccggcgcaccacacggacagtggtgcccggatgtcggtgtcgccgtcggtgacagatggcgcagtatctgtatatgcgaggggcttctccggcttgacctctttgagttctcgtcctctccatcccccgctgtcccccacttttaactctgccgtcggaggcccgcacgcctatcacgggcgcttacataacgtgacctttcacctcttcagactgccctctagtgcgctgcaacccaactacgcgacaggggcaggggggcgggacccaggcgcggagcggcagctcctccgagccaataggctgtgagcgctgaccagctctccgcctattggagcattcgccaccggcgccacgggggagcaagttagtgtgtgcgttggccgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggagtatccttttccagccgcgcgggccgggctgggccgggctgggccggggtagggcctggggctcgcgagaccaggtcagccgcgcatccccggcccggggcagctgtcagcgcgccccggccgctcgcgggcctggaggctgagtctcagcctgcgcccgccgatccttccaggggatccggcggggggcgcgcaccggccctggaaggagaagggcccgcttcggccgcccccggggccccgcactttgtcccggggcctcgccggcgaggagcgcatcccccatccccattaccttccccgggttggctttaggccttgaggacccgagagggaggaggaggcgtggggagggggagctaggttttctcctttaatttttacaaaaattttttaaaaatttaaatgaaacctgcagcttaagttttgaaattgtactcgcgcggcctcgtgatgcggcgtgtgcaagactcaactgcgtcttaccccgatctctgcggggatacttggcgtttttttcgtctcccgaggggactttaggccggggatgaactgacaggaccctggggcagaaaactaggaatgagattccccgcttagaggaaagggagggaaggaaactgcctgtggaggagctgatgcctgccttccctgggcagacacaggtttgaaattttgaaggtttagaaggagattggtatttgttaaaattaaacaaacaaaaaaaccaagacgtgaagtttttatgttgtattttaggaacatgaaattggatgttttacaaaggaagcatcctctcgtcatgactaagatttcttgcataagcattatcttttagtgaaaagttgtgcagcttttatttgcttttttttaatgggtgccagaagaatcgtttttgaggcttatctgtaaaaaaaacaaaaacgatttcggaatcaagcatttctttggtgactgaaagctttaagagtgaaggctaatgtgttatgagttttctcagccccttctgttcggaaggacttcatttctcagtttcttgcttgcttctgtataggaggaagtgtctctcagagttatttcatttctccctgatcctcactttaacgcagtactttagaggataatctcattcttgttggagtgcaatttgtgagtgtccctttgtggggagtatacacacaaaggggcctggaaaatcagtccatgctggaggaaggctcttggagaaatagagctgtagcatcttggagctgaagtggatcttggaggtggtcgggtcctcgggcttggtttgctgagttggcccagagagtggaggttgacttgttgaaggtcaaatgatgaaagaggagtagaatccaccgctcttcctacctcatccctgtaagtcaatcaacagaagaaggtggaatgttactccttcactttcaattaatttaaatattacctcacttttttgtcattatggtataaggtaaggcactttaaagtggaggggtggtgatctggtttttttcttgtcctgtgaagacttggaatgttctggagaagttccactagctctaccaaatactgcattataccgaagtaccccacttttttttttttttttttttgagacggagtttccctcttgttaacccaggtggcagtgcagtggcacgatctgggctcactgccatctccgcctccagggttcaagtgattctcctgcctcagcctcctgagtagctaggattacaggcgcgtgccaccacgcccggctaactttttgtgtttttagtagagatggggttttaccatgttggccaggctggtctcaaactcctgacctcaggtgatccgcccatctcggcctcccaaagtactgggattaacaggcgtgagccaccgcgcctggccagtaccctactttttaatacattcgaatcggcagtggagtagcaacttgtgagaatccgacatatacttttccaatgtcattaatgttttgagccgttgatggatgctcacacactttcagatgatactttctcaggtctggttctagcagagtataagaaacatgccatagagaagagacaatttctaagtatatttcaggtactgagctatgtaaaaaatggctgtaggaagttaatttaggactggcaacgcaggctttttcatattattgaatgaatgaaattgaaatatatatatgaagagttttgatggtaacaatttaaaactgaaaccggaaacattttaagtggtatgtatttaataaacattcttcattttttaatttcccataacagcatttaaaactgttttaacaaaagaagtcttaaaacatattatatattggggggaaattgctctttcgggaatttctgcaagtggaagcactttgaggatggtttttaaacaattgtactgtatggttggcagattggcatatttctttattaggctattagtggtttcatagaggagaacaaatatgtggttaggtaacagctgcctttgaagtagtattcccagttctcaacttatatttacaattatgtttttaatgggacttgatattttaattttcttttaatacctaccttttgattgcatgtatcacagaactttgtgtgatattttactgacttaaagctgtatgttggtatgttcttggagtatattgtgaatcttcattaaacttagtggaagttgtgagtaatgcacacatttaatgactaggtgttaaatattggtgattatgttgattgtactgtagctttgtatggtacattacttcctaaggtattcccacaggcaggacactagatcttggaaaacactaactttatcagaatcagttcttgatgtgacactgactgtatttaagtcaagataggttttaggcaggaattggagctacaagcagcgtgttgtagatgagtatttttgttgtgttacttcaactgtcatagtttctaaagcttagaaataactagttcacgacctttgtagcatcattatgtgagaatttattgagggtatgataatgaggggcttattcatactgttaatctggctctacacaagtgtgactagagcatgtttttgttttgttttaagagatggaatcttgctgtgttgcccaggctggagtgcagcagctgttcacagacgaggtggtagcacagggaagccttgaaccggactcaagagatcctcctgcctcagcctccagagtagctgggactacaggcacgcactactgcgtctgccttagagcatgtgttaagagttgagtagctatagatggagttaagttgtagttgtaagatagagttttactggacatttggaatactgagctcttacgttgatttttatttttatttttatttttatttatttatttatttattttttgagacggagtctcgctctgtcgcccaggctggagtgcagtggcgcgatctaggctcactgcaagctccgcctcccgggttcacgccattttcctgcctcagcctcctgagtagctgggactacaggcgcccgccaccacgcctggctaatttttttttttttttttggtatttttagtagagatggggtttcattgtgttagccaggattgtcttgatctcctgaccttatgatccgcccgcctcggcctcccatagttctgggattacagacgtgagccactgcgcccagcctgatttttatacattctttaaagtaatacgttatgccatattagacttgtttttaacttaaagacagtctggagtctttaagagaaaaaatcgagtaagagagaatatcgagtaaaaagcaaatcttgagttggctcactctttgccatcttctgacttagagcacttaggttagttacagttatgcttgtttgactctatacttatctgggccacatcttttcaggatatcaagtacttaattgaaagaaacaatccctgcaagactgaagagaacaaagcagcagcatattgtgataaggaggtagctgatggcaaagtagatacataatgagatagtctaggattcgaaaatatcttatcttttatagcttacacaacctttggagaattgctttgacattttgtctgcaattatatgtgcagcagttgctggaacataaaaacctcaattggcatttgctctgagaggttatttgagagtgagtgacttattttggtaacctaaaatctgaaataggatttagaggcagctgactcaatatccttctgatgggcctttttgccttttcattttcattttttttcttgctttccctttttttcttattcatttatttattgagacagggtctcactctgttgcccaggctggagtgcagtgatgtgtgatcatggcttactgcagcctccaacttcccaggctcaagtgattcttcccactcagcctgctgagtagctataaccataggtgcacaccaccacgcctaatttttgtatgttttgtagagacgagacgaggtcttgcaaagttgccccggctggtcttggatttctagcctcaagtgatcctcccgcttcagcctcccaaagtgctggaattacaggtatgagccactgtgtgtggccttactttctctcttttttttttgtttttgagctgggttattgctgtgtcgcccagactggagtgcagtggtgcgatcttggttcactacaacctccgcctcctgggttcaagcaattctcctgcctcagactcccaagcaactgggattacaggcacccaccaccacgcctggctaattttttgtatttttagtagagatggggttttaccacgttggccaggctggtctcgaactcctgacctcaagttgatccaccggcctcagcctcccaaagtgctgggattacaggcgtgagccaccatgcccagccttgctttctcttaatataattaccagaacagttaccagaacagttacacaaacttaaaatagccgttgttaggggttgtaggaaattcttttacagttgtttttttttttttttttttttttttgagacagtcacagtctgtcgcccaggctggagtgcaatggtgcaatcttggctcactgcaacctccgcctcccaacttcgagcaattctcctgcctcagcctcccaagtagctgggattacaggcgcctgccaccatgcctggctattttttgtatttttagtagtttcaccatgttggctaggctggtctcgaattcctgacctcagtgatccaccccctcggcctcccacagtgctgggattacagacgtgagccaccgcgcctggccccagattttataatcagtttgactaggcaattaattttaagttaatactgtcagaggacattttctgagatgtatacttcaggtttcagtgctgtccaacaaaagtataatgtaagccatatgtaatttaaaattttgtagtactctcatattaaaaaaagaaaaaaatggtgggaaaaaagaaaacagctggatgtggtggtgtgcgcctgtagtcccagctactcaggaggccaaagctggaggattccttaaacccagaagcttgagaccagacaaggcaatgtagtgagaccaccatctccaaaaacataaataaataataaaaaagaaaaccacatttttctctttgcttttgagtggagtctcgctctgtagcccaggctggagtacagtggtgccatctcggctcactgcaacctccacctcctgggttcaagtgattctcctgcctcagcctcccgagtagctgggactacaggcacgtgcaccacacctggctccttttttgcactttttaagtagagacggggtttcaccgtgttggccaggctagtctcgaacacctggcctcaagtgatccgttcccctctgcctcccaaagtgctgggattacaggcgtgagccaccacacccttccacatttttctcattttaagaccaaggctgacacctggtatggttgttcatgccagcactttgggaggctgaggcaggtgaattgcttgagcccaggaatttgaggtcagcctggacaacagtgaatgaaaccctgtctctacaaaaaaaatagaaaaattagctggacatgctggcgtttgcctgtggtcccaattacttgggaggctgaggtgggaggatcacttgagtccaggaggcaaaggttgcagtgaagcgagatggtgctattgcactccagcttgggtgacagagcaagaccctgcttcaaaaaaaaaaaaaaaaaaaaaaaaggaacaaggctggaggggcagaccctgtgtgtgacatgtcttgcttgctagtttgctagtggcacaaagaaagagctagaagacatcatgactttaagcctcttccgggaagtgacatatattacatctgctcacatctattggtcgaaaccagtcacggggtcaagcttgatgttaatgaagaggggaggtacattcctcttcagggaccttgtagacaagccacatggcagtgggtggagatgtaaaaatcctcttatggaaaggaggtgaatagttagaaactaatacaatctatcatatttgaaggttcaatgaatgttttctgggaaaagttatttttgagatctaaaggatgattagaatttagacgaataatagaggactgtatattcttggcagagaaggtgtgatgagttcgtcgtgattgtgtgagtttggaggttttttgtttttttttgagacagattctcactctgtcatccagggtggagtacagcggtgtgatcttggctcactgcaacctccgccttcctcattcaagcagttctctgcctcagcctcccgagtagctgggattacaggcgcccgccaccatgcgtggctagttttttagtagagacagggtttcaccatcttggccaggctggtcttgaactcctaacctcgtgatccacccacttcagcctcccaaagtgctgggattacaggcgtgacccaccatgcccgggctaatcttctttttttagacagtctccctctgttgctctccatcacagctcactgcaacctccacctcctgggctcaagtgatcctcccacctcagatccctgagtagctggaactacaggcctgtgccaccacattcaactaatttttttttaatagagatggggttttgctatgttgcccaggctgctcttgaactcctgggcttgagcgatgttcgtgcctgggcctcataaactgccactatgcagtttttttttttttttttgagactgagtttcactcttgttgcccaggctacagtgcaatggcatgatctcagctcactgcgacctccgtctccaaggttcaagcagttctcctgcatcagcctcccgagtagctgggattacagccgcacgccaccacgcctggctaattttttgtatttttagtagagacgggggtttcaccatgttggccacgctggtctcgaactcctgacctcaggtgatccacctgccttggcctcccaaaatgccaggattataggcatgagccactgtgcctggccggcccctacttttttttgttttgtttttttctggcccctgctttttaaagtaacaactctaggttgaacatcccaaatccataaatcagaaatgctccaaaatctgaaagtttttgagccccaacatgatcgtcaaaggaagagctcattggagcattttggatatttggatttgggatgctgaactagtaagtataatgcaaatactccaaaatctgaaagaaattcaaaatccaaaatactcccggttctaagcattttggataagggatcctcaacctgtaataataaaaacttactgttctctctttaagacatatttgttaatgtatttctcttacattctctctgatgacacagtgagtttttttttttcttttaatagttttttgtaaagtcgctatgttcaggctggttttgaacccctgggctcaagatccccccactttgtcctcccaaatgctgggattgcatgtgtaagctaccatgcctgttggagcttcttaaatatggctaaataatgtgttagaatgttatcaagctttttgaaagcttaaataagtccacttactgattcctcctctgtccttattttactacccatcccttccactcccctagttcagtagacaaaaataagacaaatccgtcttgggataatgtcctctggaagccgttccgttgctcttctctgggtataagtttgaaaatttttcggtgattggatttacatatctgtatatggaagtctgactcaggtttttactcaaacattctatatattttgtttaatcacttagatattagcaccacccctgtaaggaaaatggatttattactcagttttagcagatctggggaaagatccacaatgagcaaaggtgcttatactattgcataaagttactattttggattacctgtgggtttgttcttgtttgcgtttttgctgatcataaccttggaaaaccaagcatctatatttattaaacatgcggctgggcgtggtggctcacacctgtaatcccataactttgggagattgaggcaggaggactgtttgagcccaggagttcaagaccaacctgggcaatgtggtgagaccctgactctgcaaagataaaaaatgtaggtgggcatggtggtgtgcacctgtagtcctagctactcaggaggctgaggcccaggattgcttgaccccaggaggtcaaggctacagtgagccatgatcccaccactgcacttcagcctgggtgacagagtgagaccctgtgtcaaaaataaatacataaatagataaaaatgagctagatgctgcagtgtaagtctgtaatcccagctattcaggaggctaaggtaggaggatctcttgagctcaggagatacaggccagccttgtttccaaaaaacaaaaattagaatatttgtttatttgttagatagtattgtagaggaaactgtttaaatacttttatttcaaccactataaaatgtgtcacttggaatatacaggtattgttcactaactttctacttatgtcagttgattttcttacatagcatctgttgctgtgcttaaaagtaaattagttacttgccgtttgaatttggaagtggctggctgatggtgaattccagttggttttgtgtggaaagttgccatatttacactaccaacttgatgtttttctttccctcgtctccctcacgaagactgtctaaacggctagtaaatgatcttctgaatctcagtattattggagacatcatagagactggataaatattatatcaaaagtactttccggaatacttctaagtattttatgaaatttattttttaaaccagggtagccaatcttttggccatattggaagaagaattgtctcgggccacacataaaatacactaacactaaaaacagttgatcagctaaaaaaaaaaaaaatcacacaaaaaactcataatgttttaagaaactttatgaacttgtgttgggctgtgttcaaagccgtcctgggccgcaggttggacaaaggttggacaagcttgtaaaccctaagaagtaacatgtttccaaggtggactggagggctgtgggtaaatggatcattaatgtatgctcaaggttattccaaactgcctgtgagactgtggcctagtcacctcattttactgtagactgattcctttttttttttttttttttttttttttttgaggtggagtttcgctcttatcacccaggctgtagtgcagtggtgccatctcggctcactgcaacggcctcccaggttcaagtgattctcctgcctcagcctcctgagtagctgggattacaggcatgtgccaccaagcccggctaattttttttttttttttgatttttagtagagatggggtatctccatgttgctcaggctggtctcgaacatctgacttcaggtgatctgcctgcctcggactcccaaagttctgggattacaggcgtgagccaccacgcctggcagtggtggactgactcttaaacttgtctgagttttctgaaaattttgcttaccttacattgttattttttatgacttgtgttttaatgtacctttactttttcttatgagtttttggtacagcgtaagtcttgtgtaatgaaactttggtgaattgaggaaatcacatttgtactaaaatattaattttttttgtaaaacacgaaaaaccatttttattattttttatttttattttttgtagagatgaggtctcatcatgttgcccaggctggtctcgaactcctggtctcaagtgattgtcctgccgtggcctctcaaaatgctgagattagagacgtgatcatcccagtctgtaaatcccatgcaggtgcccagcccatgacaatccattctcattatacttcagtcttagtcatcttgctttgggccctgattccatttttttcatttttttttattttttttagtttttgagacggagccgcactgtctcccaggcttgagtgcagtggcgtgatcttggctcactgcaagctccgcctcccgggttcacgccattctcctgcctcagcctcctgagtagctgggactacaggcgcccacaaccactcacagctaattttttgtatttttagtagacacggggtttcaccgtgttagccaggctggtctcgatctgacctcgtgatccgcccgcctcggcctcccaaagtgctgggattacaggcgtgaaccactgcgcccggcctccaattccatttttatcctctcatgctacacattttaaaaaggagactagatttttttctgtatataagtatcttatgggtatgggtttgtcgtctctgttgcttgcatattgttttcctgaactactgccaacagagagtatgaagcccgcttggaaaggtacagtgagcgcatttggacgtgcaagagtactggaagcagtcagctaacacacaaggaagcctgggaggaagaacaggaagttgctgagctgtaagtaatggaagtattgctctttgccaccatcttcacattgttaggaaaggagggaatattaaccctaaagcagtatgtgtatttaagtttatggggcacaaattagactatattacattagtgtactgtatgggtttctgggttcctttgcctaatggcattttgcagtagcaatatggaatatttatttagttataggtgcacttgtttaggtatttaccaggcctttgagtgttcctgctccatactttgaccttgtaagtactctggtaatgtggtttattcttttttgctttttctttttttgagacggaatctcgctctcgcccaggctggagtgcagtggcacgatctcggctcactgcaagctccgcctcccgggttcaagtgattctcctgcctcagcctcccaagtagctgggactacaggtgctcgccaccaagcccggataattttttgtagttttagtagagatggggtttcactatgttagccaggatggtctcaatctcctgacctcgtgatcctcccgccttggcctcccaaagtgctgggattacaggcgtgagctaccgcgcctggcccttattcttatttttatttttgagatggagtctcactctgttgcccaggctggaatgcaggggcacgatttcggcccactgtaacctctatctcctgggttcaagtgattctcgtgcctcagcctcctgagtagctgggtctacaggcgctcaccaccacgcctggctaatttttgtgtttttagtagagatggggtttcaccatgttagccaggctggtctcgaactcctgacctcaagcgacctgctcatttcggcctcccaaagtgctgggattacaggcgtgaaccactgcacccaaccgggtatgataattaaatttttttttttttttgctagtttaataagtgaaaagtgttaaatcattgctgtccttttgcaacagctctggtgttcaagtcacgtttccaacatgttaacgcttcctggtttccttttttttaagaggcacagtttcgctctgttgcccagggtggagtgcagtggtatgcacatagctcctgggatcaagccagcctcttgcctcagcctcttacgtagctggaactataggtgcatgccacctcacccagctaattattttagttttttatagaggcaggttctcactctgttggccaggctggtctcaaactcctgggctcaagcaatcctcccacctgtgcctttcaaagtgctgggacccactgtgtccagcaaactgcatgtttttttttaatctttgtattccccagtgctttacgtatatttgctaaagcagtgttgttttgctgtgaacctaaaactcgtaaaatgttaagtgtttttttttgtttgtttgttttttgagactgagtctctctctgttgcccaggctggagtgcaatggtgtgatcttggctcactgcaaccttcgcttcccgtgttcaagtgattctcctgcctcagcctcccgagtagctgggattacaggcatgtgccaccacgcccggctaattcttgtattttgagtagagacagggtttcgccatgttggccaggctggccttgaactcctgacctcaggtgatctgcccgccttggcctcccaaagtgctaggattacaggtgtgagccaccacgcccagccaaaagttaagtctttttttttttttttgagatggaatctcgctctgtcgcccaggctggagtgcagtggtgcgatctcggctcactgtaagctccgcttcctgggttcatgccattctcctgcctcagcctcccaagtagctgggacgataggcaccagccaccatggccggctaattttttatatttttagtagagatggggtttcatcgtgttagccaggatggtcttgatctcctgacctcgtgatccacccgcctcggcctcccaaagtgctgggaatacaggcgtgagccaccgcgccctgcccaaaagttaagtcttaaaagaggttaggtgcagtggtgcatgcctgtggtcccagctacctgagaggtaggaggattgttcgagcccaggaggtggaggctagtgagctatgattgtgccactgcactccagccttggtgacagagcgataaatgtttgaaatgtttggaaaagaaagaaagaaatgtttgaattgacttgaattaaatctctgggtaggtgtttctgtgttttcttgataactaattacatttatttagtttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggtgagtgcctgttcgtttctgatttgacttaccatcagaattagagctgtcatcgtaggttacagaacacatttctatgtgtgtaaaactgtgttatatttagtattatatttaatgttaagtattaatactttacgttaatacttgtgtgttttcttggttttgtttttttgagatggagtctcactctgtcgccaaggctggagtgcagtgcgcaatcttggctcactgcaacctcattctcccgtgttcaagtgattctcccacctcagccttctgagtagctgggactacaggtgtgcaccaccacgcccggctagttttttgtatttttggtagagacagggtttcaccattttggccaggctggtctcaaactcctgacttcagatgatccacccaccttggcctcccatcaattattataaggactaaattttatttttatttatttgtttagagacagggttttgttctgtcacagagtctagagtgcagtggtgcagtcatagctcactgtatgtagccttggactccctggcttaagccgtccgcccacctcagccttctgagtagctgggactgcaggcatgtgccatcactcttggccttgaaccaaattttagaaccacattcatcactgagaatgttttagtattgtaataattgcaacactttgttgtactggtctgtcctttgtctttttcatccttttttgataattctgttattttgtctttttggttttgatttttcttttctttttttatttttcggagacagggtcttagtctgtcatccatgctggaatagtgcagtttcgcgatcttggctcattgcaacctctacctcctgggctcaagcgatcctctcatgtcaccctccatgtagctgggaccacaggtgtgcgccaccatgcctgactaattttttgtatgttttgtagagatgggatttcaccatgttgccccagctggtctctaactcctaaactattctcttggccttccaaagtgctgggattacaggcatgaaccactgtgcccaacccatgcaatgaccatgctaatcttctccatattattccagtttcattatatgtgctgacaaagtgagcacataattgttactatgttgaaaagacttgcaggccgggcgtggtagctcacacctgtaatcccagcactctgggaggctgaggcaggtggatcacgagttcaggagatcgagaccatcctggctaacacggtgaaaccccatctctactaaaaatataaaaaattagccggccgtggtggcgggcgcctgtagtcccagctactcgggaggctgaggcaggagaatggcgtgaatctgggaggcggaggttgcagtgagccgagatcgtgccactgcactccagcctgggggacagagcaagactccatctcaaaaaaaaaaaaaaagactttaagactttttttttttttttctttgaggtggagtctcgctcttgtcgcctaggctggagtgcaatggcgtgatctcggctcactgcaacctccgcctccctggttcaagtgattctcctgcctcagcctcccgagtagctgggactacaggcgcctgccaccatgccctgctaattttttatttttggtagagacgggttctctccatgttggtcaggctggtcttgaactctcgacctcgggtgatatgcctacttcagcctcccagagttgggattacaggcgtgagtcactgcgcccggcctcagacatgtttaatccaagtcctcgctgtaatgagagttggactttttctacttaaatttttttttttttttaagatggagtctcgctctgttgcctaggctggagtgcagtggcatgatctcagctcactgcaagattcgcctcctgggttcacgccattctcctgcctcagcctcccgagtagctgggactacaggtgcccaccaccacccccggctaatttttttgtatttttaatagagacggggtttcactgtgttagccaggatggtctcaatctccagaccttgtgatccacctgtctcggcctcccagagtgctgggattacaggcatgagccagtgcgcccggccttatttgttttttaattatccagtcaaaatagctaaaggataactattacaaaagtgataccgaacactaaagcaatccctgtataatcttgtaacagctgaaagtaagattcaggagaaaaaactaaacagttgttaaatatctatctgtatgtacttgacactgggctaattgctttacataatgtcttgcagaatttgcacggaaatcttgaagtggtaggtagccttgtacatttaaatgacatgttgaggttgatacatactagttatgagtgctttcagccgttatgtagcgaaattgtaataatagtccgtagttctcaaactttggtgtgatacttaagctactgaaaatgcgttcttggctgggcatggtggctcaggcctgtagtaccagcactttgggagaccaaggtgggcagatcacctgaggtcaggagtttgagaccagcctggccaacatggcgataccctatctctccaaaaaatacaaaaattagccaggtatggtggtgcatgcctgtagtcccagctactcgggaggccgaagtgggagaattgcttgaactgttttttttttttccctctcaggacaaatgtttaatttgcttctccatcatgcttgaactgttcttcagcccattccttgagagttcagaaggtctaggatagacctaacatttttcagttctaacagtctgcagggtggtagtgatgctgttacatgaggtacaacactttagtagtactggcttaaacaagacagacgtgattatctcatgtagtaagtcttagatagttccaagtttggtatagaggctgaatactattgtcaagacctagactttctctgtctttctgttctgttcttctcagtgtgttgagttctggtccttagctttgctgtcccctgagttgtgaaaaaatgtgactgtattcagagtgagggaatacttatcaaagcaggctaagaaaatctttccagaagcatatctggaaaaatctttcttgaagcataaaatagaaagctccaccctttatctttacatgttattggctagaccttggcttacataaccacccagagctgcagcgggggctgagaaagagagtatcttcctttgtatttaagtctcaaaagagacaggctggcaagagagaagagggagggaatagcttggtagctagctcagcagcagtttgtgctacaatagccagtacttgatggggccaagattcacacctgtctctctggtttcaaagttcttgttctttctttgtttcaataatttactctgactcctttctatctcctagctagttcttttttatttgtcatgtctggcagtactagtggggtttttgtttctttgtttgttttttattgagacagggtcttgctgtgtcttccagactggagtgcagtggtgtgatcatagctcactgcagcctcagcctcccaggctcaagcagtcctcccacctcagcctcccgagtagctgggactgtagacactcaaaaccatgcctagctaagtttttttttcttttgagacagagtctcgctctgtcgcccaggctggagtccggtggcgcgatctcggctcgttgcaagctccgcctcccgggttcataccattctcctgcctcagcctcccaagtagctgggactacaggcacctgccaccatgcctcgctaatttttttgtatttttagtagggacggggtttcaccgtattagccaggatggtctcgatctcctgacctcgtgatccacccgcctcggcctcccagagtgctgggattacagatgtgagccaccacgcctggccgcctagctaagttttttattttttatagagaaacagggtcttgccatgttgtccaggctggtttcagactcctggacttgcatgatcctcccaccttggcctggcaaaatgctgagattacaggcatgaatcactgtggctgaccattagtgggttctaatcacatactttatatcagtcagtgtcctggcaggaaacagatggcatactcaaatgtaattgaattgagtttaataaaggggctgttgacagcagacagcagtctgatcagggttaaggaaaacttaacaaggaaaggttgagtgcctcatacctatcagcagttggggaagactttatcatttctaaaccccaaggaagcagagggagggagtgggtacaggaactagaaaagagtagctgctgttgttgaagagtactatggtagtgagagaaaactgtaactgtaaccatcctcctagggaggcatttggaaataaacaccccaaggatgctttacttccatctcctggttttctgctcatgctccctatgaactgaactcaccagaatctagagggcaaggggagtcttggtggaggctgtaaaggtcagcctatttaagcatagagccaggtagagaaggatggaaatggaattgacatggcaaaacgaaaatattttgcacacatctgcaaggtgaaagaagaaatgtttgaggaaagatgggctgaacccaatggctcctgcctgtaatcccagtactttgggaggctgaggcgggaggttggcttgaagctaggagtttgagaccagcctgggcaacatagggagaccctgtttctacaaaaaataataaaaattggccgtgcatggtggtgcatttctgtagtcccagctacttggaagacaggcaagaggatcgcttgaactcaggagttcaaggctgcagtgagctatgatcgcaccactgtactccagcctgggcaacatagcaagaccctgtctcaaaaacaaaaaaaagaggaaagggaagagatactagggaagtatgtatgtccataaacatgaaaatatgtttaaactcatcaataatgcaggaaatctaatcgaaaccatagtgagataatgtatacacatcagattaataaagaaaaaaacttgctgccaagttttgacaggaatgtggaattgcttatagtgtaaatagcacatatattttggaaagcactcggcattgctgaatacaattggttattatacataccctttgactaaggatttttgcttgagtatttaccctcagttttgccgcaggaaatctgtgtaagtatattaatagaattgttcatagtagtccaatgaggagataacccaggtagccatcagtagttgaatggataaacaaattgttaagccacacaatactctatagcagaaaaaatgtgaacttgaaagaagtcgcagaagaatacagtatgattacatttatagaaggctcaaagcaggcaaaactaactcagaatgtttgttatcactgtcaggaggagaggagagagttgtttccacctgtgcgtaggcttactgggagattctgaggtactgttaatattcttttcttttttgagacagggtctggctctgtcgcctaggctggagtgcagaggcacaaccttggcttactgcaacctccacttcccaggctcaagccatcctcccacctcaatctcccaagtagctgggactgtagctataatgcctggctaattgtattttttttttttttcctcatcctacagtccaaaggcactggctaatttttgtattttttgtagagatggggtttcaccaagttgccaaggctgttcttgaactcctgagctcaagcagtcctcctgctttggcctcccaaagtgttgggattgcaggtgtgagccactgggtctggccactattaatgttaagtattttaacctgtatggtgggtacacaggtgttcattatttataaaaatgttttgcactctaagtgtgataaaaaaaaaagtagatatgatggacattggaagcgtgccacaaacattgtcccaatatagaggggtttatcccagatatttattgatgaccggctatgtagatagcatgttttgggtgctggaaaaacagtagtgaccaaaatccacagttgtttctgtgtgtttagcattggtgatgaggccaggtgcggtggctcacacctgtaatcccagcactttgggaggccgaggcaggcagatcacgaggtcaggagttcaagaccagcctggccaacatagtgaaaccctgtctctactaaaaatacaaaaattagccaggcatggtggcgcgtgcctgtagtcccagctacttggaaggctgagacaggagaattgcttgaacccaggaggtggaggttgtagtgagccaagattgcaccactgcactccagcctaggtgacagagtgagattccgtctcaaaaaaaaaaaaaaaaaaaaattcttgataagaactatgaaagaaaagcacagagtatttattaaagtttataatcaggggaatctagcttagaaccagaattggtgttgatccagtaaagctcctctgaggaggcaacatttaaggtgaagcctgtaggttgagtaggatatatccatgggagaagggggcattgagtatttcagggagagagaacagggtgtgtgaaggcctttagacagaagggaacttgatggtcaggaacggggtttctcaacgttggcattacaaactttaggacagatgattctagtgggtgctgtcctgtgcattgtagggtattcagcagcatacctggcctctatccactagatgccagtagcaccctctcagctgtgaaaatcagacattgccatatgtctcggggaaagaaaggaaaagaggtatgacataattacccctgtactgtactgggaaaaccattgtactggaagaacagagaaaaatcagtgtggttggactacagaaggagggaggatggtgggaatggtagtatcaggtagccaagggctagatcttgtacaggttgtcaaaggttaggtcatggtttgaaatctgttgtttttgtttttgttttgttttgttttgttttgaggcggagtttcattcttgttacccaggctggagtgcaatggcgtgatcttggctcaccgcaacctccgcatcccaggttcaagcgattctcctgtctcagcctcccgagcagctgggattacaggcatgcgccaccacacccagctaattttgtatttttagtagagacggggcttctccatgttggtcaggctggtctcgaactcccgacctcaggtgatccgcctgcctgggcctcccaaagcgctgggattacaggtgtgagccactgcgcccggccttgaactctgttgtttttggttttggatttatcataagggttgctttgcaaaaatggtttgaactctgttttttttttttttttataaacagagttttgcttgttgcccaggctggagtgcaatggcgcgatctcggctcactgcaacttccacctcccgggttcaactgattctcctgcctcagctgcctgaatagctgggattacaggtgcccgccaccatgcccagctactttttgtatttttagtagagacgaagtttcaccatgttggacaggctggtctcaaactcctgacttcaggtgacccacccacttcagcctcccaaagtgctgggattacaggcatgagccactgtgcccggcttggtttgaactcttaatgagcattggaaaagctttgtagagtttttttatttttatttttattttgtgagataaggtctcgctgtgttgcccaagcttgagtgcggtgcacaatcataactcccttcttcttcaacgtcccaggctcaagtgatccccttacctcagcctccctagtagctggaatcactggcatgcaccacatcctcgcctggcaaatttttttgtgttttttgtagagatgaggtttcaccatgttacccaggctggtcttgaactcctgggctcaagcagtccacccaccttggcctcccaaagtgctgggactacagccatgagccaccatgcctggccagtgtttttgttttcttaacagtattttttgaagagcagtttttagttttgttgaggctgaatagaaaagcaaataaaccttaaatatatctataattatattaaacataagtaatctaaacatttcaattaaagggtagacattgaccaggtgtggtgtgtgcctgtagtcccagctacttaggaggctgaggcgagagaattgcttgagcccagaagttcaaggccagactcggcaacataacaaaaatctcatttctttaaaacaataacagaacagtagaaatactcattttgggcagaaaaagcaagaccaaatggtattgctgtgtataagagagaaacacatagaataaaagtgaaagaatggaaaaatacatgccatgttaacataagtcaaaagaaatctgaaggggctatgtaagtatcagaggatagatttcagattaaagaatataaccagggataaagaagtagcaagtcattttataatgaaaaaaatgagtcagtttgtcaagaggacatagcagtggttcgcagccctctaatgccccaagatagggtctcaccctgtcacctaggccggagtgtggtggcactgtcatagcttactgcagcctcaaaaacctgggctcaagcgatcttcctgcctcagcctcctccgtagttaagactatgggaacacgccatcatgcttggctaattttattttattttgtaaagatggggtctccctatattgcccaggctagcctcaaattcctgggtctggccgggcatggtggctcatgcctgtaatcctggccctacacagttgatttttgatagaggtggaaaggtaattaagtagagaaaggtgttatttcaacaaatggttctggaacatttgtatatccatatacagttgatttcttttttttaaaatgtaggccaggcaccgtggctcacgcctgtaatcccagccctttgggaggctgagacaagcagatcagttgaggtcaggagtttgagatcagcctggcaaacatggtgaaacctcgtctctactaaaaatacaaaaattagcctggcacgatggtgcgtgcctatagtcccagctactccggaggctgaggcaggttagaatggcttgaacccaggaagcggaggttgcagtgagccgagatcataccactgcacttcagcctgggtgacagagagagactgtgtctcaaaaaaaaaataataataagtaaatacatacaaaaatgtaaattcttgaactgtattcacatattttaggctggtacagtgattgccctttggccttgtatattggcattttacatgaatcatgaacctagattgtgatcatttatttcatttttttaggctgtcatatttcaacctagaagtctgagaaaaaaagttgaaaacagttcattgtacttggatactttactgtttcaatcaccttttgttagttgaggaggcatgtatattggatgatatgttctaaacatcttcaggtttctgggtgtttattatctctgattttctctactacctcctttataggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattagtatgtttgatattagctttccttagtgttttatgagatcctgtttattttattatgaacacatcttttagggttctctagcaactaaatgtgtgattttttatgtagacatgattttgttcatttatgattcatagaacaactaaaatgtccacaacatgaaacacttgaatatccctaaataattaagaccattgggaagtcgtttcctctagttgcttagaaagctctatgcagggctgggtgccgtggctcatgcctgtaatcccagcactttgggaggctgaggagggtggatcatctgaggtcaagagttcgagaccagcctggtcaacatggtgaaaccctgtctctactaaaaatacaaaaattagcggcttgtggtggtgggtgcctataatcccagctactcgggaagctgaggcaggagaatcgcttgaacccaggaggtggagtttgcagtgaactgagatcgcaccattgcactctagtctgtgccacaagagcagggccacaaaaacaaaactccatctcaaaaaaaaaaaaacaaaacacaaaagctgtgtgcacattgctagctactcaagatggcaaggaaagtctgctttcctttcgtcttgaagtggaaatatgtatttatgtattggggggtgatcaaggtaggaagagcaaattctaaccctgatcttcacattataagccaatgtgatggttttaggtacagctcacccttgaacaacataggtttgaactgtacaggtccacatatgaatggaactttttcttttttttatggcacttaacccatctctcaatattttttcaatgaatgtattggaaaattctttggaggcttgtgacagtttgaagaaactcagagacgaactgagtaacctagaaatattgtaaaaaaagaacaaagagttaggtatgtcataaatgcataaaatacatgtagatactagtctatcatttgctaccataaaatatatacagaaatctattataaaaagttaaaatttatcaaaacttacacagaccatacctggcaccattctcagtcaagaaaaatatgaagattcagtattaaataataacaataaaatgaactgtagtacgtactatactactgtaatcatttcctaatgacctcctgttgctgttgaagtgacctcagtcattttatgtgatgctagttcatctctctagtaaagtgctaattgtcctagtgtccttttttggcttttcatagataaggtcttgctctgtcacccaggctggagtgcagtggtacgatcatggctcactgcagcctcgacattcctggccgaagcgatcctgccacctcagcttcccaagtagctgggaccgtaggcatgcaccaccacacccagctaatttttgtaggttttttttttttttttttgtagaggtcagttctcacgatgttgttcaggctggtcttgtactcgtgagttcaagcgatcctcctgccttgacctcttttttttgaaacagggtcttactctgttgcccccaggctggagtggagtgttgtgatgacagcttagtgcagcctggacctccttgtggcctcggcctcatgctgaattacaggtatgacgcactgtgcctggctgtatacacaggtttttgactgcgagaggaggagaggtcagagccctaacccccatgctgttcaagggtcagttgcacttttttctctccataatctgtaatctaagtccctctcacacgggagcaggtaaaatcctgaaactatgatgtcctagggacctggagactctaacaataatgtttttaaatttgaacaattgagatttggctcactgggaagaccgttcagcctctgaggccttcattaataaagaatttgactggacttgattattgttgtctccaaaaatgtaggtgcaccaagtgtttggtgtgtattggtctccctccgcatgagtattagaggatcaaatgttagcttactatttaactggtacaaactttgcattagaatgtgatgttgtctgtctcccattctattttgtgtgtctagatgttttggatctgtgcagatggtttttgaggtactttcttaatgtagttcgaagcaaacttctgagagtgtcattgtagttggtccatcccaagttgttgatacttcagtttgttttctcctgtattgtgaatgctaacgtctgtattttccagtttccctcttctttttgatactgaagttttgtaataagggcattacttgcaattccttgaggttgagaagtgttttggttaggaatattctctctgctttccgaacatcagttttattgtggtcttacttctgcctctatattcctgaaatagttcctattaagtttacaagtgtcctcttaattgtcaaaagcagagatttcttcttggcctgtgttggacttttctgttatatttattaatatttatttattttttaacgtttaagttcaagggtagaagtgcagggttgttgcataggtaaacttgtgtcatagggcttggttgcatagattaattatttcatcacccaagtgttaagcctagtacccattagttgtttttctttaaaaggcctgagtgtgtgttgttcccctctatgtgtccatgtgttctcatcatttagctcccacttacaagtgagaacatgcagtatttggttttctgttcctgtgttagtttgcaaggataatagcctccagcttcattcatgtcgctgcaaaggacatgatctcattcttttttatggctgcatagtattccatggtgtatgtgtaccacattttctttcttgtgtccattgttggcatttaagttgattctgtgtctttgctattgtgaatagtgctgtatctgttacatttaatactgttggtcactcatatctcttagcttgataccactgtctcctagtgctccagctattcggtttctttacttccttccttccctgccattcctttgactttttccataggattctattctttgccttctgtttttcagtttgcatagtgtaatgttatatgctattcatggcacagtttgaattcttaactgtttgtagcctggtgatttccaagcctgggtcagacttttaactgtagacttgatctttacttgcctgtcctatatgcaatttatttatttatttatttatttttgagacggagtctcgctctgtcacccaggctggagcgcagtggcacgatcttggctcactgcaaccttcgcctcatgggttcaagtgattctcctgcttcagcctccccagtaactgggactatgggagcacgctaccacaaccagctaattttgtatttttagtagagacggggtttcaccatgctggccaggctggtctcgaactctggacctcaggtgatctgcccaccttggcctcccaaagtgctggaattacaggcgtgagtcaccacgcctggcccctcctttatgcagtttagattcaacatgtgtaaagctgaattgacttcactcttcttgtatcccaaggcaggtaaacaagaattgttctctcattcttttacttggctcaccgtccatccacctagtgtctaaggcagaaaagttaaaatacctttaacattctcacgtctagttggtcacgaactggaagaattttgactctctttccttctgtattacagttacattagttcagatgtttgtttatttttgagacagggtcttgctctgttgtctaggctggtgtgcagtggtgtgatcatagctcattgcagcctcaacctcccaggctcaagtgatcctcctgcctcagcctcctgagtagctgggaccacacgtgtgcatcacaacacctttctaattttttttgtttgtttgtttagagacagggtctcaccatgtggctaaggcttgatttaaactcctgggctcaagcagtctccccacctcagcctcccagagttctgggattacctgtgtgagcctgtgtgcccagcctaattcagatgtttagcattgtatcttccaatttccttatcttcagtatcaactttccattttatgttcgtcttctttttgagacagagtctcgctctgttgcccaggctggagtgcagtggcatgatctcggctcactgcaacctccacctcccgggttcaagcaattcttctgcctcagcctcccgagtagctgggattacaggcacgtgccaccatgcccagctaattttttctattttttgtagagacagggtttcaccatgctggccaggctggtctcgaattcttgagctcaagtgatccttctgccttggctcctcaaagtgctgggattacaggcacgagccactgtgatgggccccattttatattgatctttccaaaatgcaccgtagttagttacagccacagtctgtcattggttctctagtgctagcaagacaaattctaatctctttaaatggtatacaaggccctttctaatatggccctggcttacctttttgaatttttttcactgtagtatacatcatatttaaccacaccttattgcttgcaatctgcaatctctgaacaggtcatatcgtattctctctctctctctttttttttttttttttggagacagggtttcactctgtctcttagtgtggagtgcagtcgcaagatcagggctcactgcagccctgacctcccaggctcaagccatcctaccctagccgcccaagttgctgtgactacaggcatgtgccaccacacctggctaattttttgtattttttatagagacagggtttcaccatgttgcccaggctggtctcgaactcctggactcaggggatctgcctgccttggcctcccaaagtgctgggattacaggcgtgaactaccacacctggcccaagtcatattcttactcatctttctacctaccttccagactaagttaggtattccttctctgtattctcatagtatttttcttttcttttctttttttgagacggagtcttgctctgttgcccaggctggagtgcaatggcgtgatcttggctcactgcaacctctgcctcccgggttcaagtgattctcctacctcagcctcccgagtagctgggattatagggatgcaccaccaagcccggctaattttgtatttttagtagagatggagtttctccatgttggtcaggctggtctcgaactcccgacctcaggtgatccgcctccctcagcctcccaaagtgctgggattgcaggcgtgagccaccacgcccggcctctcatagtgtttttctttaccaacttctattacactgtttactacattgtagttatttatagtacattgtagttatttacttgctgactctcctcatagactttagctccttgaagttaaggacattatgattcatttttgtactgcatcacccagtgcctagtgaagagcagacgttcagttaagacttgttaatgaatgaatgaaaaggattaaaataattacgtttttcactaattttctatgatttgactagatgacagagcacgtagatcgccacgaaaacttcctacttcattaaaaaaaggagaaaggaaatgggctcctccaaaatttctgcctcacaaatatgatgtgaaactacaaaatgaagataaggttagttgacactttactttttacatgtgatagatgttctttaagaaaatatcatagggttgcttttgttggagaaaatgtgctgaagaaaaatgtaaatgaatgtacagcagattctgagtggttttgtagttacagtaattaatgacttcaagttaatgtaaattatattttctttcctagaagataccatgcttttcctctttcttataggaattagtagagtgtaagtaatttacatttgagcttgaaattcagtttgaaaattaagaatctgttcccagcagttatggactttccaaggaaatcactcttcccagttaaaagtagagcagtcaggccgggcgtggtggctcacgcctgtaatcccagtactttgggaggccgaggtgggcggatcatgaggtcaggagatcgagaccatcccggctaacatggtgaaaccacatctctactaaaaatacaaaaaattagccgggcgtggtggcgggcgcatgtagtcccagctactcaggaggctgaggcaggagaatggcatgaacctgggaggcggagcttgcagtgagtggagatcacgccactgcactccagcctgggcgatagagcaagattccttctcaaaaaacaaaacaaaaaaaaatttgccaggtgtggtggcgcacgcctataatcccagctactcaggaggctgaggcaggagactcgcttgaacctgggaggcggaggttgcagtgagttgagattgcgcccctgcactccagcctgggcaacatagagcgagactccgtctcaaaaaaaaaaaaaaaaaaaaaagcgttttgctgattggaactaagattctaagaaatatggaatgttacttttcaggtattcctacaccacctgtatgtgcagaatcttagaaaggtggattaggagactgggtgtggaaggcaatgcacatttgtcttcaggtataaccattttacagaagaaacagctaagacctgagaagtttaataactgtcaaaattcttgattcagtaaatgaaaatgggaaggattgtaacccaaatcttttgcttctttatttacattgttttgttcctgcctcagaatgctgacaagtccgattccattctgactgttggtgttatggttcgtgatcagaagccttggctgggttgttaggattttttttttcttttcttttctttttttgagatggagttttgctcttgttgcccaggctggagtgcaatggcgcaatctcggctcactgcatcctctgcctcctgggttcaagtgattctccagcctcagcctcccaagtagctaggattacaggcatgcatcaccatgcctgactaattttgtgttttttgtagagacagagtttcaccacgttggtcaggctgatctcgaactcctgacctcaggtggtctaccaccccttggcctcccaaagtgctgggattacaagcgtgatccaccacgcccggcctaggttgttgttttgtttttttgtcttttttgagacggagtcttgttctgtcgctcaggcgggagtacaatggcacggtcttggctcactacagcctctgcctctcggattcaagcgattctcctgcctcagcctcacaagtagctgggattacaggtgcccgccaccgtgcccggctaagttttgtatttttagtagatacgggatttcactatgttggccaggctggtcttgaactcctgaccttgtgatccgcctgcctcggcttcccaaagtactgggattacaggcatgagccactgcacctggccaggatttttttatatttgaatattggatattgttaaatacaatttttcacagagtttcttctcattcagcaaggtagctgattaagacatgcctagttttaggccaggcacggtggctcatgcctgtaatcccagcactttgggaggccgaggcaggtggatcacctgagctcgggagttcgagaccagcctgaccaacatggagaaaccccatctctactaaaaatacaaaattagccgggcgtggtggcacatgcctgtaatcccagctactagggaggctgaggcaggagaatagcttgaaccagggaggcggaggttgcagtgagcagagattgcgccattgctctccagcctgggcaacaagagtgaaactccatctcaaaaaaaaaaaaaaatgcttagttttaaccacttccctaagtatcccttgtattcatattgatgagtataagtattttgttcacaaatataagtattggttacaggaagaaagaaaatgcaaataagaaagagatagtatctgatgtcatgctcagagataattggtgaatatagatttagtgaatggtaggtagctcctaagtgactttttaaaaaaaatttttttgtattccttccttctctgtttcctgctattaagtgacttttaaaagtagaactattctgtttatattattttataacttaattttttcatttattgtgtgctaaacatctgtaatgtcattaaattttcttccaaaacagtgttctcagattttaatgtgtgtgatagtcaccaggggaggtgattagatatgttgattcctaacctctactgccagagagtcataagattcattaagtgtgtggtgaggcccaaacatctgcattttaatagtaccctagatgattctgatgaatttttctggattgagaaagttttttcataggactgcagtgtccattatatgtacatagtttcatttaacaaatcccttattggtgtacctttaggtaataactctcaacccattcctcacttttttgctattacaagcatttgatgacaactttgtccatttacttcctaagataaattcttaacgagaggaattgctgaaagggtatacatatttttagaaaactttgatacatattgacatattgcctaaggatatttttaaattgacattctgtctctgaaaattattctccgttttctgtctctcagatagggtctcactctgttgcccaggctagagtgcattggtgtgaccatagctcactatagcttcgaactcctgggttcaagtaattcccctgcttcagcctcccaaatagctaggactattggcgtattttgatttttgtacacagagggtcttgttatattgcccaggtcgatctgtaactcctggcctcaaacaatctttataccttggcctcctgagttgatgagattacaagtgtaagaaaccatccctggcctatatatttttctttctaatttgtagccctgttgatatagatggaattttgatttttctggagagaacgtatattgcttgttctcatttgggtaattactttttaccccagtggtgagttatttgtttctttttaacctagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaaggtaaggtcactgttaatttttggacagcaggataaagcatcattatttctctgatggctccagtatatttatatttatagcaggttttgaactctaacatcagataatgaattaaaaatttttcaggtatatctgttacatacaggttgttatgtgaggttggtaggggagaggccacatttaatatcttccccagttcaatttattttttattatgctagcataattttaaaagtctatatacatgtgcttttgtgcctcagaccctttttggaatgaggtatggtataaatataaaaagtattttgttaaccagttaccaagaatgaaaactgattttgcatgtcggacaagatgatcacatacagtggcagccttgaaaagaacctggaatgaggagcagtgtgtgtgatagattagtggaaaacctagtattttcctcttgaagagtaagttttttttgttttttttttttttttgagttggagtctcgctctgtcacccaggctggagtgcagtagtgcgatctcggctcactgcaacctccttctccttcttctcagcctcctgagtagctgggattacaggcatgtgccaccacacctggctaatttttctatttttagtagagatggggttttgccgtgttggccaggctagtcttgagctcctgacctcaagtgatccgcctgcctcggcctcccaaagtgctgggattacagatgtgagccaccatgcctggccgagaaggagtaatttttaaaatcctcacttttgattttccaaatatttttatgaagttatatggtacatatatatatttcattttacagatggggtatctgaggcctagtctaatcagaaccaacagaaagtgatgacaagacttaagacactggcctaggatttctgattttcttttccatttcaagctttacctgttaaagtggttttttaatgtaggttttgaaagtacttaatgcttctttcattggtaaatgtaacgcagcatactggctgataattttcatcttggtctctgggccagcgtagaaccagaaaagggctcttgatccattaaaactaggtcacatttccaggatttctttttttcccatttcatttaattatgaaaatataaagacatctgaagtcataacaactaaatttgttcaattatcttaagttgattatggtgacaaaagcatattgaaaagtaattttatttctccaaaacattagtaaagacctccagtcatggttttagcacttagcagattttcttattctagaccagcaagataagtggtgtcttctgttatgctctttaaattattattatttgcttaaaaggaaaaatttagaaagtaattggctttttctagatcaggactaaattttccatggaactataatttttttctcagatgtttgtttttgtttgttgaggagaaattttgagttcactgtcattttgttgccacagagtttggaaccatgattcagctttctgtggtcttcacatgagattcctatcttcgctatatgagaactccatgaaaccatctctaaatgggttttagactaattcttggattacttgagtccttaatattttcctcttttctaatcttacagctctgttttatgtattttagtttagtgattcaagtatgtgaataatgtgaaagactctttttatgggtaaaatattttttgagtttcctaagacataaaagctgatccacacttatttcttactttagagacagggtcttgctctgttacccaggctggagtgcagtgggacaatcacagttcactgcagcctgaaatttctgggctcaagtgatcctcctccctgtgtctcactagtagctggggactacaggcacgtaccaccacgcccagctgatccacaatttttgtaggagagagagactagaactccaggaacttaaaacctgaaaggcaatttctgaagaaataagcttctcccagaatttctagtgggggcttaacttactaatgttatgaaatttggctataatttaggttaagactaggaaatggaagcttgcttaaagtgctggaagatggcagtgattttactcagaaaacttaagactcatgtaaaatactggtctacaaagttaaaggcatatactcaggtttattatttgttttccctaccttaaacaataatttcttatttcctaatactatctgacatgtcactgattgttttctgtatataagctgtgtttttcctatttataaaattaggactttggcttctcagccagggcaaaacatagtaacacagatgataagtagaacctaaaacattgctttgttttctttctttttctagaagaaatttaaaataatctgttgaggattaaagttgatcacataggacccatccatccaaaggcatgggatgttttctctctctgtatactctttggtttttgtagaatgtaatgttctgtcaggctctgagtacatttactgtagagtgagaccaggtgtaaagagagtgagttctgagcaatagttttagcaggccaggcgcagtggctcacgcctgtaatcctagcactttgggaggccgagttgggcggatcacgaggtcaggagatcgagaccatcctggctgacatggtgaaaccccgtctctactaaaaatacaaaaaattagccgggcgtggtggcgggcacctgtagtcccagctactcgggaggctgaggcaggagaatggcatgaacctgggaggctgagcttgtagtgagccgagatcacgccactgcactccagcctgggcaacaaagtgagactctgtctcaaataaataaataaataaaatagttttaccaaaggacccatagtgagggcttacgtgggagagaggaaaattatgtaaagatacaggaattttggattgttacctgagtacctaatatgatgatgagggtgtgtttgtggttttctaaaatctttgtagaatataaattacttgagaataagaactaccttgcttattttatatcttgtaacgtttagcatagtatgttgcatataataggtaactggctattcatttcttgaagttccatttgttggagaaaaatgccactgacatttgggctttaggggcagcgtaattttttgtaggcccaatgacttggaggaatgatttacaaggcaattgggtgataactgtcatctaagatgaaatctctagctcattttcctcttgtaatacattgcagccctattttgttagtctccatcatgtttgagctcttattttagactgataaatcctagtagggaagcctttggattagagatgtaagaagaaaataatactttaaggcatttggaatcctgcatgaatttagccttgttcttaacacattttaatattttattaaataattttatacaggagaattgacaaaacactaccaaatttctgtgtactctttaattagatttcctcagatgttaacatttatcatatttgtttatcattctctctctctttttttttttttttttctgaggtaggccttatgctgtctcccaggttagagagcagtggaatgatcatagctcactgtaacctggaacttctggctcaagcagtcctcccacctcatgcttctgactagctaggattaccggtgctcaccaccatgcccaactgatttttgtgttttttattttttgtaaagatggagtctcactcttgcccatgctggtcttgagctcctggtctcaagtgatcctcctgcctcagcctcccaaagtgttgggattacaggcgtgagccactgcatctggcctaatctgctgtctatatacacacgaattattttttcctgagccaagtaattttccagacaggatgcccttttacagaatactggaatatgaatttcttaaaaacattgatatttgctagctcacacctgtgtaattctacactttgggaggctgaggtgggaggatcacttgagtccaggagttcaggaccttcttgggcaacatggagagattccatctctacaaaacaaaacaaaaaaatcaaggatattttccaacgtaactacagtacagttgtcaaaatcaggaagttaacattgaaataactctattatctaatctatagtttttactcacattttcccagttcttcagtaatcttttaaccaaaaaaacaattttgttttgctttaataggatccattgtgctaccatgtgtcacatgttcacatttacttgtctctttggtctcttctaatctgggacagtccctcagcttttctttgtctttcaaaaccttgacgttttgaaataatagaacccggttattttgtagaatgctctttgattttggtttatttcttcatgattagattcaggttatgaatatttggacattaagaattgatgtattcttagtgcatcatttaagaaggcagtgacataattttgtccattactcatagtattacatattttatttatttttttattttttgagacaggctcttgctctgcccaggctggaggtgcagcggtgtgatcatagctcactgcagtcttgacctctgggcttaagcaatccgcctaccttagcctcctgagtagccgagaccacaggtgtgcaccatgaagcccagctaatttttatttttaatttgttgaagagacagggtctcgccatgttacctagactggtctcaaactcctgggctcaagcaatccttccccgcctcgacccctgaagtgttgggattacaggtgtgagctatcatgcctggctgatctatctatctatatctgtctgtctgtctgtctgtctgtctatctatctatctatctatcttcctccctccgtccctcccttccttcctttgacagagtctcgctctgtcgccaggctggagtgcagtggtgcagtctttgctcactgtaacctctgcctcctgggctccagcgattctcctgcctcagcctcccgagtagctgggactacaggcacccaccaccatgcctggctaatttttctatttttggtagacatggggtttcaccatgttggccaggatggtctcaatccctggaccttgtgatccaccagcctcggcctcccaaagtgctgggattacaggcatgagccaccacacccggcctgatttttctttaaagtctcgctcttaaagtttgtttgttgtgtatggctgggcgtagtggctcttgcttgtaatttcagcagtttgaggggctgaggtgggaggattgcttgagcccatgagtttgagaccagcctgggtaacatggcgagaccctgtttctacatacacaaaaaattaactgggtgtggtggcgtgtgcctctagtccaagctactttggagatggaggcagggtgatcccttgagcccaggaggtcaaggttgcagtgagctgtgatcatgccactgcactccagcctgtgtgacagacagagtgagaccctgttttgggtggaggaaaaaaaaaagtttgtgagttaggggttagaacagaagtactttaaaaggtaaattatattgttgaaggaatggttgctagaagaaaaaaaatgaaaagtaagttatattattttgagaacactttaaatatattttatagtaacaaattttgcaaacttgctaataaaggcatgtggaaattgagaaaagcccactatttgagtgttgtcctcagagttctaacatgttgccctgggtgaatgagaacagtgagataagaatcaatatggattgccaaggtttgctaattcagggttttgctgcctagattatattgcttattattaagttgtgtgcagcatctgaatgagctgctacaagtaatttctttaatttttatcctttttttaatcaagaaacaggagttgcagacagatatttgtggttgtggtgagtttcaagtgacaggaacaaatgtaaaattgtggacgctctctttttctttcaaccttccatgttgccgagacagtcataaatatttttttctgtttagcaattaggaagggcctttggcaaaaattatactgctggtaatccaggtgtcctttcttctccctccccatctgctagtctggtagattaactgtgctgagtgggggatagggagcactgttagcacataagtggttttatactttttcagatccccctgagtccagccatgccggctcccatttggctgtgactgcccagcatgccccatgctgagatgatccagttactgaaggactgctcacgtggggagccggcctattgggagggggttgggtgagttcatttctttcatttttaagaaaaaaacaaacaaaaacatggtgtggcttggcacaaaaacacaccttacgaataaaaatgggttgctagaccctcatggctaagccatcccaccattttcttgtatcatttcttcatactactatgcttctaagtggaagaagtttaaagaacctcatgtaaaatgtgagtgatttttcttttaaaatagaactataatcagtaaataaagaagtgtcccagttattgtaacagaccctattaaaacatacctatttaaaatgctaaaaatgaaacttagtctcctttttagcgataaatttcattttaggatgactttaaatatataatctgttgttctgagcattagaaaaaatgtccgcctgtatgtgtgtactctgaagattttccaaggctgactgaagaaggttgttaactttttgggggcacacatttgttcttatttcctgccagggtagtaatgggtcttgctctgcaatttggatggtctctgccatattctctttggagtactgatagtaattactgtgcatgaagagattggagtcttaaataagttatcttggcttattcttcctagcattttgaaatacagttctgggaaactagaatgaggaaattctgcatctagggaaagtaatcccggagtcatggatagggtttatatgttgtaaagctataaagcctctttgtcagcccattctaaggatggttattggagattggggaacaacacattccagtttctttttgtttgtttgtttgtttttttgagacagagtctcgctctttctcccaggccagagtgcagtggcgggatctcggctcactgcgagctccgcctcccgggttcacgccattctcctgcctcagcttcccgagtaactgggactacaggcgcccgccaccgcgccaggctaattttttttgtatttttagtagagatggtgtttcactgtgttagccaggatggtctcgatctcttgacctcgtgatctgcccgcctcagccttccaaagtgctgggattacaggcgtgagccaccccgcccggcaacacattacagttttaatcaggcaacaaaaagggcagaggaacaataacctgcagttgcctggaactcttcaaaggccagttggcctttgaagttagatagcttagccaaaagagggatttgttaagtatatcctactcagtgtaggccatatttttttcctctgcgtgtagccatggttctgtgggctcgtttctctcattgtatctttaatgtttaaatctttttttttttttttttgagatggagtctcgctctgttccccaggctggagtgcagtggcgccatctcggctcgctgctagctccacctcccaggttcaggccattctcctgcctcagcctcccgagtagctgggactacaggcgcccgccaccgcacctggctaaaattttttgtatttttactagagatggggtttcactgtggtctcaatctcctgacctcatgatccgcctgcctcggcctcccagagtgctgggattacaggcgtgaaccaccacgcccagcccctaatgtttaaatcttaattggggtctggctgggtggctcatgcctgtaatcccagcactttgggaggcggaggtgggcagatcacctgtttgagttagagaccaggctggccaacatagtgaaaccctgtctgtactaaaaatacaaaagttagccaggtatggtggcgcacacctgtaatcacagatacttgggaggctgaggcaggagagtcgcttgagcctgggaggtggaggttgcagtgagccaggattgcgctactgcactccggactgggagacagagcgagactccatctcaaaaataaaaaataaaaatttaaatggctttatagtacagcttatttaattttactaaacctatttgcttttctcctaacaagagcataggtgttttactgtgtgatccctgggatttatctcaccttagccatttccctgtacccttttttaaggggctcataatttcgttattcagtaatccttagctgttttcttgcctgtagtctcatctcaaactagcctaacctacttgtctttagacttcttctttacatgttgctcttttctggttagtcccttctgttgaaaaactggatgttcatatctgtgagtgccattgatgtacttagctgattttggtaataaaaatcaagtattctagagttgatctagtcttttccctaatcacataaagcaacagttttcttctgaaatgggctgtattttggattacttgacttggttatttcaattagtttgcattttagctaccaggcatttttctttgtaattatcttttttaaagcattccactcaaagagtttggtttttctttttttcaatacacatttaaaaagagaagcagtggtatcatgacaaatggaccggactgtaacctgttaactgattgtatatgatggagatgaggcatgggaggtatgaggagatgagatgtgtatcaggagagtgggaacatgagtggactaaaggaacatactgtgtttgctaggtgatatggaggacccgtttgaggtgcctggcaatgaatttaaagtgagaccactcactttttttttttttttttgaggcagagtcttgctccatcgcccaagctggagtgcagtggcgtgatctcggctcactgcaagctccaccttgcgggttcacgcctcagtctcccaagtagctgggactacaggcacccgccaccatgcctggctaatttttttgatttttagtagagactgggtttcaccgtgttagccaggatggtctcgatctcctgaccttgtgatcagcccgccttggcctccgaaagtgctgggattacaggtgtgagcctccacacccagctgagaccacccacttttatttatcttttattttagccgtgtttcagctgaacatatgcagggcaggagtaaatagagtgagttaatcagggttatggtttttccaagtagatacaatagaataagagagacaagggaactataggtttatgtgagattaattatcatgattgactaaaatttaatctgggtaaagcaagacatgggggttaggatggtgaaaatgtaatagaattaatggatttaaggttctggtgagattgaaggattgtagagttgtgggactggagggagtggatttggaacataagagggtatgttcaaagagaggatggtgtgaaattagttgtgggaatgagttctttttttttttttttttttgagacgggggtcttgctctgtcctccaggctggagtgcagtggtgtgatcctggctcactgcaccctcctcctcccgggttcaagcaatttcgagcctcagcctcccgagtagctggggtgacaggcatgtgccaccatgcctggctaatttttgcatttttagtagagacggggtttcaccatgttggccaggctggtctccaactcctgacctcaagtgatctgcctgcctcggcctcccaaagttctgggattgcaggggtgagccactgcgcctggccagaatgagttcttaaaagtgttgggtgaggacaaaggggagtttgaggcccaggtcaggaggtgtctttatctatgagcagtgttcatgttgttcttacactcactgatgcttctataagaaaatgtacctcagagttaagacaaaagtactttaaacagtatcatttctacttaaaagcataaaatgccctgaataggaaccaacagtgaaaggatgaaaattcagtcttgtttcaagaacagtgctttttaaacttttcagatattgccattttgtagatcagatatccttaatctggggtccatggatggattctctgaaattgtatgcatagtttttgtctactatttctgctggaggggttcacagattttgtttaaatatttaagaatcattaatatacataaacagaactagttacatagcaaaaatgtctagtattaagtctggatgtcaagggaattttgtgttgacatgacaaaaacattagctaacattcatgtctttgttttttcagggacaaagtatctatgaagagatatgaatatgtagctttacctgaatagctggggaagagggcctttaagatgcttaaatgttgcttaagttagttttagattttaaaattaattttgctcctattcttaaattctagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaaggtaaaatttcatgctgagagaaaaggggaagctctgtagaagatagtaaaagaaaggaaattactgaggtaatggtagggtctctgtttgtttacttatttctgtatgtaataacccagcacctattggtatgtattttattttttattagttctgttgataatttcatatttcagctggagtgttcagcctggcattctgattagttaataagttaatgtgatgttggcatcttttctgggttcagtaaaggaccaaatctacaaatagaaatagtggaaacaacataggacttgggagttgactgacctgggttcaggttctagctctgacttagctgtacagtgttcctttgggcagattacttatccgtgcctcactttcctcatatgcttgataagattgttgtaaaattgattgacaaggtatttgaagcccctagcacggtcaccaactcagatagtaatctgtcctttaagatttaagaacttaaaaattttgggctttgatggctccatcgaatctgaacttttaaaaagcagctttattaagaaataatcgacatacagtataattagttcacttattgtgtataatttagtgttttcagtagagtcacagataatgtacaaccattgccaattttgtaacatttttatcatctcaaagaaacctgctacccatgaactgtcattaccccattcgcccatcctccccagccctgagcaaccactagtctactttgtctctatagatttgctattctaggcattttctctaaatggaattgtataataaatagtctgttgtgactttcacttagcataatgttttacatgctacaacatgaatgaatcttgaaaacattatgctaagtgaaagaagccagtcacaaaatagaccacctctatttagttctaaaacatttttttttttttttttttgagatggagtctcgctctgtcacccaggctagagtgcaatggtttgatcttggctcactgcaacctccgccttctggattcaagcgattctcctgcctcagcctcccgagtagctgggattacaggcatgcgccatcatgcctggccaatttttgtgtttttgtagagatggggtttcaccgtgttggccaggctggtttcgaactcctgatccacccgcctcagtctcccaaagtgctgggattacaggcgtgagccactgtgcccggccagccaccatgccgggccagccaccatgcctggccccaaaacatttttaaaagaaaacccaaaagtcactcactcttctcccttgtccacatcccccagcaaccaccaatctgttctctgcatctatggatttacctattctggatatttcatgtaaatgcaatcatataatatgtagcctttttatggctggcttttttcacttagcatgttctccaggttcatccatgttgtagcatgtgttagtacttcattcccttttatggctggataatattccattgtttggatataccacgttttgtttctcattcatcacttgataaacatttagattgttttcatcttttacctattatgaacaatgctgccataaatattcatgtatgagtttttgagtagtcatatacttaaatttctttagagtaaatacctcggaataagattgttgggtcatatgattatgtttaaccatctgagaaactgccagactgttttccaaagtggctgcacaattttacatgcccaccagcagtgaattaaaggttctgacttttctccttcctcatcaatacttgttattttctgactttttgatgatagtcatactagtgggtgtgaaatggtatctcattgtggttttgatttgcatttctttgatggctaatgatgttgaaccatcttttcatgtgtctcctggccacctgtgtatctttggcgaagtattcagatcatttgcccattattaaattgagttatctgattattattgagttgtaagagttctgtatatattctagatacaattctctgtctgatacctggtctacaaatattttcatctattttgcgtgttgtccttttactttttttgggggagacggagttgcgctcttttttgtgcccaggctagtgcagtggcgtgatctcagctccctgaaacctctgcctcctgggttcaagtgattctcttgcctcagcctcccgagtagctgggattacaggcgtgtgccaccacacctggctaattttatatttttagtagaggtgggttttcaccatgttgaccaggcaaggtctcgaactcctgacctcaggtgatccgcacgccttggcctcccagagtgctgggattacagctgtgagccactgcacctggcctgtcctttcactttcttagtagtatcatttgaagcacaaaagttttttaaatttgatgaggttcattttatctatttattcttttgttacttatagatttggtgttagatttaaggatcttttgccaaatccagggtcatgaagatttactcctgttttcttccaaatgtcttaatagttttgcctctgaaatttaggtcttttattttcagctaatttttatagtgtaaggtaaaagtccagctttatttttttttgcatgtggctctccagttgtcctagtgccgttttttgaaatgacaaacctttccccattgaatggccttgatacgcttgtcaaaaatcatatgactgtaggatacgttggcttatttctggactctgaattctatttcactgatctgtatgtctgtctttatgtaaaagccacactgtcttgataactttgctttgtagtaagtttcggaatagggaagtgttgatcttccagcttgttctttttcaacattttcttttttattttattttgagacaaggtctcattctgtcacccaagctggagtgcagcagtgtgatctcagctcactgcagccttgacctcttgggctcaagtggtcctcccacttcggcctcccgagcagctgggacttacaggcatgtgtcagcacgcctggctaatctttttattatttgtggaggctggtattgaacccctaaactcaagcaatcttcctgcttcagcctcctaaagtgctgggattacaggcctgagccaccaaaccccggcttgaatagttctttcattagaaaatgtatattccttttaaaacaaattttagtttacactacttaaggccattgaaatatttttgcatatgtatgcatactgtgcctgagtatacatatgtaatgtgtactttccattttatttatttttttggatacagagcgtcgctctgtcgctcaggctggagtgcaatggtgcgatctggctcactgcaacctccacctcccaggttcaagctattctcgtgcctcagcctcctgagtagctgggataacaaggcatctgctaccacactcagctaatttttgtatttttagtagagatggggattcaccatgttggttaggctggtcccaaaactctgacctcaaatgaactgcctgcctcaacttgccaaattgctgggattaaaggcatgagccaccgcccctggccattgtattaacattttaaagacatatgaacaggccaggctcggtggctcacagcctgtaatcctacacttcgggaggctgaggcaggcagatcacgaggtcaggagatcaagaccattctggccaacacggtgaaaccctgtctctactaaaaatacaaaaattagcctggcatggtggcgcatgcctgtaatcccagctactcaggatgctgaggcaggagaattgcttgaaccagggagtctgaggttgcagtgagccaagatcggccaccgtactccagcctgggggacagagcgagactcttgtcttttttaaaaaaaaaaaaagatcagctgggtgtggtggtgcctgtaattccagctactcggcctataattccagctactcgggaagctgagacaggataatcgcttgaaccagggagttggaggttgcagagagccgagatcacaccactgcactccagcctgatgatagagcgagactccatctcaaaataaataaataaataaataaataaataaattagctggctgtggtggcacacgcctgtaatcccagctacttgggaggctgcggcaggagaatcgcttgaacctgggaggcagaggttgcagtgagccgagatcatgccgttgcactccagactgggtgacagggtgagactccgtctcaaaacaaaacaatacctatcaagaaagtataactgcggccgggcgcagtggctcaacacctacaatcccagcacttggggaggctgaggtgggcggatcacctgaggttgggagttcaagaccagcctgaccaacatgaagaaaccttgtctctactaaaaatacaaaattagccgggcgtggtgacacatgcctgtaatcccagctactcggtagactgaggcaggagaatcacttgaacccggcaggcggaggttgcggtgaggcgagatcataccattgcactccagcctggacaacacgagagaaactctgtctcaaaaaaaagaaaaaaaaaaaaagtataactgtgttccagatgaagcagaatgtaggttaaaaccttcagctctattttatctgaaacgtaataatttcttcttgcatttttggactgctccactgtgttttatatttatcttaagagaaggaaaagaagatgatactctgttatttgtatggaaacaagagacagaatattagtgttttaccaagatcagtatttggattagagttcaggtctttggataactagttcagtgctgtaacctctgagacagaatttggtcttcctttggtgacttgtcctaagttggtttatgtttgtttgtagtcttgggagactgaacttttccttgattgtaattgggccatcactcactctctcgcttttttttttttttaatcatttacctttgtgctattttctactataaccattgttacaaatacacagtttcacttgggctagaaaactgtttatcaaaggtaacaaattccatgttttaaataaatggaatttatcttaagtttttaaagtaacatctttagacagatgcattttccagatttacatcttattgtagatgttattgtcaatagacaatcagggttaaaaattattggggctgagtgcagtggctcacatctctaatcccagcattttgagaggccgaggcaggaggatcgcttgagcccagaagtttgagaccagcttgggcaaacatagtaagaccctatctctaaaaaaataataaacacttcttaaaaattgtgacattgtaaatagcattgccatgtaccctatggtgtcaaggtttgtgacaattatggaaaaacttaacaaaattagcgggctgcttttgttgagggaaatttctaactgaataaacctaattaatgaatgatcagaaataaaatttttatcattaacagtaacttgcagaataattagaaaaataggtgttcaatgtaaaataattattatccacaagtgcgtccctgctgttgcttttcaggtttgttttcttgtcatcagggctattaagccaaattactgtcagattcctcaggactgaaatatgttttattttgaaatagttattttactagtttgatttatcgtgatctttttgaggatcctgtaggtgcacctgtcagaagatgtttcagttagtcctatttatggactgttaactgtttcttcaggattgtttaaaatatattaagaagtgatattttggctgggtgtggtggctcacgcctataatcccagcactttgaggggccgagacgggtggatcagttgaggtcaggagttcgagaccagcctggacaacatggggaaaccccgtctctactaaaaatgtaaaaattagctggacacggtggtgtgtgcctgtagtccagcgacacaggaggctgaggcgggagaattgcttgaacccaggaggcagaggttgcagtgagccgagatcgcaccactgcactccaccctgggtgacagagcaagactctgcctcaaaacaaaaacaaaaagaagtgatattttggagataaaagattttgcattgagttgagggatgagatgtcaccacaaattcaaggagtgtaggaggactagatgttgctgccttacatgtaatttcttgtaacagattagaattagagaaagcaaactaagatttgataactactgtatactaggcactttttactccatattttatttaatttgtaagagtgggatttactaggaaaatatctgatttgagtctttttatttttaacagtgaaactggaacgccaagctgaagaagaacgaatacggaagcacaaagcagctgctgagaaagctttccaggaagggattgccaaggccaaactagtcatgcgcaggactcctattggcacagatcgaaaccataataggtcagttcctaaaccaaatttttgttttctttaggactatttacattgctattagttaggaaaattttctaaagtacaagaatagacaagcttctctcttcagttttccaattctttttggaaacagaattgttgatgattattgaatattaactgccaaatgctagagttgcaaagttaagtaagacatattcctgcccttgcatataccacaagtaggaagcttacatgatggtgataggtgaaatgtaatccaagtctttaaaaatggcagtaggttttaaatacatacattttgtgaaacctaaaggagaaatattagtagttacacaaattagggctgggcgtggtggttcacacctgtaatcctacactttgggaggctgagtcgagaggattgcttgaggccaggagttcaagaccagcccggccaacatagcgagaccccatttcaatttaaaaaagaaagaaattatacaaattacgaacattaagctagtctccagtttcaacatttctcgtatactttgatttaccttgcaatttttatctgtctagagttctgaagaggaagaattctgtaaactgtggttttgaatgctcagtgatactctgtattatcttctccagcagtaaaatcatcctgcaatcctgatctattcactgtcttattaatactggttgtgatttgtagatactggctcttctcagatgaagttccaggattattcattgaaaaaggctgggtacatgacagcattgactaccgattcaaccatcactgcaaagaccacacagtctctggtgatgaggattactgtcctcgcagtgagtatatctgtatatctaagagttatttcaccctgctcaagtgggctcaacattaaggactgcttttcctctgtcacgttttccatttgcagaatttctttattgtggtcttagatctatttgagtgaagtaggtagatgtgaaatgtgtagaaagaaggagagaaacccacgtttgattaccacctttgttctaagcatagtgtgagaagatgaagagcttgaatatgaggatatttgggtattagcttttataggagcagttttcaaactttgtcccttggaagcctttgtaggtgcctcaagggctgaaattgaggtatggggtctaagaagggcagtgttagatgtcctcttcttcttcttctttttttttttttttttgagacggaatttcactcttgttgcccaggctggagagcaatggcgtgatctcggctcactgcaacctccacctcctgggttcaaacacttctcctacttcagtctcccgagtagctgggactacaggtgtgtgccaccacatctggctaatttttgtattttttgtagggacggggtttcgccatgttggccaagctggtctcaaactcctgacctcaggtgatctgcccacctcggcctcccaaagtgctggggattacaagtgtgagccactgcacctgaccctcttcttctacttttaaaattaatttattcagtgtttatgctgaatctctatttgtgaagcagtttgtcatacgctaggggtatagcagcaaacaagacagataaggttcttaaaattcttgtgaggagaaacatggcaaatacctaacgaaaaatgagtgactgagaggggatcatgtagggacactggtaatattctttctcttgatctgggtgccgggtatatgtgttcagtttgtaaaagaaacacacactgaatagttttctgaatatatatccatattctttcttaaagtgtatgtattgagtatatttcaagaaagaaataaaacaaattttaattaaaaaaataagatggttaggttaggtcaggttttctcaacctcagtgttactgacattttgggctagatgaatctttttttttttcctcccaccatgacactgatgaggaagatagttttttgtactgggagctgtcctgtgcattataggttattcgggagctcccctctacccactaggtggtagcagtgaaaaccaagtatgtctctaaatcctgccagatacatgtggcaggcagcagtgctccctttcgagaaccactaggttaaatgatccataagcttctttcagctctgctgtctgtaacctaatgaaaattgcttatgtgttggtgtcatgtgggagataaagaaataaaagaagttgcttcctgagtactaggttattgtgcttcttcgataaatctttattttttaaaaagtaattcattttagagaaattcctaactcaagcttgaaactcacaaaattgttaaataagaataatactgatttacaaaaataaacattccttcaaataaaacttcagatttaaggtgtttgcatgttgaattatatcgagcatagattatgtcactttatagaagaatctggtttcgttagacttcataaatactcaggtgagggcagttaggtttgagagcagtaactgtggagcctggatgtttagatttggaagagattccagtgggatgaaggagtgttactttataatgtgtccccgagacaagattggggagccagacccttcacttctagagcatcctggtggatgttgtttcgtgttttccagttctagaatggcagtttttatttaaaattacccaactgaggctggatgcagtggctgatgcctataatcccagcactttgggaggctgaggcaggcggatcacttgagctcaagagttaaaagaccagcctggccaacatggcgaaaccccgtctctacaaaaaacacaaaaattagccgggtgtggtggcgggcacctgtaatcccagctacttggcaggctgaggcaagagaattgtttaagcccaggaggcaggggttgcagtgagccaagattgcgccactgcactgcagcctgggtgacagagcaacattctgtctcaaaaaattaaaaaaaataaataaattacccaattgaaaagactaaacaaagttatgtgttagtattgcagagatgtttcaggttaaagtggggagaatgggaaagagaagataaacaatcatagtatgaggtaaggcttcaaatattgtggtgactggccgggcgtggtagctcacacctgtaatcccagcacttgggaggccaaggcgggcggatcacctgaggtcaggagttggagaccagcctggccaacatggtgaaaccccatctctactaaaaatagaaaaattagccaggtgtgttggtgtgtgcctgtaatcccagccactcgggagtctgaggcagggagaattgcatgaacctgggaggcagaggtttcagtgagctgagattgtaccactgcactccagcctgggcgacagagcgagactctatctcaaaaaacaaaacgaaacaaaacaaaaaaccaaatattgtgatgatctaagataggctttgataaattggctcaagatatatctatgttaaagtcacgtatcagtatataggaactgatttacaaaaaagttagttgtattatttgacacttgaagcctccaaggataagtctatagtatttatatgttctcattacctctgcttcactacagatgcctttgctcttaacatcatgtaaaaggagtaaattctttattttgctttgatataaagatatttagtcattcttcattctaagttgcagtacccctaaactttggaactgtgtaacgattccacttcagagagcaaatatctgagataacatgctgtgtttaagatatttaagagaaattagcatcttttatacatgaagatatatttgatatatttcacaggaagtatctgtgttgttacaaattgttgagtttggcactgtgtactgcttagatttgaaactagcaattgggtatttactaaagtcaacctaatgtctcaatttttcttaggtaagaaagcaaacttaggtaaaaatgcaagcatgaacacacaacatggaacagcaacagaagttgctgtagagacaaccacacccaaacaaggacagaacctatggtaatgtgagcattcatctggttgctctttctttttccttttaattgttaaggaagaaagtatttagtatagtgatgccagtgagttaataattatttgcgcaggatactttgtgtgactgatattttggatatcaaaacttcttgcattagcagacctgattttttgttaagaagatacttgtttttttaagggttggaattttgattttttcccccctgtaatataactttgtatattatgtgatagatcttatatagcagtagaaatgtagcttaaatttggttgggaatagaagtatttaagattttccttaaattttattaattaacaaattgtatgcatagctattcgtttcctttatgcgcatttctgcttttaggcagcgagctaggttttagaggatccattctacggctttaactgtgatcacctgtgatttaatgacctttcatttttgaattttgggtataggtttactctctggagggaaagggacaagtatgccaattaactttataaaatttcatataatattttaataggaaccatattggctctggtgtcctagtacagaattaacattaggcatcatgaaaatagtaaattacttattctacttctagatagtagattgtgaacacatttggaattctgttctcccaagtcccaccaccaactctagatcccttgcttagtgtttgattttgaatttttttttttttttcagagttatcaggtctcttttgcccctacaggtttttatgtgatagtcaaaaggagctggatgagttgctaaactgtcttcaccctcagggaataagagaaagtcaacttaaagagagactagagaagaggtaagaggttttcatcttactcctcacatcttacttctctttagcattggatataaatatctgagggttttttttcttatccatttaagttactaaagtaaaatattttaaatgtgtaaccgttttgtgttcatattgcctggtattttcttggcatattatgcttattggaaaaatatacctttggccatctatatatagagtagcaggattattatgcactaaagaacagttgccagcaccaagctgtgagcctcatggttgtcagacagctttgcagatggaggcccagatgggtgggtgtccagaagtattctatcaatattcagaagagccaaaaggtggaaacaacggcaatgactatcaactgatggaacggataaataaaagttagtatatatccaggccttgtgcggtggctcacacctgtaatcccggcactttgagaggtaaaggcaggccagtgtcttgcatccaggagttttgagaccagcctgggcaacatagggaaactccgtttctgaaaaaaaaaaacaaaacaaaaattatcttgggtgtggtggtttgtgtatgtagtcttagctacttgggaggctgagctgagttgatcacttgagcccaggaggcggaggttgcattgagccaagatcatgcccctgcactctggcctgggtgagagagcgagatgctgtctcatacaaaatgaaacaaaaaacccccaaaatttagtatattcaaatagtggaatattatttagccacaaaaagaaatgaagtactgttctgtgctacaacatgaatgaacctagaaaacatgctaagcaaaagaagtcagacatcaaaggccatgtggtgtatgattccattcaaatgaaacatcttagaataggcaaatctatttcaaacagaaagtggattagtggttgccagaggataggggaaggggagaataggagtgatgattgctaacaggtaagagattcctgcttggggtgatgaaaatgttttggaattacatgtgtggttctacaacaaaaaactgaagtacatgcttcaagttggtgaatttcatgtcatatgaattaaaaagaatcaaaaaaccctgttctgtctacaaagtagcatcaaatttgcgactgccatatttgttgtagacattatttctatcaaagccaggacaagattttggcttaatgcctcctctcattgctgactctgtgctcaatttcacggttgaatttaggtttgatggaagagagaaggaaaatatgattcagtacatactctacaccattgccagacttttgcgaaggacaataggtacattatattgatgttagcccactgcttaatgtgtaaattaagtaaaactgtattcagaattgtgttgtctgaatacagatgtgtctaggcaaattaagaaagacagaggagggccggccgcggtggctcacgcctgtaatcccagcattttgggaggcagaggcaggcggatcacaaggtcaggagttcgagaccagcctggccaacatggcaaaatcctgtctctactaaaagtacaaaaattagccaggcatggtggcgggtgcctgtagtcccagctactaggtaggctgaggcaggagaattgcttgaacccgggaggtggaggttgcagtgagccaagatcgcaccactgcactccagtctgggcaacagagcgacattccatctcaaaaacaacaaaaaaaaaaagacaaaggaaaatgtcggtatacagagccacaaagaaatatagttctatgatgttccttctctttgggcagagcatttgatagctatgtgtgttgaattgaaaagacctgttttgttcactaaatatgaagatcgaatccttccattaaaagcttagaagtggctgggtgtggtggtgcacacctgtaatcctagcagtttgggaggcctaggggagaggatcgcttgaattgaaatcaggagtttgagaccagcctgggcaacatagcaagaccccatccctacaaaaaattaaaaatatagccaggtgtggaggggtattcctgtagtcccagctgtaggctcaggttggaggattgcatgagtccagaagtttgaaggtgcagtgagctgtgatggcacctttgcactccagcctgtgtgacagagcaagaccctgtctcgggggaaaaaaaaaaaaaaaaaagaaaaaagaaaaaacaccagggagaggtgaaagagatctaagtaagttttctagaaataaaacatgttaagtaattgaaatttgaagaacatcttcaaaagtttgtttctttccccattctcttgtcccaaatcttctaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtaggaatataagaaaatcccccttagattactcatggcaactcaatctgaagttcttccctggtgctgttcttgacttcccaacatgaccctcctggaaatcagatgtttggatttgtcttggaagacatgtatggaaccaaaaataccttatgtatatgtattttttccttgttatcttttgctgctatccagaaaaacttagtaattggcttacaaccttggtatgaaaagagcttcactactaaggtgaatgaaaactggttgtagaggctccagtcgtatagcatcatttaacatctttaccttgcgatgcctgtgctttcaggtgtgaaacatgcttgcatatcctgcacttgcccattcttcacactcagtcagctcagatttctatttatgttgggcatcactcatgttgtccagtgtgctgtcattacagtcctgtcctttattgctcagagggacccttaagtggtataggtgaaacttttcaaaagatcccataccccgtaacaggtaggtttaggtatcaaagattggtgaatagtatccatcaattactattataaaccgttttttactgattttaaatcaataagtccacataattctagacatattaatatttgtgggtcttttcaaattcctcatgcactatgatgttttgtcttttttttctttttaaagaaatgaagtcccctctgttacccaggctgaagtacagtggcacagtcattgctcactgcagcctcaaattcctgggcttaagtgattctcccatctcaggtttccaggtagctgggactgcaggtacaagcaaccatgcctggctgatttttagaatttttttgtagagacggggcatgttggctcacgcctataatcccagcactttgggaggctaaggcaggaggattgcttgagcccagcaggtcgagaccagcctgggcaacatagcaagaccctgtttgacacacaaacacatggaaaattttgtagagacaaaatctcactatgttgccctggctgatctcaaactccaggcttcatgagatcctcctacctcagcctctcaaaatgctaggattataggcatgagccacctcacccagccaacatatgtgctcttatagttttgtgatttttatgaacagtttcatttgcattcccccatgccatttttcctaatttataagtacttttcaactattttagcttgtttttctttgctattggaataagcaaataatatgtgtatcttacatatgcacattttttctttttaattaatcttgtgatgaattcttggtacatttcctggggaaaaggatttaaacatctttatggttcttaatgatttttttaaaaagaattattgaacccaaaggatcttgcaggtttcagatgttacatgtttacttttttgtgtagcaaatgttcattaattgcctactttgtgccaaattcaggcctatatcttgctgacgttaggttgtcatttttcttagttttctttgtgactattaaaacgttatcttctaattggcatgtcttgtgtgattgacaagatagtatttaaggacattttttatttcttttctttttatttttaaattaattgatcttttaagagataggtcttgttcatgcgggcgcggtggcttacgcctgtaatcccagcactttaggaggccaaggtgggcagatcacttgaggttgggagttcgagaccagtctgaccagcatagagaaaccccgtctctactaaaaatacaaaaattagctgggtatggtggcacatgcctgtaatcccagctactcgggaggctgaggcagaagaatcgcttaaactcgggaggcggaggttgcagtgagctgagatcgcgccattgcactccagcctggacgacaagagcaaaactccgtctcaaaaaacaacaacaacaaaaaaccaaaaaaaaaaagagagagataggtcttgttatattgcccagtctgaagtgcagtggctattcacagatcatagctgacagcagcctcaaactccttctgcctcagtctcccaagtagctgggactactggcatgtgccaccacacctggctgggtgcatgattttgatgaagtgatttaacttctgtttcctcatctatcaggtagatgtgaagcttaaaaagagatcagtgaagcaggaggatcgcttcaggccaggagtttgagaccagcctgcgcaacatagtgagaccctgtctctaaaaagaatttaaaaaattagccaggcgtgatgccatgtacctgtggtcccagctaatggggaggctgaggcaggaggatcacttgagtctgggagttcaaggctgcagtgagttgtgattgctgcacttctgcctgggtgacccagtgagacctatctctttaaaaataaaaaaaaggagatcaagtttgtaaaacatactaccttacatatagttagttacatgctggaagcaagttagaaataagaaaaaaattaaaaaaacattaagatggaaagtcagtgaatttttattttactttcttagtgtgtctttgcgttaaaattgtattttacacatagtaggcactcagtcattattgaatgaatcaactatgtaactcctttatgtgggggggcttctgccatttagtggatcccttagctgggaaaagggaagtagtcaagtacttttttttttttttttccctgagacggagtctcgctgtgtcacccagactggagtacagtagcacgatcttggctcactgcaacctcctcctcccgggttcaagtgattctcctgcttcccgagtagctgggattacaggcacgtgccaccacgcctggctaatttttgtatttttagtagagatggggttttgccatgttggccaaagtggtcttgaactcctgacctcaggtgattcgcccgccttggccccccaaaatgctgggattacaggcgtgagccactgcacccggccagtcaagtacttttaaatgcatgagccatgcagtgaactgaggagcacagttaaattaatggtatgtggctctcgattttgtttaatgaatgttatgtggcatttgagtctagatttatttgaatttgaggttggattcctttcgtcttcctctgggccttttctcagtctggttttaaaatcctttcctataggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggtattttgttgttataagttgtagtttatgattccgtagatgagttgatttggttttaaaataatctaaccctatgcattttagctgctataggcactgtgccctgagtgagtgtttttgtgtgtgtgtgtgttttttttttttttaatcactttctaccccttctgtggttttcacactggcctgtggagtgcagccctgcttcttggtcattgggtgatggtcacagtggatgtggccttcccacctttaccagagtttactttcttttttttgtttttttttttttgagatggagtctcgctctgtcaccaggctggagtgcagtggtgcaatctcagctcactacaacctccgcctcccaggttcaagcgattctcctgcctcagcctcccgagtagctgggactacaggtgcgtgccaccacgcccagctaatttttgtattttttagtagagacggggtttcaccatgttggccagagtggtctcgatctcttgaccttgtgatctacccgcttcggcctcccaatgtgctgggattacaggcgtgagccaccactcctggtctaccagtttactttcttttttaaaaaggtggtggtgacttttaaacacattaacaatttgtttatttaatttttagatacagggttttgctcttgtgtaagctggtatgcggtgatttgcttataactcactgtaaccttgaacttctggcctcaagctatcctcccaccttggcctctcaaagtttgattgtaagcgtgagccactgcgcccagccatgcttgctctagatattttttaaattttggtaaaaatatgcataacatacaaatttacttttttttttttttttggagaaagagtcccactcttgcctaggctggagtgtagtggcataatctcagctcactgcaacctctacctcccaggttcaagcaattcccctgcctcagcctcccaagtagctggaattgcaggtgcatgccaccatgcctggctgatttttgtattttttgtagagacggggtttcaccatgttggctaggttggtctcgaactcctgacttcaggtcatctgcccacctcagcctcccaaagtactaggattacaggtgtgaaccaccacgtccagcccaaatttaccatttttatgtgttcgattctgtggcattaagtatattcacgttgttttgcaaccatcaccaccatcagccttcaaaactttttcatacacttctgacaccaaatacatgggtttttaccacactaagcaactctctagttctctgctgataccaactactcttaaaattcagtttaattctgactctttctacttggagtttgtgtcagatcctgcaagttaaagtgctctgtcccacgagactattctcacttcagatgccagtcgcaagccccacgttgccacctgtaccatctatacattgaggattctcatgaccctctccttaagtatgataatttgctagaatgcctgacagaacccgggaaagcattttacttaggttaaccgggtcattttgaaggatactactcaggaacagccagatggatgagacgtgtggaacaaggaaggtggcggagcaggggtacgtggggctttcacgtgttctctgaacactccttccttccagcttctgagtgtgttacctgaagctgatcagatcttgttccagtatcttcgtagagcttaatctccgaagtctcccctcctcttgcctttcaggagcttgtgggtagggctgaacattccagtcttctaatcatctggtctttctggtggccagccccataactagaggtctcaccgaaagcctcattagcataaatttaggtgtgatccaaaggggctcctctgaataacaaaagacactcctattaaggttttagtctgcggagaaggaccaaatatatttattatatcatgtctctatgtaccacattttgttgatccactcacttgggttgcttccgtcttttggctattgggaataatgttgctgtgaacatgaatgtacaaatgagtcccggccgggcgtggtggctcacgcctgtaatttcagcactttgggaggctgaggtgggcagatcacctgaggtcaggagtttgagaccagcctggccaacatggtgacacctcatctctactaaaaatacaaaaattagccaggcgtggtggcgcacacctgtattctcagctactagggaggctgaggcaggagaattgcttgaactcaggaggctgatgctacagtgagcagagatggagccactgcactctaccctgggcaacagagcaaaactccatctcaaaaaaacaagaaaaacaaccaaaaaagccaaatatttgagtccctgcttctaattttttttcagtgtatacccagtagtgggattgctgcatcatatggtaattcagtgtttaactttttgaggaaccactctatggtttcctatagtgactgtacaattttacattctctccagcaactcatgagggttctggtttttccacattctcgccaatacttttttttttttttttttttttttttttttttttttttttgagacagagtctctgtcgccgaggccggagtacagtggtgtgatcttggctcactgcaaactcccctgggttcaagcgattctcctgcctcagcttcccaagtagctgagactataggcgtgcaccaccactcctggctaatttttttttgtagttttagtagagacgtggtttcaccatgttggccagactggtctcaaactcctgacctcaggtggtccgccggccatggcctcccagagtgctggcattataggcctcagccaccacgcccagcctttgccaatactaatgtcctgtttctttaatagtatccatcctaatggatatgaagttgtatctcattgtggttttgatttgtttttctctaatgatttatgatgttgagcatcttttcatgtgcttattgtccatttgtctaccttatttggagaaatatatattcaagtcctttgcccatttttcaattggattttttgttgttgagttgtaggagttctttatatgtccttgataataaccctttttcagatgcatgatttgcaaatatattctccagttccatgggtagccttttcattctgttgatagtgtcctttgcatacaagcatttcatttgcatggagtctaacttaacctatttttttccattgttgcctccacttttggtgtcatgtccaagaaatcattgccagattcagtgtcatgaacgtttctttctcttgtatttttctagatattttatagtttaacttttacatttaggtctttgatcatttgagttaatttttgtcagtggtagaaggtaaggcttcagcttcatttttttcatattagatacccagtttcctcactttttatttttaaatgtagcatgctttattattgtaagtaaataaaatgagaggtaagtaaaatatataactcccaccctagtttcactgcccaaggatgtcacttttttaatagtttggtgtcctttttatgtatatacaaagatttgttggatttattaaaagtggaaacttatactgtgcacaacagtcttcagtttctcacttaccagtatattctaaacatctgtcccctccgtcccgttagtccacacagatctacctgatgtcatatttgctcttttctgattttattgcgtttctttagaaacgggtctctactgtccatgctggagtgcagtggtgcagtcatggctcgctgcagcctcaaactcctgggctcaggcaatcctcccaccttagcctgccctgagtacctgggattataggcgagtgtcaccatgcccagctaatttttaaattttttatagagacggggccttgctgtgttggccggctggtcttgaactcctgggctgaagtgatccacccaccctggcctcccaaagtgctgagattacaggcatgagccacctcgcccagccacatttggtcttttaattttgtattacttattaataaatatgaaacttaatagaataactagcagctccatttttgtctgttttgcgtattagatttctgcttaagattacttgtgaagaaaagaatttgagaacattacattatgggagaggtcctaaccattatttagtgcagaatattgtccctaattttagatttgcctctccctgccttctttccttttttttcacaaagatctggtaaagccctgcttgtgccagtcgctagtaagtttggaggttttatagagatgagtaaaaaagccttaagttcaggaccaggtgcggtggctcacgcctgtaatcccagcactttgggaggctgaggctagcggatcttgaggtcaggagttcgagaccagcctggccaacatggtgaaaaccggtctcttctaaaaaaaaaaagaaaaaatgcacacacacacacacacaccccgagtgtggtggtgtggtggcgcgagcctgtagtcccagctactcaggaggctgaggcatgagaatcacttgagcccgggaggtagaggttgcagtgagccgagatcgcaccagtgcactccagcctggcaacagagcgagactccgtctcaaaaaaaaaaagccttaagttcttgccttcggggaactcaatttgagtgtgagagaccggcaggggacgcttactgtggtgtgaccagtaatgatgagaaacagcagtactcaggctcactgtgagggatacccagggcacactagagaaaacttaccagagggaagagaggatgggttttgaagaatgtgtaggagtggatcaggtcatgggaggggcagcataggcctgttcagattgaactgaaattgggctctttgtcactgacagctggttcttgtttgtcctccccatttacatagagtgagtctgctgtcctttccaaagcttatcaaatgtttatacatagttgtcatgttccccctacatttcttcctgaggccgaggatgatatgtgatatgggggagataattttggataagaggtaagcagggtggagaaagaaaattcagtttagataaagatttaattcatgacttaagctgagacacttactatgtggtgtgtcattatcttgctgggatttagttttcaccttcctgtgtttcttttatttttaaaaatgtctttactttttgggatggggtctcactgtgttgcccaggctctctgcagcctcagactccaggcttgtgatctcccacctcactttcccgagtagctggaactacaggtgcctgccaccattcctggctaatttttaaatttttatttatttatttatttatttatttatttatttatagagaaggggtttccctacattgcccaggctgatcttgaactcctgggctccagtgctcctcccatcttggcctccaaaagtgctgggattataggcgtgagccaccatgcccagcctatgcttattttattttatttgtgaatgaatgaatgaataacagggtctcactctgtcactcaggctggtgggtgcagtggtgtgatcttggctcactacagcctcaaactcttgggctcaggtgtccttctacttcagcctcccaagtaactgggaccacaggcatgtgccaccatacccggctttttctgtatttttctgtagaggcaaggtttcaccatgttgctggtcttgaactcctgggctcaagtgatccacctgccttggcctcccagagtgctaggattacaggcaggagccaccgcatctggccctgtgttccttttaaatgactgtgtatagcacctaggtaaccttttagatgtctaagatattaaacagttaactagtctccttagctaaatctcttctcattaggcttaagttttagtcttactactacataggttttgtttttaactcaagttcaatacagaagagtctctttcttgatgtgatctgtccaagagtcacgtctgtcctttccatttcttttcctgcaacagtgcttccttctcattgagaactcacccatcactgtagggttctcattaacttctgaagtactgtgttccacagtgaagtaaactcattttagtttgtcagatgagacttgttcttagcttagttggggaggaaaatgtgagaagtttgcaggtccagacacagtacataaatggaaagcatggaagagtttcttggaaaatcaactaggttgcctactaagtagttcagcagtgttctgcattaaaatggcattatgcctcgtggttccccaccagaggtcaactcagccacagctttgaaattttccactgctctttgctttgaaggtttccacttagcaagggccaaagttttttcaactggcactaggctgttgcatgagcttttatcagtctctaatctaggattcagcttccttatttataaaaatggattgtctctcaaatctctttttgtaatagtggttgatttcggtttttaatgcttattttgttttattgaattaaatagaaaagactgatatattgtttggcaaaatcctgggttttgtttgattgtttactttggtggcgtttgtccggacatcctgattacagatgctcctgaatttaggatggggctatgtcccaataaacccattgtttgacttacagtatttataatttatgatggttttatctgggtttaaccctatcataagtcgaggagcctgctgaatgtgtatcacttttttttttttttttttctcgagatgaagtcttgctctgtcacccaggctggagtgcagtggtgcaatctcggctcactgcagcctccgcctcccgggttcaagcaattctcctgcctcagtctcccgagtagctgggactacaggcacacatcaccacacccgcctaatttttgtatttttagtagagaccaggtttcaccatattggccaggctggtctcgaactcctgactttgtgatccgcccgcctcggcctcccaaagtgctgggattataggtgtgagccaccacgcccggccgaacgtgtatcacttttgcaccattgtgaagtcataggtttgacccatcgtaagatggggtgattctgaataaccaaaatacggaagcagcccaggtaactgtcagctgatgaatggataaacagcatgtgcaatgtctattcaatgagatattgttcagcagtaaaactgatgaaagtactgttacatgctttgcgaatgaacctagaaacatgctcagtgaaagaagccagttacaagggctacctattattgtatgatactatttaaaatctgttttttaaaaaaacgaggttaaataagcctattcccaaaacaccttcaaatttaaaaaaagttttaatgaggtcagatgagctattggatgctcagattttataattcataggaaatagtaaaaagcaggactgcccatgactgttttcttccatactgtgtgcactacatgtgaatgtccactagaggacagcaaagcccattggtagtcattccctgccagttctcaagcacttttaaagaaccgaacctgaaattcttacattgatattccattgaaaagatttgggttatcctctcaagaagagaatctgcagtagtgtctgtcagctctctttttatcaggggagaagacagcaaggcagctgtgattgtggacctcagtttactgaggagctctgcaaaagtaaggaaggagattgctgtttttcaaagcagatgttgaaatatctacaacagagtcagtcagtttccagttgaactttagcagcttcttaaatgtagatttttgtatgtgtgtttatattacttatccttgttattcataaatttatacacacaaggctccctgtgattctctgtttctataggaaagagaaaaagcagccctgttcccctcatccctctccccagtctgtttagtaccccacttcggaacagaatcaactatctttgttccttggcacctgtattttaaagcccatgaccttccaggataactggctgttttcctttaggagattcattacttcacaaggacttctttgcttcgggcagggcattgaaatccagctgtggtattggattggtggtgttgtggtaggttattgattatcttttaaatcggagttttattagctgtctaaaattgttgcattatagcatttacagcatacaggtgatcctatttttaaattatactgagttgttaggtggatttccctagaagatgcttgtccccagtcatccacccactccactgcatctctgtgtgacctttggcaagtttttttccccctttggagccttttataagaataaatggtttagattagtgaagttctaggaggcaagtgtcctcagaattctctcatactgtcccctgttcctagttctctctcagtgtctttggtcagtgtagtaatgctggcctggtttggtctctgtttaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtatatttaaatcaaatttgcttatgtgggtatattagggagtaggatttctattcccaagatcttcatttctacccaaaagaattttgtgtacacagaatataagtgtggtatagattttactctcctgcaggtctgtaacatgccagtctttgaaatgtcgtgccagggaatcagagcaggccctttgttcctcggtttagagcataacataaaagcaattgatctcttcaatcttctgattttttacagaaaacaaaattagttaatccttgtaactattttagttagtttagttttaaatcctttgattggctcagaactttagtcatctgtgaagtaagatatgtgctttcagcaggaggcagtccgggtacagagggtggcatgcagtctcatatgtgcaaaaggaacttcatggttagaagccccttgctgattggcttttcagtggctagagttattttctgagttaggttagagatgaaaagatctacgtaaaatcattcagttgctgtaaagcgttcaatcgctctagaatgaaggttggaaggagagattaccatattaagttgactcagcacaacactttttcaaatgtaagaaaccacatggtttaagggaacccatcaggggccgggcgcggtggctcacgcctgtaatcccagcactttgggaggctgaagcaggagaatcacttgaacccgggaggcggaggttgcagtgagccgagatcgcgccactgcactccagcctgggtgacagagcaagactctgtctccaaaaaaaaaaaagagagagagagaacactcatcaggcataagttgagaaacgtttggggaggtcgaaaaagcagcaaaatttcctactctcacttgggttttttgtgcctcttagtaattgttaactgttctgtcatagccatgggtaagttttgggatataaattaggagacctgattcccaaattatctgtaatctaagttatgcttcatttctttttagaaaatgcctgcatttacaaagcaacaactgggtagcattctatggaacatgtctcctcgtgtgccttgaattgtagggtgattgcctcttccttacagctcattgactgctgctgtgctcccaacaatgctattcacatttatctctctgcaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggtgagaatcttttcttttaaaaataattgaatgaataaatatgaatagctgttataattaagcttgagttattcaaacagaatgaatctaaggagctttaagttcatcttttgggtacagagcctgatcatttacagtacttcaataggagctcaaaggactctgagctaattttagctgaatgttgacatttctagttttcactgccagccacattctctgtcttcttgatcataccttcttctcaagtaatgaaatctctctctctgcctttagcctcctgttgcccacttcctgtgtcttcatgattacttctgctatcacccactgctaaaaatctcacactcattaccttccttaccgatacataatgttttcttccctatcatgagtagaacttgggtgtcaacttggaaatgaacatctctccctcatcctacaaacccattaatttgccatgatatcaatccaatgcccagatgtttgatgatccagtttcttgctctccattctccgtggtctccgctatcatttgtcccttctacatctgtcacctgggctcctttggtggcttctcaactcctctttcttatatcacgtcttctcccctcttatccacccaactattgcaacaccagaatgctgtacacaaagcaaagatctgctcacattcctgatcacaaacttctagtcttcccattgcctctagaataacatcccaattcctggcctcacttctgagactcttacacaataccagcttgggtttttattagctttagatcccatatttgtgtacttgttacagaccgtttgttgttcatccttgcctcttgtgcctttctcccagctgggaacattctctgcccagaattcccagtgggtaaactgcccatggcttcgctaaaatttcactgcgcttttgaaaagtgcttgcatccttaggcttcatggtttctcctctgtgttcagctgaacctccattctctgaagtagtattttggtgcatggatcttgtctctggttttatacatgtctgtctcccatgagattatgaatgccctgagagtagaggtggtgctttgtttttttacttgaatctcaataaggccaaataccgggccttgtaaagaggagacaccttgtacttgccaagataatactgttgttttccacactgaaatttggggttgtaaaatgtgcagcttataggtactctggcttgggcttcttttttgagacggagtttcgctcttgttgcccaggctggagtacgatggcgcgatctcggctcactgtaacttccacctcccaggttcaagcgattctgctgcctcagcctcccgagtagctaggactacaagcatgcgccaccacacccagctcattttgtatttttagtagagatggggtttctccatgttggtcaggctagtctcgaactcccgaccttaggtgatccgcctgcctcagcctcccaaagtgctgggattacaggcgtgagccacggtgcccggcctgggcttccttctaaggggcagagctgtttgatcctgaccccaccttaacagtattagcaggttcttttgcactccatcccagctgcacttagagatgagacatgttgctctgaaatggtggggctttggaccagctgttccgagctgggattaccactgctttgatattatggtcatctgcaagctgtttcagctcctggaagggggccatcaaggtgaagtcacacctgtctgggctctgtttattcttttcagtctacctcagaggtggggacagcttttagtaactgatgtattacattatctggctctttttgtgagacaaaagaaacagtgttttgtattgctttgtgtggggaagggtaggattgcattttggtcttaatttctgttgcctttggtatcttgtccaaactgtctgtggcctggcagaaggaggcatgaggcatgctgttgaaacttggtttttcatttttatgaaaaactctcctggcttacattcaggttccctccctgaattatcatacgttatacatatgtagtctgtgaagagaagtttcctgatccctgtgggatttgagcccttcttaggaccactttgggctaaaactgtgttccctacattattttttctacccacaggaactatactgaagagtctgcttctgaggacagtgaagatgatgagagtgatgaagaggaggaggaggaagaagaggaggaggaggaagaagattatgaggtggctggtttgcgatgtaagtattttgtctgcctttgtagttgatttcacagtcttctaagcttggaacgcttggaaaggctggcttggcagtaggtagtgtggccggcttgccctattccttttctcttgtgttgtgactgtggcgtaacttagctgccatgggtttaaatgggtttccaagatggcgtttaacttcctgcctggtgggagagaaggtggcttgatctcagtaacatcaacccacttgctctaagatttagtagaattcatggtcccaagtatatttatgccaaggctgctgattctcagctcctcggcatatggggacaatggggaaggaagatcttggcccattgccatctcctgacagttcttttggctgttgttttatcgctgctttcagagagtgactttttctgtctggttacagtgattttctcctccctgcagtgtgcagggttatagctttgctggtttgaaaagagacgactgattatttgaaggcttaggtggaaggatgttaggaagattcagatctgttctcactagatgccagtaggaaaaaaggcatcatcttttgtgttcaccgcattgactctcattctctcatgttcatttctcatgagtgttggagagtctggtgtttgtggctaatgtcctccagtctagcctttcttttagcagcctccctctttccaaaatacacttttttttttttttttttttttttgagatggtctcactgtcgcctgggctggagtgcagtggtatgacctcagattacctcagtctctgcctcagcctcccgagtatacagacacccaccaccacacctggctgatttttgtatttttagtagagatggagtttcaccatgttggccaggctggtctcgaactcctgagctcaagtgatctgcctgccttggcctcccaaagtgctgggattacaggcataagccactatgcccggccaatacacttttctttacaggttcgtagaaaacagaccacagatcaaaattctaatgagcttttgaagcagtggtacagttcccaagatcatagcagctctgaatggtcatacttggtataaggagtgagagagaggatgcctggcatgactagtctcttactgtagtgagactgccaaaacctaatgatttgggcttgcccgtcttctcctgtcctcccactttcccccccatacttcagaggtgtgatgtgggacaccttaagctctcacatacgtatgggctctttttgtttgttcactacgcctgatttttcaggtatcctagggtaagtgaacaaatggcccatcagtcctgcattcaggaatatcctcttctgttggtcagagtcagtgacttgggcacacctttgtttgggaacatattttttttggcggagcgggggatgggtatctttctctgttgcccaggctagagtgcactggtatgatcactgctcactgtatcctcgatctctcaggcttaagcaatcctccttacctcagcctcctgagcagctgggactacaggcacgtgccaccatgcccggcttttttgtagagatagggtcttgccatgtttcccaggctggtcttgaactcttgggttcaagtgatcctcctgccttggcctcccgaagtgctgggattacaagtgtgagccactgcgcctgatctctctgagggcagatcctgaatatggtagtatactgattctgtttatttgtaagctagtgattgctttccacttctacgttgtagctctctttccaaggaattgcttttctaagtttttacggcctcgacttgccaaaaggatctgggaagtatttggtacttcagagctttttgtcaactctatctttcagaccaccaaagatgtggttccccagtgcagctcaaggttctagcacctaagcatcagattcttaccctttcttactagcctgggcttgagctagagacgctaaagtagccaagaaagggttatcgtgatccagaaatagaatggaaagtagtgtttctggattattcgtgtcactgccttcctagacctctgtgtccagtgtcatctccccactccccaagggaaggtggtggagagcctggagctaaatcctcatggcattgtttcccagggctcactgaggaatgccagttggcttgatggtgagcacctgttgtaaacctgagacacaagtagtctcagtgcctttgtgtgtgtgtgtgtgtgtgttttttttcttttgtgagatggagttacacccttgtttcccaggctggagtgcagtggcgtgatctcggctcactgcaacctccgcctcccaggttcaagcgattttcctgcctcagcctcctgagtagctgggattaccagcatgtgccaccacgccctgctaattttgtatttttagtagagacggggtttcaccatgttggtcaggctggtcttgaactcccgacctcaggtgatccacctgcctcagcctcctaaagtggtgggattacatgtgtgagccacaacgcccggcctatattctttattctctcattggggatcctgggcagggctcttatggaggggactagccctaaattgtatttaatgaggagccttgtggcccttcatggaagtaccagcttttctctggaaagattctgatggtaagtgtagaataactctgggaattacaacatagggtttgttttacaatccagttccatcttacatgtaaatacatccactcgctcaggctgagcttgggctgtgggaaatccaggctgacctattagcaaatggcttctcatgagtgagagtttacagttgattcctgcaggggccttatggctgggagtaactgcaggacggggcaggacagaagtactgaaggacctagccctctgaagggctttggcagtggatgaaaggcacccattcttcatcggctgccactgccttttagtgtcctgttaggtaaggcaagataaaatagcaagagcaccttaaaaccaaaggaggccactgctttccttgtccaggaaaaggattctccctgcatccctttcccccatttcgaagatgctcctcccttcaccttccgttgttctctgctgaatccatagtttttctttcagtgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgagaattatttatcatcccttctctaacctttctgtttcttattccctaccccagcaattaggaattcatcaggcaacaggtgggaggggagcctcccccctcctccttcttaccaaacttgggaggctggggaggcagatgggtgagcctgtacgcagacagaagcagcaaggcctccaggaacagctatgtccggcattcccctgctgtagcctgcaaactagttagcgggcagcctgcaacttattaaggatttaaaaatagtatccatgtgtctccagtgggctcagaggggctgggtcttcattgtgggaatgtcagcaatgctggagcctcacttactgttgagtcgacagttgttatgggagggacattaccctcccctctgctccttaaccaatgtaattttagtagtttttagatctcacttgagctttaaagaacaaaaaagaaactcttgaaaaggtgcttgttttgacagatcaaattggagttaggggcttaaggcaggccatttgggagatcataaggcattagaagatgctcggtttgccacagccttgggctctgtggcctctgctgtgaatcacagcttttgttatggctacctggaatggaggccccgccccttttctctttagccacttaaccctcacatgtctacggtggaagagcccaggaagggaattggacctcttgcttttcttaccagaggcaccccacccccacagaattggctgctgttggcccagatagcatgttttgctttctgcagtggcttgttgatgcccttccatggtgtcactgtaaccccaggtccacctgttctctgagagctagtgtcctgttgacagtagcccccttcagccgacctccagcaggactgctggtaaaggcggcccccgctgcctgctctttgctgctttgattgccgtggccccgggggaggcgagtgagtggactactgggaagatgcctgccacctgggccgagggtgctccctgacttgaatatcagaaggtttcagcacctctgcgccaaggaaatagttgaactctcttccttttttgagcagatacacttattttctgccctgtccattcttcctcctgtcttgaatctgtaataacattgttctttctttcctgccaggtgcttcagaccaagcggagctcccggaggcaaagcctggagctgcagaagtgtgaagagatcctccacaagatcgtgaagtaccgcttcagctggcccttcaggtgagtgctgtgttctcaggtgcaggggagaggagtggcctggctggttctaaaagcttccagagcccctgaggggctctcagccaagcccttgcttttcaggacgtgtctcagtggcaggggcactgccgtcaaggctgtgcagattctccatttggttcttctccacagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccactctggtggctgtttgtgctctttcttggtgggtgggggtgggtagtgctgtcccgagtgctgctttcccactgacccttggagccgggtcctctgaaggcttggcctccagagtcagggcctctcagtgttcttaaccacagaaagaagtactccctccaagcctctcctggccctgtctccgtctaaaaccctgaaaaacttcatttgaaactaggaattacggtgaaaataggtttttaagccttcactatggggaaattctgccattttaaaacctttctcagggaaaaaaaattttggggaggggggcggtggggacagtctcactccatcacccaggctggaatgcagtggcgtggtctcagctcgctgcaacctccatctcctgggttcaagcaattctcctgcctcagcctcccgagtaattggggttacagggacatgccaccacgcctggctaagtttttgtatttgtagtagagccaggttttcaccatgttgtccgggctggtctcgaactcctgacctcagatgatccacccgccttggcctcccaaagtgctgggattacaggtgtgagccaccgcgcccagcctcaaggaaaatttcaaacacacaaacagtggaaaagtataatgaattcccatgcactcggctttgacggttctaccacatgtctaatcttgttttatttatgccttcatttatcttttaaagtctgactggctgatatgcgtagggtgctgctaggcagccacccgccaatggaatacagagattttgctgagccactgctgtgggcccaattactgagaaattaaactgccaattcctgaccagctgaacgaggtgaagctggtgtaatgggaagagcctttgaggcctgagccttgggcgcaggttctgctgctgagcagctttgcggccttggtaagcacgggcgagccaggtcctacacagaacacttggggaatttttgtcctgcctggaggaagcgggcttgccccaacagcagattgaattttcctgctcatccgctccagcctccagctctggagaagagaaccatgctccttctggacattttctgcatggcgacagtgacacttggggctcccagccttcctctatgaagtcctgctcctccagtaatttccccaggcacacactaggatactgccttggggtggtcacttctggtcgtgtcctggtctcagcacactcttagccactgccttaccaggctgtgaccttgtggggcagccactttgatgactgcaaatgggggcatgggaactccatctctgaggacaggggcctgagtcatgacctgggagtcagctgaggcctgtccttgtcctgcacactcttctcaagttttgtctctggggaggtgacatggtcagtagacttggttaacaggtggcatctggattccaacagagccactcagagggggcatctcttcctgctggccaggggctagggtgtctctggaggacactgaggaactcacctcccattaactgcgctctcctaaccccagccctgggcctcctggcttttcaacacctgggactgctgtgttcaggagctgcttccttgagcgggcaacttcctgggagcaggaggatcttgggctcaccacacacaagcgcaaacccacagggacaggctcagcctcccaagaggcttgcgggcgtgtggtgccgcactctgaagacccaaatgctgggcaccaggaccactaaggggaaggcccgggcctgggcacgcgatgcacatgccagcacgtgtgggtttccgaggtatttttgtttggccctggagggttctttaatgggcgtggggagaggtctggcagtggtaggggtgtttgtctcctccccacccgctttgcccagcttctggggacataaacttgccaaggcatacaccctgcctttccccaccaggacctaatcggatccctggtgtggaa

SEQ ID NO: 12909 - DNA, 43435 bp, Human
taggagaatcacttgagctcgagaaatcaaggctgaagtgagccgagatctcaccactgcacgccagcctggacaaccagagtgagaccctactcaaaaagaaactccaacctaagctatatgtttaaagttgcaaaacctagatcaatattatgtggatctccaagcacagttgctttaaaaatatatatttaatataaaaataaaaatataaaatatataaaagttacacatatataacatttcctccaagtggtgttcactctattttatgtgtatatattatatatatattatgaataaagaactgataaacattccttccagcgtgatggttccagattttttccatgctacggccaacagtagccctactagtgttggaaaaaaatggacacaaaggaataagaaattatttgttagagacatccccctgacgtacataggggtgaaataacaatttctagggtttcttttaaaaaccttcgaggcagggagagaggataggcggtggaaaaagtaaatgcggtaaaatctttgattgctgaatttaggtgacaggaacatgcagaatcactgtcgtattctctccacttttgtgtctattttaaatattaataataaaaaccaaactaatggaacccaattgtttctgattccaaaccctgtggcagacatctacatattgtaacatttcctccaagtggtggtcactctcttttttgaagttaacatcactttaaaaatgtacagcacaagtattttctcctaaatggccatttctcacagcccacacacgttgttttatgggcaagtaagcttgaattgtattaacacccccaaactgcaacataagtcagtcccaagagcagagcattcgggtctcacgcaaactactttcaggaaaccaaagtgcccttgttaaaatgcaaagtaagtggtagaagttatctttgcgcaaaatagcctaaaaatattacactcaaaaacatgggagaagtaggggtgcgagaatttccccggaaaatgtccaagacacaaacgaaagttagcgagatgttaaagcatataagcataagggtaccagaggggctggagctcggtcagggccaggggagtgggccagcaggaaaacgtttagtgcaggagagaccataaagaacgaagctggtgttgggggcgggatctacacgtgcgcctcgggaaggcgaggggatgtcgggcttggggaatgaaaatgggcgagggtcatgttgcggacaagagtgcacagaagcgaggaaagggggaggagagggctgtgggaagctgcggcgagatgagaagcagcatagggaccggagtgtcccaggcaaaggacaggagcggcgagtagagaaggcggcgatttgggagaggcgcggagggccgcgaggggaaggtcccggggagttgggaaaggaggtccaggggccgcgtgggcgggagactaccccagttacaggcggcgccggagctgctggggctgggagagggtgtcgggaccggcccaggacgccaggaccccagctaccttgagggcttccagccggtagcgctgggtggagttggggtccatcatgaccgtcaccgctttcaccagctgctcgcacagcgcgtttacttgatccatcgccatgcctagcgccacgcgccgagagcgcacaccactgcagtcccgggaccacgaggcacgacagctccctcggcgagaccacccgttggtaccgggccgcggcgggcggcgggggtgggaagctggaggaggagcgttagcagcaactcgcgctgggaagaagccggcgctgcgcacgcgcccggcccgccactgcgcacgcgcccgcggaagtggcggctcccgtgtgcaggttgagcctaggtgggcggggcgggaggcggaagggccgcggtgcgcagccgcgtcaacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttggtaagaaaatttagaaccgttcgctgtcactgtgttcagactttctatgttgccttggctattggttttataatgtagcagtgactgggccaaggttgcgtgaaatataaatcatgctaacagggataaggccctggtactgtcttctaagatttttcttgtagaaaaaagtatgtttttccctgtagttgttaaacctctctcttggaattactttcctggatgtattattacctggtgggcactaaacttgttttgtgcggattggggtaactcgagatgtttaaagggaataattgcaatcagtgaaggtttgtgcagttttgataattggccaagtgctatgtataaggtttcaaagtagtgtaatccttatccaaaagcatggcttgggcagaaagtcttcttcattttccatctttataaagctcttggccgggcgcggtggctcacgcctgtaatcccagcactttgggaggcggaggcgggcggatcacctgaggtcaggagttcgagaccagcctcaccaacatggtgaaaccccgtttctactaaacatacaaaaattatgtttgcatttttagtatttttatacaggcgtggcggtgcgcgcctgtaatcccagctactcgggaggctgaggtgggagaatcgcttgaacccgggaggcggaggttcagtgagccgagatcgcgcctttgcactccagcctgggcgacagagcgaaactccgtctcaaaaataaataaataaagctcttgctttctccagtaaatacataaacggaaaacctcaacagctttattatctgttaaagtctgcatgtctgtttttgtgattgtgtgcttagtaaattgtgtgctgaacataaatcactgcttcctattcttgctccacttctggtatttggatctaatatggtgcttagcctgtgtttttttgtgttacaatactatttgttggctcagtctgttccagtactactgaaaagccacttcaaagtagagggacttctggcatgttatagttttaacttgtaaatgtttaaagtatcacattctgcctgttttaggcgtggtcgattggaatttataaggaattaatgctttgactgctctgattttaattatttttctttccactcaccttcctgctttgcagttgtaagacgttttttttttcaaggtgaatgttagtttttgaaaaactttttttagaatacagttgggtgctcactcaactgtataacctgtgtttctcgtatttaaatcatggattgctggtgtttcgattgtcttatttaggtcttggctcccaaactgctgcatattggaattacctggagagcttttaaaaatccccggcctggcgcggtggcacacgcctgtaatcccagcactttgggaggccgaggcgggcggatcacgaggtcaggagatcgagaccatcctggctaacacggtgaaaccccgtctctactaaaaatacaaaaaattagccgggcggggtggcacgcgcctgtagtcccagctaatggggatgaggcagaggaatcacttgaaaccgggagatggaggttgcagtgagctgagatctcaccactgcacttcagcctgggtgacagacggagactctgtctaggaaaaaaaaaaatccccatgctaggccgagcgcgatggctcacgcctgtaatcccagcactttgggaggccgaggtgggtggatcgcctaaggtcaggagttagagactagcctggccaacatggtgaaacccagtctctactcgaaatacaaaaattagccgggcgtggtggcgtgcgcctgtaatcccagctactcaggaggctgaggcaggagaatcgcttgaacccgggaggcgtaggttgcagtgagccgagactgtgccattgcactccagcctgcgcaacgagaacgaaactctaactcaaaaacaacaacaacaacaaaaaactcatgcccaggtcatacccataccaattaagttagtatatatagttgtggaagtcaaatatcagtagtatttaaagcagcctggcggggggacaagagcgagactttgtctcaaaaaaaaaaaagtgtcatggtcatgaaaaacaaggaacaaccgaggaaatgccacagattggggggcagtaaagtatgtagttaataatatgccaatgttcatttttaaattttggtaattgtgttaagtaagatgttaacatcaggaaactgggagtaggagaactctaccatttttgcgattttctgtaagtctaaaagtatttcagagtaaaaggttgacatttttcatgaatgctatgatgttatatattattttctccttctcttttctctgaatttatacttgagatttgtctgtcaactgattccgtattggttctcttcccctggtgatgtgcattttaatttccatttccccatgactaatgatggtgagcctatttttatgtgccaattggctatgtttgtattttgtggttagttcttttaaggataagtatttttaaagcttttaatacctattgccttcataaaattgtactaatttatccttatgccagcagtacaggttgagtatctgtgatattgtgatatatgtatgttagtttttgtccacggttcctagctcataactcccctagctttcgttataatgttggagctcttgaagcaagcctcagaaaacagaatctctctctggccttctgccctcctttcacctgcccaaagcaggactctaatcttcccctgcctttctgattatgggtcataagactttcatttcagaagagttcctaccccataccctggagaaaggaatgctacccagagaggccaggaagaatctggacaggccttgctgggtttccccagtctattagtattagatcatatcttttttgtccagtcacatttctacacggatgtcagtcatgcctatccaatgaagtttccataaaaggcccaagaggagagggttcgaagagctgctggataggagcaaaaggaagttcctggagagtggtgttcccagggagggcatgccttgccatgtgtatctcttcatctgtatatcctttataataaactagtaaatttgattacctgagttctgtgagccactctggcaaattaactgaacccaaagaggggctcatgagattcccaatttatatccagtcagttagaagcacaggtaaaacaacctgtggcttgtgattggcatcagaagtagggggcagtcttgtgggactgagccatcaacctgtgagatctgacgctttctccaggtagataatgtcagactcgaattggaggatacccacttggtgtctgctgcagaattgattgcttgtttgttggtggggagaaatcctcacacatttggtcacagaagtctaccttattgattgttgttgagtgaaagaatcttttttttttttttttaaatttatttttttattgataattcttgggtgtttctcacagagggggatttggcagggtcatgggacaatagtggagggaaggtcagcagataaacaagtgaacaaaggtctctggtttcctaggcagaggaccctgcggccttccgcagtgtttgtgtccctgattacttgagatcagggattggtgatgactcttaacgagcatgctgccttcaagcatctgtttaacaaagcacatcttacaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcatggcccgttctcaatgagctgttgggcacacctcccagacggggtggtggccgggcagaggggctcctcacttcccagtaggggcggccgggcagaggcgcccctcacctcccggacggggcggctggccgggcggggggctgaccccccaacctccctcccggacggggcggctggccgggcagaggggctcctcacttcccagtaggggcggccgggcagaggcgcccctcacctcccggacggggcggctggccgggcaggggggctgacccccccacctccctcccggactgggcggctggccgggcggggggccgacacccccacctccctcccggacggggcggctggccgggcggggggccgacccccccacctccctcccggactgggcggctggccgggcagaggggctcctcacttcccagtaggggcggccgggcagaggcgcccctcacctcccagacggggcggctggccgggcggagggctgacccccccacctccctcccggacggcacggctggccaggcggggggctgacccccccacctccctcccggatggggcggctggccgggcggggggctgacccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcagccgggcagagacgctcctcacctcccagacggggtctcggcagggcagaggcgctcctcacatcccagatggggcggcggggcagaggcgctccccacatctcagacgatgggcgggcgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggcccgcggggcccgtccgctcctccagccgctgcctcccgggcggcgctcgccggcgcggcggcaaagactgagacagctctgctgcccgctgaactccatcctcccggcggtcgggcggcggcggctgcggtcggtcgcggcagcggctccgcttcatatctgcagctggggcccgcgggcgtcagcgccgcgactgtcccggctccgcactgccccgggccgcagcgcagccgcgccaaccaccacccgcggccaccatggccggacgggctccctaagccaccgaccccagcccgcggcgccttcgagccttctagggcctccggcgccgcgacctcctctcaagatcgagtgaaagaatcttaaaaactgttttttccactcagggtatccctaatctgaaatttgaaatcttccaaaatccaaaaaattttttgcaccaacacagcattcaaaggaaatgtttattagagcattgtaggtttaggatttttggattacggatgcttaactggtgattataatgcaaatattgcaaaatttgaaaaaaatgcaaaatctcaagcactttggatcccagccatttcagataagggatactcaacctgtatatttaaatgcctatttcattcttgttagtttccatgctcccatgctcatggtaactcatcagtgaaagaatggaattacagttttccctggcattttggattaggtgtttttctaactgtccataaaatgttgtgttacagaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtgggtatgtatcattgttattgtcacaactattcaatggtaacacagtggcactgtggcaggtcctttgttgttgtggtggtggtggtggtggtgacagggcctttctctgttgtcccatccagagcgcagtggcaccatcagctcacagcagctttgacctgggctcaagtgatcatccctcttcagtctcccaaatagttagaactacaggagcgccccaccatgccaagctgattttattttttggggggtgggtagagatggggattggttgggggggcagggctcactatattgcccaagcaggtcttgaactcccggcctcaagcagtccttctgccttggcctcccaaagtacaggaattgccagcatgagctgctgtgcctggccctatttttgagatttctgaactgctttgttttggattgaatgatggcatctgtggtcaaaaagtttctaatatgtttatagattacttgtgttaaatgttacttgtttttgcttgtgatcatataatatgttttctgtttccttttttttctaaccttagaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaagaaaaaaacattatttaaggagacataaaggagtcgaaaataatactccatgaggctaggaactggtgttttgaatttgttccatgtaaataacaccggaaaaaattctttttggttagccatcttgtctctgtgaaatgaaaaacagattttaatattgtgttttggggacagttcaaaaccattataccatataagagttgctgcctttgatatctattcagttccttaattgttcaaaattggttgttaaattcagacttaataccaattcccatgttctccatccaaaaatctaaagtatttgaaaaattgactgtgaaactgagaatttttccaggaaaggctgagtcaaactgacattgtagtacaatatcaggaattagttgctataattgaacaatatcaagggagatttctctgtttttagattaagctatctctccgcaaatattagaagtttcaccttggaatgggggatatgaatcagcatagctaagtcagaggtaggcacaaaccccagcctttaatcctaacagctaatatgtattaaacatattatcacatgccaggcacagtgttaagctctctataggcaatatctctattaaatctgacattgttataaggtaggtactaatattactcccccttcacagataaggaatcaagttcagagaagttaaataatttaagttaggctggggatggtggctcatgcctgtaatcctagcatttagggaggctgaggcgggcagatcacttgagtccaggacaccagcctgggcaacatagggaccagcctgggcaacatggggaaaccccatctctaacagaaaatacaaaaattagccaggcatggtggcacacacttgcagtcccggctactcaggaagctgagttgagaggattgcttgagcctgggaggcagaggttgcagtgggcccagatcacaccactgcactccggtctgggtgacagagtgagaccctgtctcaagaaagagaaaagttcagacagctaagtgaaagactgaggattcacatctgttttttaagattctagtatctatgttctcaaggtacactatactatgtgttgtggtataggaatcatgctttgacttaggacctgacatacttctgaattctaattctaattctatgaattagaagtctaaaggtagagtggcatacagacccacattggaattattgctagaaaagaagatagacttgactgaagattaagttttccaaatactcttaaaaataccttgcagtgatttgctcaagaggctgtgaggaagcactgaaatagagtattgttttagaaaaactcaaactatggttttcctctcctctcacaccacaagaacaatcaacacagaagacatctgtgaccaaaggtgtggaagtatttccccacacaccaatcagcagacaccagctgcatgtcctcgcactcaattccaacactgtctacctggagatggcatcagattccacatgttgagggctcaataccacaagaacaccccctccttcctttccatcacaagtccaggcctttagaacgtctgaacagctggctttaagttggggttcctgcaaccccctctttggatttgattaatttgctgaagcgactcacagaactcaggagaacacttacttatgtttattataagggatattacgaaggatacagataggttgggcatggtggctcacgcctgtaatcctagcactttgggaggctgagacaggaggattgcttgagctcagaagtttgagaccagcctgggcaacatagtaagacctcgtctctaccaaaattaaaacaaaaacaaaaacaaaaaaatttagctagacatggtgttgtgcagctctagttccagctactcaggaagctgaggtgggagggtcgcttgagcccaggagattgtggttccagagagtcatgatcaaaccactgcatgcagcctgggcaacagtgagatcctgtcaaaaagaagatgaagatgaagagatatatagagcaaggcatgtgagaaggggtgcggagctttcatgccctccctgggtgagccaccctccaggaatctctactattacagctatttggaacctctccggaccctgtcctcttgggtttttagggaggctccgttatgtactcatgactgattaaaccattggctatgggtaatcaacttgacctgcagtatctctcttcctctcccctccccagaagttgagggggtggggccaaaagtcccaaccctctaattatgccgtggtctttttggtgacctgccctatcctgaagctattagttaacattagcatacaaaaagacaaaacttgggtgattccaaggatttttggagttgtatgccaggaaactgggatgaagaccgaatatatatttcacaatattataagtatccttttctggctgtgtgtatgagtatattgctctttcttttctttttttttttttttttgtgggtgggggacggagtttcactcttgttgcccaggctagggtgcaatggtgcaatctcggctcaccacaacctccatctcttggattcaagtgattctcctgcctcagcctcccgagtagctgggattacagtcatgtgccaccgtgctggctaattttatatttttagtagaaatggggtttctccatgttggtcaggctggtctcgaactcctgacctcaggtgatccacccacctctgcctcccaaagtgctgggattacaggtgtgaactgctgcgcccgatcttgctctttattttctttgaggcctatcctcttcctagttcaaataatgatttaaaaaaaaaaaaagtcaagtatttctctaattctctaatttgagagtgttttagaacaataattatattagtttttatgggtgtcatggtgaagaggtaccgatgttttcatttttatggtaaatataaagtcaataggaacaaagaactggacactacaaagcaggtccaagccaaaggaaagcaaatatctgtatattggccggatgtggtggctcacgccggtaatcccagcacttggggaggccgaggtgggtggatcacctgaggtcaggaattcgagatcagcctggccaacatggtgaaaccctgtctctactaaaaatacaaaaaaattcaccaggcgtggtggcaggcgcctgtaatcccagctacttgggaggctgaggcaggagaattgcttgaacccgggaggtggaggttgcagtgaggcgagatgccactattgcactccagcctgggagacaagagcgagacttcatctcgaaaaacaagaaaaaaaagaaaatatctgtatattgtcgtagaaaactaggtatagagccagaagagctgcttattaaagtttgaatagaagacatacgatgagattggtatgtataccctgaggaaggttgtctgcctgcccagacacatcaccacattctaggtgcttatcttcaacttgatcatttgaatattagtatatccgtaaatggttggttaaggcatgtgtgtgtatgtggtgatgaccagttcacatgttaaccaaactcaccgttgactgaagtataaaatccatatgccagtttgttaatttatggtgagaaatactatcctggggaagaccatatactctggttcactgatcagtgcagtgttgcatgtaaattaccctttttttgaagacaaaattagaagcagaagatttcttggtggatatatgaaaataaaaggaataggtgatcatagtaatacacaaatttgaggcatttctttattttttagagagttccttgtcatatagacgtgttcatagtctgaatgctttctgccttggtagttctggcattgtgctaaaaatgtttgcctccgtgattcttccttttccatgcttctattattgaccatctgcctgccgattgaccctttcagttactattgtctagtctctgttaagccacatgtctcttgattacgtgtattattgttcattatggcagggtgggagtggagcagacaatctcaaggttgcctctgtttattgcctgcatgaatgatccttatacttcttaggtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaaggtacttccatagcatcatactgcttctgcttcctgcctttggaacctgctttgcttggtcatgctgattctccttggaataattgaaaggaaacttaaactacagcctgaatgaatcacaaggactcacatggaaggatatacaaattttcttatctttccaggtatatggctgttgagaagctgtgaaatctgtatgaaagtaaatttctctttagatataactagggcaggttagtgttatcaatagaaggcagagacctggcgcggtgattcacgcttctaatcccagcactttgggaggccgaggtgggtggatcatgaggtcaggagttcaagaccaacctggccagcatggtgaaaccccatctctactaaaaatacaaaaattagctgggcatggtggcgcgtgcctgtaatcccagctacttgggaggctgaggcaggagatttgcttgaaccaggacccaggaggtggagattgaggtgagccgagatctcgccactgcactccagcctaggctacagagggagactccgtctcaaaaaacaaaaaaatcaatagaaggctgactgagcactttgtcattggtagcttaatttatattattataacttagtgtcttggtttcttcatatataagaagggtgagctttttaaaggggggcctcaggtatagggagttgagtgattcaaaatttctaatcacttcttagcacattattacatatgggctgcacaaggcccctctcattgtattttgctacttttaccctttatagtgattttcccactccctctgtgccgcacctaccctcttgtacccacagatacatttgatatatcttagatgtctgtctttccttccttccttctttccttccttcctcccttcctttcttttctttctttccctttctttctttctttcttttttctttctttccttttcatttcatttcatttcatttctttattttgagatggagcgtcactctgtcgccctggctggagtgcagtggcatgatctcagctcgctgcaacctccgcctccagggttcaagcagttctcctgccccagcctcccaagtagctgggattacaggcatgtatccactacacgctgctaatttttgtatttttagtagagatggggtttcaccatgttggccaggcaggtctggaactcctgacctcaaatgatccacctgccttggcctcccaaagtgctggcattacaggtgtaagccactgtacctggcctatatctttataagttactcagtattgctttgtctatgtgctttttaattacaagatgattttgtgctattatagatctcattctttttctttttttttttttgagacggagtctcactctttcgcccaggccggactgcagtggcgctatctcggctcactgcaagctccgcctcccgggttcacgccattctcctgcctcagcctcctgagtagctgggattacgggcgcccgccaccgcgcccggctaatttttttgtatttttagtagagacagggtttcaccgtgttagccaagatggtctcgatctcctgaccttgtgatccgcccgcctcggcctcccaaagtgctgggattacaggtgtgagccaccgtgcccggccttcattctttttcttaattttccttcagtaatgaccttagagatgtgtccatgtggctgtatttatttgtaattgatggcttcgatggctgttacttgcagcgtaatccatgatatggatccaccatggttacagaccattttccctagtgacaaattcattggttgcttctaatgtcctgctctaacagtttacattccccctagcagtacataaaagttcctgtttcccccatattctcaacaacaactggtatcatctaatgtttaaaaatatttgccaatataatgtttgtttgttttgctttaatttacatttctctgatcactaattgagattgaagatctcttcatacacttgtaagccagctgagtttctgcttctgtgatttacttatttataatctttgcccatttttccatggaaaaatggtaaaattatttattttttgatttgcaagagttccttgtatatcctatcctaattattagttccttgtcttttttttttttttgagatggaagtctcactatgttgcccaggctggagtgcagtggctatcagtcgctattcacaggtgtgtaattatggctcactgcagccttgaactcctgggctcaaacaatcctcccacctcagcctccagagtagctagaactacaagtatgtgccatcatgcctggctaatttttaaattttttgtagagacagggtctcactatgttgcccaggcttttatatatttttttcattttctacttgattattgatgtgttgggaaatgataaatgggtttttttaatgaattcatttttatttactttatctaaaaaaaattgtgatataatctgtatgaagtgttttaataacatgtacttgaaggttaatttttttttcttagatttgaatagaattaggacaataaaaacttgcttttgtggctgggtgcggtggctcacacctgtaatccaagcactttgggaggccgaggtgggtggatcatgaggtcaggagttcaagaccagcctggccaagatggtgaaacttcgtctttaccgaaaatacaaaaaaactagctgggcatggtagcatgtgcctgtaatcccagctattcgggaggctgaagcagaaaattccttaaacccggaaggaggaggatgcagtgagctgagatcgtaccactgcactccagcctcggcaacagagcaagactccatcttaaaaaaaaaaaaacaaaaaacttgcttttgtgataatgttagattatgatagtcctagattccaggtctaagaatttgcataagaatgagggttttttttttgttttggtttttgtttttctttgagacagagccactctgtcacccaggctggagtgcagtggcgcaatctcggctcattgtaacctctgccagaatgaggtcttttttttaattgaatattatgaaagtggaattcagttgtatccccccagagcaaataattctgcatgtttcatgttttggctgggtgtggtggctcacacctgtaatcccagcactttgggaggccaaggcaggtgaatcacctgaggtcaggagttcaagaccagtctggccaacatggcgaaaccccatctctactaaaaatacaaaaattagccgggcgcagtggcaggtgcctgtaatcccagctacttgggaggctgagacaggagaatcacttgagtccaggaggcggagggtgcagtgagccgagattgcgccactgtactccagcctgggtggcgacagagcaagactctgtctcaaaaaaaaaaaagaaaaaaaaaaaaaagatgtaacatgtaaactttgcttttgctgctgaacaattgcataaaatgcctttaatgtgttgtgcagaagagtagtagtaaaactgcccagggaagcttgtgacttaaggaattattttattttctgatcctgataatgcaaagtatgtcaagctagaggctgcagatcctttagttctttggacaaaatataatggacaataaagatgtgccacttatagaggaagcaaaatcatggtacataagcttttgatatttgatattttattattctgggaccagagtcagaaatttaattatcataataagaaaggtgttctttggtcttacctttctgtaccacatcttattacataactttctttttttttagtttccatatgcaacactgatttttttggtgtcacccaggctggaatgcagttgtgagatcttggcacactgcagcctccacctccagggttcaagtgatcctcatgcctcaacctcctgagtagctgggattataggcatatgccaccatgctggctaagttttgtatttttagtagagacggggtttcgccatgttggtcaggctggtctcaaactcctggcatcaagttatccatctgccttggcctcccaaagtgctgggattacaggcatgagccaccgcacccagcctgattttttttttttttttaaatatttggaattggttttataatgccttgaatttgtggctctttaaagtttatttgagaattacatactcttaaaaatttgttgaaagctatagacccttgctggcctccgaaaaatttgtatctatacataagacaattttgcatgcagttttcaggagattcacaaaccctctgaaatccacatacctcagaattagaactagtcttacacattatattggtttttgctgcagagcattgttgaagcattctattatctctggctgaagatggtatataccttccttggtagttgaatgttaactcagatggacgtgttcctctttcttctacacttacttttcttacctatgtacatttttttattaaaaatgcccatgtttatagagaggtctatttctgtatgtcttgtgtctgttgcattagtgtgtccaacttaaatattaagctcccagatgcagtgccagcatcttattatatgtaatgttcagaacagtgcaatgtctaggaaatatttcatatcatattcctgaatctttgatgtgtgcaaccacaaaaacctgataacagaaattagctgatctaagtggatataaccttccagaaatcatttttcatggatacaatatatttcaaatctaagaaaagaggcgaggtatttgtaataccttgatactgagctttccatcaacttttccatcttgcctcctataagagctagcaatcatgctcagccctcctgcatttgcagctttgtatcttcttttttttttttttttttggagagggagtctctttctcgctctgtcgcccaggctggagtgcagtggtgcaatctcggctcactgcaatctccacctcccgggttcacgccattctcctgcctcagcctcccgagtagctgggactactgttggccgccaccacgcccggctaatttttttgtattttttttagtagagacggggtttcaccgtgttagccagcatggtctcgatctcctgacctcgtgatctgcccgccttggtctcccaaagtgctgggattacaggcgtcagccactacgcctggccttgtattttctaaaatagttatttgtgtgtaaagtttaagtagtaagatttacttaaagtacttctcagaaattgtcaaggtgaaactttcccatcattgccattttgtaactggtttgttagctaagggccttttcttttccctttgttttttcttaattcatttctttattattttaaaacacagagacatggtctcactatgttgcccgggctggtcttgatgagttcctggcctcaagcaattttcccacttcagcgtcccaaagtgccaggattataggcgtgagccactgcacctggccttacaaaacagttttataatgattatttttgagatggggtctcactgtgttgcccatgttacctgtgaactcatgctcaagtgatcctcccacttgaggcttccaagtagctggaactatcggcatgtgccactgtgtctggctttatcttataatgatcatataattattattaaagattataaaattcaatggaaagattatactatcctcatgtatcaaaagactaaatcttactagtgctcaattctccccaaattgacgtatagattcattgcagtcccttccaaaatcccacagaaattgacaaactgattctaaaatttgtatggaaatgcaaagaatgtggagtagccaaacaactttgaaaaagaactaagttggaagacatactacctgatttcaagatttaactataaatttgtaactagggaagtttggtattggtgtgagaaaatacgtagattaatggtatagaatagaaagtatacaagtagatccccacttttcaggctggggtgtgtgtggtggcaattcatttccacaaaggtgccaagataattcaacaagaaaaactcttggctgggcacagtggctcacgcctgtaatcccagcactttgagaggccagggtgagcgaatcatgacgtcatgagattgagaccatcctggccaacatggtgagaccctgtctctactaaaaatacaaaaattagctgggtgtggtggcgcatgcctataatcctagcttttcgggagggtaaggcaggagaattacttgaacccaggaggcagaggttgcagtgagctgagattgcgccactgtactccagcctagcaacagagtgagactccgtctcaaaaaaaaaaaaaaaaaaaaagaaagaaagaaaagttttttctcagctttcatgggcatttaacaccagaactacctgaagtatttcctgtagtccatttcatggtattgaagaaaaaccaaaattttatagatttttcttatcaactagagaaaaggtaaaaagcattgtagggaaataagggaattctgcttatcttctgtggtcccgttcagttaatacagataaaggattaaatttaaaaatctacattgccacaggattgcaacattacccaatctgggaaagcaatgatgaaaaaaatctaaagcagagaaaatttagctctaactgtttaaaaaggtccagaaagtcatacaattacagtaaattattcatatttttgtttcccaaagctaatatatactagtataaattgttttaaatgatggatgttttaatagtatttattgttcttaatatgtgcaagccttggtatttcaggaaaacagataattaaaaaaaaagcaaaaaatgcgcaagccactgtgctgaggaactttatttttaaaaactaccttttggccgggcacagtggctcacgcctgtaatcccagcactttgggagcccttgaggtcaggagttcaagaccagcctggccaacatggtgaaaccccatctctactaaaaatacaaaaattatctgggcctgaaggttcacagctgtagtcccagctactccggaggctgaagcaggataattgcttgaacctgggaggtggaggttgcagtgagctgcactctagcctgggcaacagagcaactccgtctcaaaaaaaataaaaaataataaactatcttttaatcctcataacagctatatgaagtgcagtttgtagacaaggaaattgaagcttagagaattatgtaacttgtccaaagtcacatggtcagtaggttatgaagccaatatttgaaccctgcttgactgcagaatgttcttttaacaattatgctctacttcttatggccatacatggtggtttacacctgtaatcccatcactttgtgaggccaaggctgggggctggggaggtggggggcatatggggggggattgcttgagtccaggagtttgagaccatccttggtgacatggtgaaaccccgtctctacaaaaaatacaaattagctgggcgtggtggcatctgcctgtagtcctagctacttgggaggccaaggtaggaggatcgcttgagctcaggaggcagagaatgccctgccaaaagacaggttttttttttttagtttttttttcttttttgaggtggagtgtcactcagctcactgcaacctccgcctcccgggttcaagtgattctcctgtctcagcctcctgagtagctgggattacaggtgtgcaccaccacgcctggctaatttttgtatttgtatttttagtagagacggggtttcaccatggtggtcaggctggtctcaaactcctgaccttgtgatctgcctgccttggcctcccaaagtgctgagattacagacgtgaaccaccgcacatggcccaaaagatagtttttaaaaataaagttccttggccggggcgcagtggctcatgcctataatcccagcactttgggaggccaaggcaggcggatcacgaggtcagaagatcaagactatcctggctaacatggtgaaaccccatccctactaaaaaaaatacaaaaaaattagccgggcgtggttgcaggcgactgtagtcccagctacttgggaggctgaggcaggagaatgacgtggactcgggaggctgaggcaggagaatggcgtggacccaggaggtgaagcttgtggtgagccgagatcgctccactgcactccagcatgggcaacagagcgagattctatctcaaaaataaataattaaataaataaaataaagttcctcagcacaatggcttgcatgtatttttctttttttttttaaattacctattttcctgaaacaccaaggcttgcacatattaagaacaatgaatactattaaaacatccatcatttaaaataatgtatactagtatatattagtgagccaagatcatgccactgcactccaacctggatgacggagtgtgactctgtctcaaaaaataaaacaattatgtctacttcatattacagataaaaggtaaagaactttaatgtggtactagaaagctagctagaatagttgaaggagaggacttcataatagataaacttgccataagccctaaagtatagatgtgtttaagcaaaggaaagaagaacagagttaaggggtaagagcttgccaggcgcggtggctcaggcctgtaatcccagcactttgggaggccaaagcgggcagatcacaaggtcaggagatcgagaccattctggctgacacggtgaaaccccatctctactaaaaatacaaaaaattagctgggcgtggtggcaggcgcctgtagtcccagctactcgggaggctgaggcaggagaatggtgtgaacccggcaggcagagcttgcagtgaggcgagatcatgccactgcactccagcctgggtgacagagtgagacttcgtctcaaaaaaaaaagaaaaaagaaaaaacctgaataaaatagggtggtgggttgcagtggatatgtgaaatattttaaagtaggttttgttgactaaatggctgcataatgaggaatgaaagagaaaataagccaatattaatgtggattttaagcccttaatagaaatagggagttggttggaaagaacatttgagaaggaagacaaagtttgattttagttatgtttagttggaaaccataattaaaaattcaagaaaagttcttctgtagggagtcaggaaaagttcttctgtagggaggtagagctaagggattagagtgtacatttggggataaagatttgtatgtactcagagtaagatattttcaaggtcctaagtcccaagcaacatctgacttaaaacagcttatcaagggaataaatctagtgcctcggagtggattttaagttactcagctggaatccacctctaaaaacatgtaaatgttaaagcttatattgaagcttgagttaattctgaatattttctaattgaaaaaaatattcttggagaagatgtttaagtgattaaatatagtaggagaaagaaaattcaagagaactggggagataaatgtgtttacattatttttttttatttttattatttttgagatgaagtcttgctctgtcgcccaggctggagtgcagtggcgcaatctcggctcactgcaacctccgcctcctgggttcaagcgaatctcctgcctcagcctcctgagtagctgtggttacaggcctgcaccaccatgcccagctagttttgtatttttagtagagacggagttttgccatgttggacaggctggtcttgaactcctgacctcaggtgatccacccgccttgctctcccaaaatgctgggattacaggcgtgagccaccgtgcctggccaaaaatgtgttttaaaatcattgctcatgaaagatgatattaatacaaaatatttgtcgtacattagcactataaaattcagcctatgctgaagctaagctgcgggaacactctgaaggagaaattgagctctcttataattggtcttctaagctggctgccatttttttgtgaaaacttatatgtctaaatacctgtaatctaagcatttctacattagatagcacaattaaataaataattttttaaatgtctaaatgtgagttcttaattcatttcagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtgaaggctaatagtagatttcaaagagaaacattgatatccttagtcaaatacagtagggacagtgggacattgaaattattacacataggccgggtgcagtttcgcacgcctatgtgagtggatcgcgtgagcccaggagttgaagagcagcctgggaaacatgttgaaacccagtctctacaaaaaattagccaggcgtggtggtgtacacctacagtcccagctactcaggaggctgagatgggaggatcagctgagtccaggaggttgaagctgccgtgagccgaaatcatactactgtacttcagcttgggcgacagtgagactgtcaccaaaaaaaaaaaaaaaaagttgttacacatgtactttgaatggatttcttttaaaattcatgttgaggcccaaatcaaagcataagtaattctttaacatggaaatggacattaaatatgtactttcctaagaagcaagctgaaggccgggcatgggggctcacgcctgtagtcccagcactttcggaggctgaggcaggtggatcacctgaggtcaggagttcgagaccagcctgaccaatatggtaaaacaccatctctactaaaaatacaaaaaaaaaaaaattagccagacatggtggcgtgcacctgcaatcccagctacccgggaggctgaggcaggagaattgctttaacctggaaggtggaggttccagtgagccaagttgtgccactgcacgccagcctgggcgacagagcaaagactccgtctcaaaaaaaaaaaaagaaaaagaaaagaaaaaccatacactataagaacaatttatatagcatttacattgtacgttataggtgttataagaaattagagatgatttaaagtatacagaaggatatacaaaggttatatgcaaatactgcaccattttatattatgggacttgatcattttatatacgggacttggggttttggtatccactggaggtcttagaaccaatcccctgcagatattgagagatgacagtatttccttaatgactgaactgtttgttggaaaaaggaggctagtctttgcacttacatacattaatgtatttcttctattttcacttgctgaattttttttttttttttttttttttgagatggagtctcgccctgttgcccaggctggagttcagtggcccaatctcagctcactgcagcctccgcctcccgggttcaggtgattctcctgcctcagcctcccgagtagctgggattacaggtgcacaccaccatgcctggctaatttttgtatttttactggagacagggtttcaccatattggccaggctggtctggaactcctgacctcaagtgattcacccacctcggcctcccaaagtgctgggattacaggcatgagccaccgcgcccggccacgtgctgaatatttttgtattatcttgttatgtggaattgcctgggtattttatgcttttgcctattccctgttttcttatgagagcaataaaaggaataatacaattttattaatttagaccactattttaatttagggtacacagacaattctcaacaatccaggagcagaataactggttttctgattaattatgaataaagtgtagcaagagcccaggactttcatccccttctgaccaaagctcagtaattgggcagtggctgattttccctggttgataccttctccgcctcccttcaatacaaggaaagttgccaaactacccatctgaatttttttggtgtttttttttttcctggttggatgaagggaaaggaaacaataacttcaatgtaatttaaaccagactaaatgttgcctagtagaagttcttaacgaatctctctaatgaatttaataattttatattttaaaacatacaaatataatttttaaattatattaaaaaattaaaaattatatttttataatttgcaaaatgataccattgaagtgcttttactcttagaaaagatttctcttggccgagtgcggtggctcacacctgtaatcccagcactttgggatcccgaggctggtggatcacctgaggttgggagttcaagaccagcctgaccaatatggagaaactccgtctctactaaaaatacaaaattagctgggcatggtggctcatgcctgtaatcccagctactcaggaggctgaggcaggagaattacttgaacccaggaggtggaggttgcagtgagctgagatcatgccattgtactccaggctgggcaacaagagtgaaactctgtctcaaaaaaaaaaaaagaaaaagagttctcttgggaggctgaggcgggtcgacagatctcaaggccatcctggccaacatggtgaaaccccgtatctaccaaaaatacaaaaattagctggacatggtggcgcacacctgtagtcccagctacttggaaggctgaggcaggagaattgtgtgaacccggtgcgggggcggttgcagtgagccaagatcacgccactgccctccagcctggtgacagagcaagactctgtctcaaaaaaaaaaaaagttctcaaggatttaagctttttcattttttaagtgctatttataagaaggtgtttgttattggagggtggttttgagcccaatctctataacagatactatattatgataatttgtgttaaattggggactcaaaatggaccaactattaatcaagaaatgtaaatgggatagggtaaaacaagtatgtttcggcatttttgtatagacatactgagaaatgcatcttgcttgagtttctcctgcagtttctgcttttcaaacctcttgaagtaggaatagatgggaaggaaaaaatgactagaggaaaacagaatgggagagatgtgggaagaacagtgaggataatgatattgcgtcatgtttcccactggggatgttgtgggataccaagttttagagatgtcttgagtttctggttttatttttgtttttaatgtagaaaccattagttacagctattaagctctgtgtgtgtgtatgttatgtgtatgtttatattcaccaactttgatgggttgacagtaatgaggtttttatactttgcatgcttccaggtcctggcaaaactggcctgtggactaaacaagcccaaccgccaaaccctggtttcacatgggtcagtcccacagctcttcagccaaatgcccattcgcaaaatgtaagtattcaggcagcatgttaaatttcacttctatccatgtgtagaaactctctggttgtagtttcttgtgttactaattaaggactggagccaggggaaatacataccaggcagttagaaggaaaacaacacagaacattttgaaacacacgctgagacttttatttttatttatttatttattttttgagacagagtttcactcttgttgcccacgctagagtgcaatggcacggtgtcagctccctgcaacctccacctcccaggttcaagcaattctcctgtctcaggctcctgagtagctggaattacaggcgcccaccaccacgcctggctaatttttgtaattttagtagagacagggtttcaccatgttggccaggcaaatctcaaactcttgacctcaggtgatttgccctcctcagcctcccaaagtgttgggattacaggcgtgagccactgcgtccagccacgctgagacttttattgaaccttcaattctgggttatctgtggcagatacttaatcctgaattaaaaaaaaatgagccaggtgtggtggctcacacctatagtcccagcacttttggtaggccagggtgggtggatcgcttgagcccaggaggtcaaaaccagtctaagcaacatagtgagaccccatctctataaaaaataaataaataggccgggtgcggtggctcacgcctgtaatcccagcactttgggaggcgaggcaggtggatcacctgaagtcaggagttcgagaccagcctggccaacatggtgaaaccctgtctctactaaaaatacaaaaattagctgagcgtggtggcgggtgcctgtaatcctagctactcgggaggctgaggcaggagaatcacttgaacccaagaggcggaggttgcagtgagccaaaatggcgcccttgcactctagcctgggtgacaagagcaagactccgtcttaaaaatatataaaaaataaataaataaaccaagttttagctaaatgtttaacttcccgctagacttttttatttaagtctgttattaagtaacaaataggaattttacttcttttctttcctctaatagcatatcaaggtgttcagggctgctgaatttcagctctcaaagtaggcattagagaagaagccaagtcaaatgaacaggttgtgcctaccagttgtgtggccttgacaaggacttataatattgtagaaaggacaaggtaaaaagcaatagtaaaagtgctgtcataagactgcataattgataaatgaattgtgcagtagaacaaacttcacaaaagaagggagtatttggagatggatttataaaaaggcatgggattttgttttgagatttggcaaaatttggagagtcagacaaaaacagcaaagcagtactgatttggagaactttttagcacaaagaagggaaagtatgagatattttcagtgaactgggacctaaagtagtttagctgcaccatattgaggaggataatggaaatagactgaaaagatggtttaaagacagattacagggagcctcaaaggctgggctaaagaattttgacttttttttttttgagacaagtcttgctctgttgcccaggctggagtgcagtggcgcgatattggctcactgtagcctccacctcctgggttcaagcgattctcctgcctcagcctgcccagtagctgggaccacagctgcatgccactacgcccgactaatttttgtatttttaggagagatgaggttttactattttggccaggctggtctcaaactcctggcctccaatgatctgcctgccttggcctcccaaagtgctgggattacaggcatgaaccactgtgcccagctgactgtttatatttaggttatgtattcctttttttttttttttttttttttgaaacagagtcttgctctgtctcccaggctggagtgcagtggcacaattaagagctcactgcagccttaacctcctgggctccagcaatcctcctgcctcagcctcccaagtagctgggagcacaggcacatgccaccatgcccagttaatttgctggagtacagtggcacaatctcggctcactgtaacctctgcctcctgggctcaagtgatcctcccacctcagcctcccaagtagctgggactacagctacatactaccacacctgactaatttttttgtattttttttgttgagacagggtttcgccatgttgttcagactgttctcaaactcctgggctcaggtgatccactcgcttctgcctcccaagtgctaggactacaggagtgagccactgcacctggccttaatttttttttgtagagttagggtcttactttgttgtccaggctggtctcaaactcctggactcaagcaatcttcccgccttggcctcccaaagtgggatcataggtgtgagccattgtgcctggccagattatatattcttaagtaaagttttagccatggaagggatttattttgtgtttgggattttaatccccaaacaggacagcaggcgttgtacaattgaacgttttatatacagtttacttgatagttaatcaaggactttaaccttttggttatgttatttttaatcttcttctcaaattctaactcccagagtaactgaattcccagaatatatgctctcatttgtcctgaaccttttggagagctgtttacaaagtagaatgtcttacgtttgctgctaattagatagttatgatgtgacctatcaattctttgtctcctttgttatcagccgtagtcttggaggaaagctaggggcctctgtcattgagatcctagggatagaatacatgggtgaactgacccagttcactgaatcccagctccagagtcattttggggagaagaatgggtaagtgattcattttttttaaaatcataacctttatggagatgctatattcaaatatagacaaaaccatctagtaaaatccagacctatctttaggttaacatttgtttcttgagattatttcactggttcttcttgcttcaatatcttgggtcactatggcccatcagtctagagtagttttttccatgtacctaggtggttgatagataagatttgttactttgatgcctgagtatatactaattacatcattcatgcatgctgagatgctatattctcttaaaatccttgtgtttaatgccctagcaagcacacacacattttgggatatgaatcagtggcttgcttggcatttttccaaaaatacaaatgatgacttggctttagaagacaaaaccagtgttctcattgtccatatattgcactggaattcactgagaagggcaggggtttcgtcagaggtccggtacactaaattttggacaaggttttcctttttcatgaaaaagataaaagggcaatataatatagttatttggttttgttttaacaagaataatcatttaatttcaccttaacgttttttgctggtcttattaggtcttggctatatgccatgtgccgagggattgaacatgatccagttaaacccaggcaactacccaaaaccattggctgtagtaagaacttcccaggaaaaacagctcttgctactcgggaacaggtaagctggcattcttgacagaacactacctcttttaaaggggtcagtgggtaggttttggtagctgtggaaggtttaataggttagaggagacctttataaagtatgaagaaaacagatgttctgtccttgggttgaaaattgactagtttatgattattacttttttctctttcgtctatcgaaataaaatggaatttctcatttgtttagtagatggagacttggaaagcctaggatattatgcttcaagtttgggtcttgtctttttctcagagctggaacatgcttgaaagtcacctgatggcaaacaagcaggaaaagaaaatgaaaggcttgagctagggcaggacagaaggactgggaacatttctatgatctggtgatcctttgattatggggagtctttggtgcacaattctgtttgggagaaaaaaaagaacaaataacaccatctagttcttaatagacttcgagtgtttaaatgaaagattaaagtctcaatacttttttaggtacaatggtggctgttgcaattagcccaggaactagaggagagactgactaaagaccgaaatgatgtaagattttctttctttattcctggggtgggctttgcaatttacatatcagctgctctttaccttatggagcaggaacaaagacagaaaaaagtattagcataggaaatatccgttttctttcttttttttttttttttttttttttgagacatggtctcactctgtctcccaggctgagtacactggcacaatcatggctcactgcaacctctacctcttaggctcaagctctcctcccaactcagcctcctgagtagctgggactacaggtgcatgccactacaactggctaaatttttttattttttgtagagacagggtcttgctaggttgctcaggctggtcttgaactccagccaaggaaattttaagaaatctttttaaattttttaattttttaatttttttttgagacatagagttttccctcttgctgcccaggctggagtgcagtggcatgatcttggctcactgcaacctccgcctctgggttcaagtgattctcctgcctcaccttcccaagtagctaggattacaggcacataccaccacacccggctaattttttgttttgtattttcagtagagacggggttctaccatattggccaggctggtcttgaatgcctcacctcaggtgatccgcccacctcagcctcccaaagtgttgggattacagacataagccaccacgcccagccagtagtggcagttttaagcacattttattgtgtatatttgatgtttacaacatgatgctatgggatacatatagtaaaatggttactatagtgtagcaaattaacgtatctatcatttcacatacttttttgtaaaaaaaaaaaaaagtagttaaaatctacttaaaatctctaatagaattttattaactatagtcctcacttgtacattagctcaatagacttgttcaccctacgtgtctgctactttatatccttttacttacatctccccatttcctcctcccctcccccatcccaggtaaccactgttttattctctatctctgtatatttgacttaaaaaaaaaattctgagcattgtacatttttctttctaatgttaaagacatctgatgattagtttctctcctttttttttttgagactgagtttcgctctatcgcccaggctggagtgcagtggagcaatcttggctcactgcaacctccacctcccaaattcaagcgattctcctgtctcagcctcccgagtaaccgggattacaggtacctgccaccatacccagctaatttttttatttttagtagagacggggttttaccttgttggctgggctgatctcgaactcctgacctcaggcgatctgcccatcttggcctcccaaagtgctgggattacaggcatgagccaccgcacccggcagtttctctctcctttttaaatagctttattgacatatactttacataccacaaaattcacccatttaaaataattcagtggttttagtatattgcagagttctacaactattctacaattttagagcatttttatcaccccccaaaagaaatcctgtgcccattaccagtcactccccatttctctcccagctactccccagccctaggcaaccactacactgcttaactgttctggacatttcatataaatgtggtcttttgtgaaaatatgtggtcttttgtgactggcttgaagtctttcacttaatatgttttcaggttcagccgtattgtagcatgtattagtacttagtcattttttgtttgttttgtttttgttttttgagacggagtctcgctctgtcaccaggccagagtgcagtagtgcagtctcggctcactgcaacatccgcctctccagttcaagtgattctgctgccttagcctcccgagtagctgggattataggcacgcgccaccacgcccagctaatttttgtatttttagtagagatagggtttcaccatgttggccagggtggtctcaatctcatgaccttgtgatcttcctgcctcagcatccaaaagtgctgggattacaggcgtgagccactgcgcccggccaggactgacacctttttatggctgaataatattctattgaattaatatataccatattttgcttatctacttattagtgaatggacatttgagtatatttccacttttggctattatgaataatgttgatatgaacattcatctacaagtttttgtgtagacacctgttttctttccagcatataccttggagtataatttctgggtcatatgttaactctatgtttagcattttgaggaatcgccagactgttttccacagtggctacaccatttcacatccttaccatcaatgtaagagggttccaatttttccacatccttgttactgactttttaaattttagccattctagtgggtgtgaaatggtatctcattatggtttggcttacattctctgataatcttttcatgtgcttgttggacatttgtatatctttggggaaatgtttgttgaaatcctgttcctgggccgggcgtggtggctcaaatttttggaggccgaggtgggcagatcacctgaggtcaggagttcgagggtagcctggccaacatggcgaaaccctgtctctactaaaaatacaaaaattagctgggcgtggtggcgggcacctgtaatcccagctacgcaggaggctgaggcaagagaatcgcttgaacctggaggtggaggttgcagtgagccgagattgcgccattgcactccagcatgagcaacaagagcaaagctccacctcaaaaataaaaaagaaaaaacaaaaatcctctccccttttttaaattgggttgtctctttattattgagttttaacatgtcccttgtcagatacgtgatttgcaaatattttctcccattctgtgggttttcttctcactttcctaatggtattgtttgatgcatcctcttcttttgaaatgtcttggagttctacaagtcaactgtacatgtcaagaatagtccaaaactgctcgttgctcctttttagctggaatgggtggtaaatgtttgttcctttggtaggcatcataaagagggatttgatccagttgcgttatcgcccttttccgcttttgcccactaggtggcacttgtttctcatctctctctaagtccctggggcctttctttccacttttttttcctaagagacagggtcttggctgtcatccgtgctggagcacagtaatacaaccttagctcactgcagccttgtagcctcaacctcctgggctcaagtaatcctcctgccttagcctcccacagtgctgggagtacaggcatgagccactgtgcctagccttttcttccctctttgtatccagtggggatccctgaaaatctatcttttaagcttcaaaggactttatgccaaaaataattcaggacatagcagatcctatcacttcactgtttaaaacattccagtggtttcccttcacacttaaggcatattaaggaattttttaaaagtaattctataaagccaaatataatctaatttcttgctacttctctgaccccatctcttatcttcccctcacttattctagtctccacttcactggcctccttccctttatctaacacactaagtaagctcttactttagcacttcccgtttctttgccctggagactctttgttcatatattcttaatatttgcttccttgatttattcaaatctctgtgcatgtattacattctccaggaggtcctccctagttaccctatcacagcagcagcctccatcactctctgccttattctgcttttcttcatagcactcatctctgtggtcatttctgttacatgtctattttttattatctatagttcctactacaacataggatccatgaggacctggactttattttgttctctcctgcatctctaggcactgtctaggcatgcagttatagttgaataattttggtcaacaaggactcctttataattgctaatttgtattccctcaagatatataaatccatacaaatgtattttttatccaaaaagtagttcctgctcttagcttgtttgccttagggatacttcttctcactagcatcttttgataggggtcccttatgtagaattttcaccttcttatatttctgcctcttgaccattatgtctcagtttgctgagattacagcattcagatgcttcagacttcactgaaaagtgagtcatgatcttgctctctcaaggcaggctcactatatggtatcttctctagataagctgtaaaaaggtgttggtagaaacttctggaattggtggcgaatgtttgtttaccataagagccccagggcagaaaaaaagatatgacttgaagcctagttccactttgctttcagacaattacttacctgaaaccttccttcagtcacaaaatagtatctagtattgtagatatttgttataattgtcctgcttagacaccatgaaaaacatttaggggagtcccattttcatttgtgctgtcctgttcccatcatctgtcaaaacatcctaggatactccgatgttccataatccaaattatgtcttcttcagttactttttacacccagaaatagcattaacacttttttgtggaaccatgtaatcagatttctattcagaaaatgcattctgttgcatatatatagattctttttttttttttttttttttttgagacagagtcttgctctgtcatccaggctggagtgcagtggcaccatcttggctcactgcaacctctgcctcccaggttcaagcaattctcctgtctcagcctcccgagtagctgggattacaggtgcctgccaccacgactggctagtttttttgtatttttcagtagagatgggatttcgccatgtttgccaggctagtctcgaactcctgacttcaggtgatccacctgtctcagcctcccaaggtgctgggattacaggcgtgagccaccatgcctggcctctttctcttttttatattttatctttactctttgcagaactcagtttacctttattcttgacttttaaactactgtttccaaaccattgtcaccctggttcttttaatttcctctcctgcagttcagtacctagaattcagatgctcctcataactttatttctggtctccatcctttccacccacagaatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtgagttcttttctagctcatcttctcagaatagatgatgattcttagctctgtcttagctctacaagacataatttttatcataaagttcctcattgtgtctaatcactcaaattttcacatgagctgaatttcagaagatgaaatatgcttttatgtacagattagtccttcaatgaggtaaagggtaaatgtcattttaaagttattattaaagtatcggccgggcgcagtggctcacgcctgtaatcccagcactttgggaggccaaggtgggtgaatcacctgaggtctgtctcagttctacaagtagtaggaatctctgtcttagctctacaagtagtaggaatctgagctcttccatctgggatagactctgactcagactaccagtacctgttactctgggagaaaatacagtaccaacctcagaaacaagacagctcagcacagatcctttgccgacagctgatacattccagttcccaggaggttagacccttactctgtattggcttggtcagggaaatgaccagttgcacttggagaacagagctcaaatttcaaggatacatttgggaacttcaaactacttgattgttctatcttaaaagcatatttcttgattataaaggtgacctgtgttcactgatattctctatctgacatcccaactcagttacaagctccactggtattataccaaatgtcatattcattagtaaacttcacttctgttggtcatgaaatataagcctctttttggagcatcttcattttctgtccagatattaatgattttcaggattggaatcctttaattgcatatttaataaagcccttactttttttaaagtattccaaattcacaatagaaatataattatgagagagaggtaagtcagttgctcacttacagatgtatattgaatattatacaaaataaaatcaaagtttagttaatcgcttattacttatctaaatatattggcagtataattatgtgtacagacctataatatggtggagtctcctagtctttgttcatagggccgggcgcggtggctcacggctgtaatcccagcactttcggaggccgaggcaggcagatcacctgaggtcaggagttcaagagcaccccagccaacatggtgaaaccctgtctctactaaaaatacaaaaattagccaggcatggtggtggatgcctataatcccagctacttgggaggctgaggcaggagaattgcttgaacctgggaggtggaggttgcggtgagccgagattgcgccattgcactccagcctgggcaacaagagcgaaattccgtctccaacaacaacaacaacaaataaataaataaataaataaagtctttgttctgagaataatttacttaatacttcctgatatatttattttcaaatattgaagttttacaaaaccaaataacaaccgtggtactaatgtacacatgaaaccttatttgaaaagttataaattgacaaactataacaaatactactcaccaacggtgtgaaactccgtgatgcacagggaagcatcaaaattatctgattataagactgtcccaaagcatgaaacctgaggatattgggatactttttttttttttttttgagacggaatctcgctcttgttgtctaggctggagtgcagtgacgcaatctcggctcactgcaacctctgcctcccgggttcaagcgattctcctgcctcagcctcctgagtagctgggattacaggtgcccgccaccacgcccggctaaattttgtacttttagtagagacagggtttctccatgttggccaggctggtctcaaattcctgacctcaggtgtttcacccacctcggcctcccaaagtgctgggattacaggcgtgagccactgcacccggccaatagtgtaataataactttaaaatgacatttaccctttacctcattgaaggactaatctgtacataaaagcatatttcatcttctgaaattcagcttatgtgaaaatttgagtgattagacacaatgaggaactttatgacaaaaatttctgatttttttttttttttttttgagagggagtctggctctgtcacccaggctggagtgcagtggcgcaatctccgctcactgcaacctctgcctcccgggttcaagcaattcttctgcctcagcctcccaagtagctgggttacaggcgtgtgtcaccacacccagctaatttttgtattttagtagagatggggtttcaccatgttggtcaggctggtctcatactcctgacctcatgacccacccgccttagcctcccaaagtgctgggattacaggtgtgagccaccgctcccggctatcacaagaatttcttaaaatgtttctgaaattgggactagtaacgaaaagcagttgtggaatttcattctctagaaattccagagtggtaagtcagtcagggttaggtagtgccctgtttaaaaacaggataatggctaagaggattttttcaagtctttctagtctaaatattctaaagctttttgttgtcctgaataaaatttcttgccccaaccctgaattacagcagctttccagtggtaccttataaaaaacaataatctctagctgtcgggaggtgagtggttgctaaattagtggttctcaagacataacatcagcatcacctaggaaattaaattctctgtcatcccaggtctgttaatctctgatacacattaacgtttgagaaccactgcagtaaagaataatttctgtggcagaaccagaatgctagtcatctatggattaaatctgtcctatggtgaaataaaacagatacaattcatggaattagcaataggtcactattttaatcttctaaattgctaatcatcttatttctttactttctgtataggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaagggattatttttatttttattttttatttttgagacggagtctccctctgtcgtcaggctagaatgcagtggtgcgttctcagctcaccgcaacctccgtctcctgggttcaagcaattctcctgcctcagcctcccaagtagctgggactacaggcacgtgctaccacactcagctaatttttgtatttttaatagagatgaggtttcaccatgttggccaggatggtctcgattgcttgacctcatgatccgcctgcctcgacctcccaaagttgctgggattacagatgttagccaccgatcctggcccccccaaaaaaaggattttaagaaaaacttctcttggccgggcgcagtggctcacgcctgcaatcccagcactttgggaggccgaggcgggcggatcacaaggtcaggagatcgagaccacggtgaaaccccgtctctactaaaaaatacaaaaaaaaattagccgggtgcggtggcaggcgcctgtagtcccagctactcgggaggctgaggcaggagaatggtgtgaacccgggaggcggagcttgcagtgagccgagagcgcgccactgcactccagcctgggtgacagagcgagactccgtctcaaaaaaaaaaaaaaaagaaaaacttctctttaggctgggtgcggttcctcatgcctataatcccagcatttagggaggctgaggtgagtggattgcaggagctcaggagttcgagaccagcctgggcaaggtggcaaaaccccgtctctactaaaaaaaattagctgggcttggtggcaggcgcctgtaatcccaggtactcgggagactgaggcaggagaattgcttgaacctggaaggtggaggttgcagtgagttgagatcacaccaatgcactccagccagggtgagagtgagagactgtctcaaaaaaaaaaaaaacaaaagaaaaacttctctctagctctgtgacgggcagttcagataataccttcaccagatttacctgttttcagctgaagaatgtgagatgaagccttgaaaccctaaaagtgatatggtaactagggcaggtctttctgtacataaaagtgacttaataaacagtgaatttcatacaggtaaaccctattataccctcagttctaaccattggcctatctcttgcgttttgttctaatgtagaattagattgctacttgactagttcaggaactctgtttagatctgataagtcataatcaaatcttgccaggcgtggtggtttatgcctgttatcccagcactttgggaggccaaggcaggtggaccacgtgaagtcaggagttcaagacaagcatggccaacatggcgaaaccctgtatctactaaaaatacaaaaattagccgggcatggtggtgggtgcgtgtaatcccagctagttgggaggctgaggcaggagaatcacttgaacctgggaggcagaggttgcagtgagccgagatttccactgcattccagcctgggcgatagagtaactctgtctcaaaaaaacccactagatcatctctagaacattgctactcccaagtatgatttgaggaacagcagcctcagtatcaccagggaacttattagaaatagtctcagcctcaccactattcccacttaattgtaatctgatattaacaagatttcccaatgtgggtcaggtgtggtggctcatgcctgtaatcccacactttgggaggccaaggtgggcggatcacttgaggctgggagtttgagaccaggctggccaacatggggaaaacccatctctacaaaaaataacaaaaattaggtgtgtgtggtgacgcatgcgtgtaatcccagctacttaggaggctgaggcaggagaatcacttgaatctgggaggcagaggttgtagtgagctgagattgtgccactgcactccagtctgggcaacagagtgacactgtttaaaaaaaaaaaaattccca

SEQ ID NO: 12910 - DNA, 17390 bp, Human
gcatacgtgggctccaacaggtcctcttccctcccagtcactgactaaccccggaaccacacagcttcccgttctcagctccacaaacttggtgccaaattcttctcccctgggaagcatccctggacacttcccaaaggaccccagtcactccagcctgttggctgccgctcactttgatgtctgcaggccagatgagggctccagatggcacattgtcagagggacacactgtggcccctgtgcccagccctgggctctctgtacatgaagcaactccagtcccaaatatgtagctgtttgggaggtcagaaatagggggtccaggagcaaactccccccaccccctttccaaagcccattccctctttagccagagccggggtgtgcagacggcagtcactagggggcgctcggccaccacagggaagctgggtgaatggagcgagcagcgtcttcgagagtgaggacgtgtgtgtctgtgtgggtgagtgagtgtgtgcgtgtggggttgagggcgttggagcggggagaaggccaggggtcactccaggattccaatagatctgtgtgtccctctccccacccgtccctgtccggctctccgccttcccctgcccccttcaatattcctagcaaagagggaacggctctcaggccctgtccgcacgtaacctcactttcctgctccctcctcgccaatgccccgcgggcgcgtgtctctggacagagtttccgggggcggatgggtaattttcaggctgtgaaccttggtgggggtcgagcttccccttcattgcggcgggctgcgggccaggcttcactgagcgtccgcagagcccgggcccgagccgcgtgtggaagggctgaggctcgcctgtccccgccccccggggcgggccgggggcggggtcccggcggggcggagccatgcgccccccccttttttttttaaaagtcggctggtagcggggaggatcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaaggtaagcggtcgtgccctgctggcgccgcgggccgctgcgagcgcctctcccggctggggacgtgcgtgcgagcgcgcgcgtgggggctccgtgccccacgcgggtccatgggcaccaggcgtgcggcgtccccctctgtcgtcttaggtgcagggggagggggcgcgcgcgctaggtgggagggtacccggagagaggctcaccgcccacgcgggccctgcccacccaccggagtcaccgcacgtacgatctgggccgaccagccgagggcgggagccggaggaggaggccgagggggctgggcttgcgttgccgctgccggctgaagtttgctcccggccgctggtcccggacgaactggaagtctgagcagcgggggcgggagccagagaccagtgggcagggggtgctcggaccttggaccgcgggagggcagagagcgtggagggggcagggcgcaggagggagaggggccttgctgtcactgccactcggtctcttcagccctcgccgcgagtttgggaaaagttttggggtggattgctgcggggaccccccctccctgctgggccacctgcgccgcgccaaccccgcccgtccccgctcgcgtcccgctcggtgcccgccctcccccgcccggccgggtgcgcgcggcgcggagccgattacatcagcccgggcctggccggccgcgtgttcccggagcctcggctgcccgaatggggagcccagagtggcgagcggcacccctccccccgccagccctccgcgggaaggtgacctctcgaggtagccccagcccggggatccagagaaccatccctaccccttcctactgtctccagaccctacctctgcccagtgctaggaggaatttcctgacgccccttctcttcacccatttcctttttagcctggagagaagcccctgtcaccccgtttattttcatttctctctgcggagaagatccatctaacccctttctggccccagagtccagggaaaggatgatcactgtcagaagtcgtggcgcgggagcccactgggcgctttgtcacattccaccgaaagtcccgacttggtgacagtgtgcttcccttccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgacgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgccccctggccttggaaggggtatgaaatttccgtcccctttcctccttggggcccaggaggagtggagggtcccgggagaatattgtcagggggaaggcagggggtgtcatgggaatgggtgagggggctgaggtgcagaatccagggggtccctgcaggagccgcagtggtaagctgtccagctggaagcctggtaactgttgttttctcttgagaggggcttcctgtgaccttggctgtctctgggagcagggctggggtacctgagtggggtgcatttggggtgtgtgggaaggagagggaaagaaagatggacagtgggactctcccctagcagggtctggtgttccgtaggctagagtgcccctctgctctgcgagtgctgggcgggaggggagttggtgagagctggagacccccaggaagggctggcagaagcctttccttttgggtgctgtcaggtccgcatgtcttggcgtgttgaccttcacagcttctggcgaggggaggaatgatctgatgcgggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtgaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggttgtgtcctgttcgactcagaagacttggagaagccagaggctgttggtgggagggaagtgaggagggaggaggggctgggtggctgggcctgtgcaccccagcccctgcccatgcccatgccttgctctctttctgtcctcagtggtcccaggctgcacccatggcagaaggaggagggcagaatcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcagggatcctaggtgttgggggaagtgtcccttgtttcccctagctcccaggggagagtggacatttagtgtcatttcctatatagacatgtcccatttgtgggaactgtaacccttcctgtgtgagctggaggcacagagggctcagcctaatgggatctcccctcccttccctggtttgcattcctttgggggtggagaaaaccccacttgactatgttcgggtgctgtgaacttccctcccaggccagcagagggctggctgtagctcccaggcgccccgcccccctgcccaaccccgagtccgcctgccttttgttccgttgtggtttggatcctcccatttctctggggacaccctggctctccccaccactgactgtggcctgtgctctccacctctggggagggaaggccctggggtcttccttcccgcgagtttccctgacctaaatctggcgtggctgggtagtggccagcagtggtgatgcccagcctgttctgcctcctccttccccaccccaggagccctttccttggcctaggacctggcttctcagccactgaccggccccctgcttccagtgcgccacttaccccttccagcttcccagtggtctctggtctgggagaggcaggacaaatggtctttgtttgctggagaaaaggttgtctgcgataaataaggaaaaccacgaaagcctggttgttggagtgtacgtgtgtgctcccccaggcagtggaggccagccctccttggaggggcggctgcctgatgaaggatgcgggtgaggttccccgcctccacctcccatgggacttggggattcattccaaggggaagctttttgggggaattcctaccccaggtctttttaccctcagttaccaaccccttgcccaggccagaccttcctgctatcccctcctgggccacaagcctggccctcctctgtcccaattgtgatgaaggggcagttcaaaacttcttgattagtcatcttctcccctatcgacttggctttaaaaaatgaccttttcagacttctagtctcgttcactctttttgatgatgctttgccgtaacccttcgtgggtagagaaggattctgtgcccattggtggtctggataaaagaaatagagacctcacaggaagcagtggactggcctgtttccccactgttctttctgttttcacacctgtggccttctccccaccttcttcccaatcaacctattgtgtacatagcccccctcattgtcctttattcttctggaaagcagaccttggagggaggagtgagggggaggctcagctgtggtctctggggggtgggggttgggagctggggtggaagtccacgaagcatacacttaagatgctttggtgaagttctaaacttcatattacccaggctgaaaaaagagcacttgttcctagggctggaaatggaagccaaaacaccacctttttcagcctgtttcagcatctttagagatcagcccaacccacttacacagttgagcagagttggaggcctagagaggggagggactggcccaaggtcataccaactcatggccagagcctgggcctcctcactggccaggtgttatttcttccctctgggtagggaacctatttcagggacaggattgctatgtggtagtggtggtggggtgcgataggcgtggcaggctgggccacaatttggagtagtcatgccagagtcctgcatttatttattctcaagggccccgcctctgtggcccagaattaccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagtctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccataataaatgctgtttttactgtgattattattgttgttatccctatcattatcatcaccatcttaacccttccctgttttgctcttttctctctccctacccattgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggcggcaggcggcagacacacagccctcttggccagggagaaaaagttgaatgttggtcattttcagaggcttgtgagtgctccgtgttaaggggcaggtaggatggggtgggggacaaggtctggcggcagtaacccttcaagacagggtgggcggctggcatcagcaagagcttgcagggaaagagagactgagagagagcacctgtgccctgccctttcccccacaccatcttgtctgcctccagtgctgtgcggacattgaagcccccaccaggcctcaaccccttgcctcttccctcagctcccagcttccagagcgaggggatgcggaaaccttccttccaccctttggtgctttctcctaagggggacagacttgccctctctggtcccttctccccctcctttcttccctgtgacagacatcctgaggtgtgttctcttgggcttggcaggcatggagagctctggttctcttgaaggggacaggctacagcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgaaggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctccgggaagcggccctgtgtggctttgctttggtcgttcccccatccctgcccaccttaccacttcttttactccccccaccgcccccgctctctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccctccctggctctcatcctcctggcccgtgtctctctctcactctctcactccactaattggcaccaacgggtagatttggtggtggcattgctggtccagggttggggtgaatgggggtgccgacttggcctggaggattaagggaggggaccctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgaatgactccttggctgaaggaggagcttgggtgggatcagacaccatgtggcggcctcccttcatctggtggaagtgccctggctcctcacggaggtggggcctctggaggggagccccctattccggcccaacccatggcacccacagaggcctccttgcagggcagcctcttcctctgggtcggaggctgtggtgggccctgccctgggccctctggccaccagcggcctggcctggggacaccgcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcggcaggtgtcctagccagtgctgcctctttccgccgctctctctgtcttttgctgtagcgctcggatccttccagggcctgggggctgaccggctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtctccctcctcagactggggctctgagggcaaggggtctggctgttcgtttaggatggggcagttttgcctacacactgaaggagctgtagcatccaagaatactagatacctttaatcctccaccagtcatggtgacaaccccaagcagcccacacattttcaagtgcccccaggatgcgtggagggaggggtctgtgcccattctcctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgtgttagggaagtccttggagtgtctcccctcccccagcaatgttcttgtggcttgtgtgtgctcaggggatgctgggaaccaggcctgggtagttggtgtggggtgctgtctgtcttggccctatgtgaaaccaagagggcgtatattagtgctggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacactgggaggggacatggggaatggagatggtccctcaccttcctggggcctcctgctctacgctaccccctcgggagcctcctgtccccagggcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcagctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcaggccggggctccctgagggcagggctggggctgttctcatactggggctttctgccccaggaccacaccttcctgtcctctctgctcttatggtgccggaggctgcagtgacccaggggcccccaggaatggggaggccgcctgcctcatcgccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctcttggtttctccttctccattgaatccttgctctagacttcctcccgccccctttccctcttcctctggggaacatggcatttgtcttgggtctgggaaaggtacgtctaatgtgtaggatatggg

SEQ ID NO: 12911 - DNA, 11103 bp, Human
agtggtgtgatctcagctcactgcaacctccaccctcaagtgattctcctgcctcagcctcccaagtagctgggattaattacaggcatgtgccaccaggcccagctactttttgtatttttagtagagatgaggtttcgccatgttggccaggccagtcttgaactcctgacctcaaatgatccacccacctcagcctctcaaagtttataggcgtgattacaggcgtgagccaccgcgctcggccaaattttgaacccagttggtctgggtctggagtttattactatacttttgctgcagcctttgaggaccggagaggaacatgtcaggggaggagactgagaacatctgaaatcatgctgactcaagggaaggagatgcttcaatttcccaggcctttcccctcgtggctcctcactgggcttcatgctcattacgtctttcccactctggtcctacatggggttgaagaacagtgggccatcttctcccctcagccctcccccaactcttctgcctccaatcgccccccacagactaggtccttctcctctccctatctctcttcccttcccattctcagttcaaatggaagcttccttgcctctcaccccactgagtagctggccccactgtgtgcccccacaacaccctgttctcacttctgtcttatcccaaccactctgagctgtaattgccaaggagcttttttaggaccatgggatttttttgttggtcatggggggtggttattggttattactgtgatagtcagttttgcttccagtagaaagaacaacgtcagacattacaggagaccttccatacatgtttgtcaagtaggtgaatgatggatgaataaaatgaggttgcaggggaagggctgtgggaaagctggcctcccccctgcaaaacgttgctgtctacactcatccaccttcctttctccaatgctggagatggaaaagctacatgttcccttgcggataaccctctaagggcattgctggcgttaggctgatagcacttggaatagtggggaggaatgagggaataaatcatggagcatgggcttagggctcacttgtagtagggtgctcccacggccttcctaggcccagggacagtgaaagaggaaagatgttttgggactaagattggggctgtgttggggacctgagcagagtgcaacccagcatgtctggggcctccccaacctgaccccacttccttgactgctggggttgaccagaaactgtaactacccaaggccagggtttcaccctttgaggaagaagaaactccacaaccactttactttttagacaacagtttccctgagaagacgctctttccaaaaaaacattttcatgcccaattccatgtgatgtgggacgttgacacaggagactgtcttccaggacccaggagaactgctcctttaaagataatgggagtcccctttccctacccgtacccctgggcactgatagggaaagatgagaaagcaagagaaattgagataaatgggcaggggataggaagcagtgcttccccatcccatcgcctacatgccctcccccaaagatgccagcttgtacggacaattaatagatatttcttttaaaacaaatgaatgatccgggaccggtggctcacagcctgtaatcccagcactttggtagtccgaggcaggcagatcgcttgaacccaggagttcgagaccagcctgggcaacgtagcgagacccccgtctctacttgtagtcccagctactcgaaaggctgaggcaggagaatcgcttgaacccaggaggcggaggttgcagtgagcagagatcaaccactgcactccagcctgggcaacagagcaagacttcgtctcaaaaaaataaaaaataaaaataaaacaaatgaattaagaaatagaagtgaaagaaggaaacagtacatgcgtggaactaatgaatggagtgaaggaggaagggggaaagagtgaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgtgagtatgggggctaggctgaatcgggatgctaactctgggcctgcccaagagccgcaacaggtcgggcacccccactcccccgtgaagatccttcaagtccccattcgctcttccaaactccagacttaactctcagcccacttttgaggtccagctaggccatggaatcatctctgtcctcccatttcggggtgggcagagctggcaggacccttaacccagccagcatcttggaaatctaccaataatccacccttaggaagagaaaattcccctgaccaagtccagtttttttgtttcttcttgctggggaaggggacatccttatttgctcaatatctgggattcccagttcctgacctcagaatgctctgtctcaaggaacaacaggtgccagttacaggttgccagtcggggccaggaagctaggcatggggggtgccaccagggtgtaggtttgggactggtcctcaggaggatggggtgagccaggctggggcactcttgccccagcagacagacaggcggctggctgccccagcttacttcctcctctgctaagaaaggggaagtgagggctagagtcagcgtccctgacatcctctacctccagagcccccagtcccactaactgtcgtgtctcactccctcacttaacccttcctcctccagacccagatggagtttggtgggagtgggccagagggcagttgaagtaaaaggcagttgtgtgggatgggttggccagttgaggatttagccccccaggaagaagaaaacattgacagaggagggaaaggttgggaactggggatgagaaatagagttggggagggctggaatccctggtcaagggtgctcatataaataggagtaggggaggcaggaggtggctgtcctaacctgctttttggagatgcagggtcctaatcctgggtggccattgataaagacagctggtggacccagtgggtgggagaggagtgacccagtcctttctgtactctgcctggatcaccagccctcaggcccagaaccccaaggttttgggggctgcacgcaagatacctctgatgacctttgatccaaggagaggggacttttgacattgccgtcttttgttagcctctcagccccagccttttccatctctagttagaagcaggtgttgtgtccagattgggtgtgtgtgtggaggggagaaatgtccgggctccccagcgagtccccagagagcagggggcactttcctccctctgttggaggtgtctgggctgtgggaggtatggaagtgggaagaggaagtgggaggaggggatactgggggagagagggaggtggctgcaagaatgtgacccagagagcaggccctggcctaggggatttccagagcagttcctccctccctccgtcactctcctgggcctctcctgctgcctgctgctaaagcctgccaccctcctgcccaagcagccccctccccagcccagacgggccttttagccaatctacccccctcactaatgccccaaggcagctgtcccggcctagaccctccatcactggctttcgttttccccacctgacgtggggaaaccccaagactggaacttcccctcccaactgcccccattacccctagattaaggttcttggccccctcaacaaatacattttctgcactacaaagacctcctcttggaggtgcacacaggaatggagggcctctgttaggcccgacctggtctgtgctatctgagaggtgcctcttgactcccagggaagggcagcaggacaggatgctgcactgtctccttgctcctcttccaagagtttctgtgtctctcccttggaatgtgtaacactgagttgcttgggggtacggggtgaccctgcaactgtctccttctttcctgtgtgctggggtggtggggtgcttagccctggaaaccccctctggactacttcggcagctttcaatttggctttgagctgcagctggctcggcagagccctgagggcaaagaggagtgggtgtgggcaggctggacaggaaggctgttgtcctgtcagcaccctgcccacatgcccacccagccaaggccctcctgaaggccagcagtgggaacttggagctccaaccctaggatcctggcttcccacaccaaccctcacttcctggcccacactctcacttcctggacctaccctatgggtagctagttaaagtttgatgtgttccttctaactccaagaccccaacccactccctctggcctgggcccttaactctaagccccgcctctgctcccctaggctggtccacctggcagtgattcatgaggccccagcggtgctgctctgttgcctggctttgctgccccaggaggtcctggacattcaaaataacctttaccaggttggtggcgagagaatgttatgcccagatacctgtttgtgccctggcagccattcccagcagccataccagtccaaaggctgctcacttaggaaaccatatgccagacactgagctagaaactgaggagacagacccaagtaagacatggcctctgtcctgaggtgcttgcatcctgggctgggggacttgtatcaacagctaaatacacagcctggtgacaagagttgtgatagagacacataccagctgctatagggtccagtgtctgtgtgcagcagccagggaaggcttacagaggagatgccatctgaatggagcctaacagagagttttgccagggagagactgcccggtgcctctatctttcctcctgcagcctaacccctgggggtaacagaggtctcctcacagggtgaggggctagactctcctcctacatgtcctttctccagggcctaaggtgacttacaagaaaagcagagagctactttcttcaccttgcttccagaattgggatcccaagagcttggtgggggaggggtgtgacaggggaagggctcggtagtatttccttggaagaacaggttatggcctttataagctgctttcaaagaagatgctggcagctggtgattcttgagcccaagcatgttcccagaggtgggagcatgctgcagtggccccatgaccctctatttgtgcctccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtgtggacagtctttaagactgcccttagggcctgtgggatgaggagggcataggagatagggacctcactcttggggaagggagggtcccagcttgtccattggtgcccctcccactgtaagcacatagatattcagtacatctttgccaaatgaatgaatggatgatttgatttcgaatttaaccagtacctactgcctgctgagaagaaaactaaatcttgcccttaagatacttagtttaatagagattagatgacctgattcattcattcaacagaaatgtactgagggttttctatgtgccagacgttatcctaggagctacacttgcatctgtgtgcaaaatagagaaagattgagatgagcaataaatgtaagaagtgaactatgtaatatgttaaaaggaagtaagtgctgtagtaaaaagcagagcagagtgagaggaaggaatgtggggagtaggagagttgatatgattgttaaatagggtggtccgggaaggcctcatggagccagtgacatctgaatagcgccctgaggaaggtgaagaatgtaaatttgaatcgaaatctctattactaagcaagggtcgggagtgtccagactagaaaggagagcaaaaaggccaggggagcacagaaggaagcggcccctgagaaagggctgggggcatgaggatcttaggtggcttttcagaaaaggtggctttcagactgggcttgaaggcaggttgtgtgtgtgtgtgtgtgtgtgtgtgtgtgtatgtatgtgtgtgtgtgtgtgtgtgtgtgtgtgttgtagtttgtgtataggaggagggtgttctttgggggtgtcactcagcagcctgacccctgaagcatgaaagtttcaataacatgactctgaaaaggtggaaactttgagttcctttccccttagacttttgagggggttttggggtttgcattttaacagtcttgtgattagagacattgagtgggctgtgagtcccttggggctgagtggtagggaggtcccagaagagagggagttggtggatgcagatcagcagccctcaccctcactctcaccccatcccaggtctggcttgtctccacattgccacccttcagaagaaccaaccactcatggaattgctgcttcggaatggagctgacattgatgtgcaggtgagacagccagcaaagcactgcccggcccagggcctgcccccacctgacacatccccaagtcccctgcccagcagtcagaagtggtggcattcacttccttatccagagcccaggcccagcacactgcctctgagggccttggctgacatccttattcctccccaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaagtaagtggcatatgctttgctctccagggccttgcacacccatagcagagagaggttctgtcattagctgaaagggccagggagccaggagtcctggggtataaccaggactctgccactgaccaactgtgggaacttgagcctgtttccttagttggtccaaggagccaaatttggactcttacagggaccctgcagttaaagtgaatcagtgaagttggccagatatgagaccatggtgtggtgaggcctataagaacccagagagccatccctgagggtctctgtactcagcttcagcaaaggcttacaaagcaggagtgtaggcccagtttttcctggtcttggactttcttgagaggtgaaactcagattttctgtacagtctttcctatttttaaatgttcagtgtaaaaaagaaacctaaatgttctgcgagtacccagcagcccccccaccccatcccccaacaacaacaaacaactccaggtccatgggctggatcacctctaagggtccctcctaactcggatattctggcattatcttagaaaaggaaggcttgtctaagtcctcagggctctgccaagcccagaggggccactattttgaggattcgtgtgaagatttgttccctgatggtcttcaactgtcatttggtggggagggagtggcccaacaggtttccctgggtcccctttcccaagtcaccttttcccatgtcctctgatcttgcttctctccattctccttctcagtcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagttgcagtgggtgctatgaagggaaaagaatagtgggaaggaaaaggatggagtcggtagagggtcatactttgggtggtccgggaaccctcgcctgaggagtatcatctcaactgggatgtaaggatgagtaaagggatgggggcagagcattagggggaaagcctgtgaattagaggaactgagagcaagccagtggggcttcacagcgggcgagtgagtgggcgaggaacgcgggcgaggccatgtagagcctcgaagatcatgggaagtgggacagaattactacccagccaacaaagcaaggagacaccttcatcctgtcagaaaacggggaaactaacacagaggagcggcttgggatgcagagcctcaatgtcctgtccacaagatggcaatggtcaccatgacctctgggacgcttatgaagggcgatgacgaagcacaggggacacgccgggcgggcgcctcttcagggctggggctccccgcgcccaggggcagcccaggtccccggaacccaagccgcgtctgcctccgggccgcgcgggggcgctgtggtccggcggcggcccggggcgctgcgtggtcgcggcaggggcggagggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccaggtgggggctagggcagcagcgagctcacgtgaccgagcccccgggccacgtgactgccgcgcctcagcacgggggccgggtggggtcccggctgctcggccgtcggccagcatatcgctgcccggagccagcggggatgggagctgcggcttggttttgtgctccttggggagcttcgggcggaggggctggggaccctgacgtcccggatcttggaggggagtgtgggggaaggggcgcttcctctgacctgagcagccggctagcgttggagggaacagaggagacctgtgtggccagaggggcggatccgcccccggggagggaggaagctctgcctggccagcgccggcgcaccccctccccgagagagagagagagagagagaggctctttgtccgggccggagctgcagcggagggggcggggaggagactccgggcactactccagtgtggtcccctctggagggcggaggggatgaggagctgcgccctaatccttatgtccgctttccttacagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggaga

SEQ ID NO: 12912 - DNA, 18466 bp, Human
gctggggaggcctcaagagtggaccgcctggagaggagggagaggttaggcccccaaaagtgaggccacaagtcctggcagcagctgtatccacaaaatgctttcttttggagtaggataatcctggcaccagcactgaccgaagcctgcccagtggacagaagatatagtgagggttgtgcatgagagggatctgccacagacatgcctctccactcccaacagaaatgtctttctggaagaatgccttgcatctagcacaaaactgattattgcccctctgtcctccagcagttcctcccaaagaccactcctaatcacctctggcctcaggcgggaggggaactaacacccacccacccctgccctccctgcaaatgggaacatcaaggttcccagtgcttaactgagggacaagtgacaatttagcagagaggcaagatttgaatccagactgtcttccagactcaggacctaccttaaaataatatctgagttgcctatggaggcagacctgcctgcaaagcccagcactcagcaagtgctcaataaatatttgatttgaattctttccatggctttgaaagtctaatcacccagactgctgctctgcaaaacagtttaacctggcctggcagttggtgggggtgggggagaggagagatggacaattgtacaagggtttattttgctacctattccatcgtggtttcagtcctcacagcctggaagttgtttccccctgctaagtttcggtcagtatgtcacactgtgacccagaaatggcttgagtccatctaggaggaagtttgcctggctagctcacagtagggaggaaaatatcctccagcgagtttgaggacttctcagctagtggtggtgggaagaggggtgatacgtttgctaagagactgggtgggaggccacccagggaggcagtgcagaaatgcatccccttgagggtcatcccaccctagaagagactaggggtgggtgagttgccttaagaactgacttcatcatttcctcctccctagtgggaggcccctcaggggtcaaataagagcctcagaagagtcaacatgcttaaggaaacacagttagaaagtgcagtctgggcagggcgcggtggctcacgcctgtaatctcagcactttgggaggcagaggcaggaggatcacctgaggtcgggagaccagcctgaccaacatggagaaaccccgtctctactaaaaatacaaaattagccgggcgtggtggcgtatgcctgtaatcccagctcctacggaggctgaggcaggagaatcgcttgaatccgggaggcggaggttgcagtgagccgagatcgcgccattgctctccagcctggacaacaagagcgaaactccgtcttaaaaaaaaaaaaaaaaaaaaaaaaagagttagacacatttgcatcccagcctccggataatttgcttattgttcccaggcaataatcctctctctctgggtgactcttgggctctatctaggttcagacgaggacagtgaggagtacaggatccaattgggattccagtcccctccccacacccgtcagaaggcttggttgggaaagaagtgagccccaagctatccgccccacccccagccctgcggggctttctgcctgccacacgccgtccctgctcactaccccatcggtttccttcgggagtcttcaaagccagtgcacgtgctcccaggtctcagggaggcgacccagggggaggggcagagagaagggggtccgagcccttgggcccctaaccccgtccctttccggagcctcgggtgcccaaaggcgccggccgccagtcccaggcccgaagggcccctcccactgagtcggctctggtctccccgcccctgagccgcgaggactggacgcagctggctgcggagctctgggcgggcgctggggtcgcctgttgcagcctctcttccgcccggcggcccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcaggtgcgcggggcggggccggggggcctggcggggcggggtggggtgggggcgaggtctgcgccgttctcacgctgccgggcgggacagggggccagtagggggacccgctgggctacagtgtctcaggggagtcagaatctttggtttctggatgcggggccacttttctgggccttcgaaggccattattagatgactgcctccccaaactccccagccacttacagatgtcccaggaacatagggtagggggaagaggtctggaaaattagcctagaagaccagcccagacctaactgaacaaagaatttagtcttctcgaaccccgagccagtacccacactgtgaacacacctgtctttacttaaaaaatcttgatgttttattcatcatggagtctttaaaaaaaaacaaaaaccgagtctcgctctgttgttcaggctggagggcagtggtgcgatcacagcctactgcagcctcgacctcatggactcaagccatcctcccacctcagcctcccaaaatgccaggaccacaggcatgcgtcaacatgctcagctaatttttttttttttttttttttaagagacagagtctccctgtgttgaccaggctggtcttgaactcctaagctcaagtgattcttctaccttggcctcccaaagtgctgggatgacagatgtgagccactgcacttggcatcatggagtcttgatttgtagacattgcattaaaacttattttggtaagggctgggtgtggtggctcacgcctgtcatcccagtgctttgggaggccaaggcgggcggatcacaaggtcaggagttcgagaccagcctgaccaacgtggtgaaaccccgtctctactaaaaaaaaaaaaaaaaatacaaaaattagctgggcgtggtggcacgtgcccgtaatcccagctactcaggaggctaaggcaggagactcgcttgaacccaggaggtggaggttgcagtgagccaagatcacgccactgcactccagcctgggtgacagagtgagactccatcttaaagaaaagaaaaaaaaaaacaaacttattttgattacattaaaatgtatctttgtttgtttgtttgtgttttcagacaaggtcttgctctgttgcccaggctggagtgcaatggcaggatgatggctcactgaagccttgtcctcccgggctctagtgaacctccggcctcagcctctggagtacctggaaccacaggctcgagccaccatgcctggctaatttattttaattttttttgtagagatggggtctcactgtgttgcccaggctagtcttgaattcctgggctcaagtgatcctcccacctcggcctccaaaagtgctgagatttcaggcatgagccaccactcctggcctaaaatttatcttgattcatgagttttttggctcccccttacattttacacccctggcaagtgcctcactggcctctccctagtcccagccctgtcacaaggccatggagatacagtcacaaacacaactgagaacacagacagtcatgagacatgtgctggttaccaacccccaggccaagcaaacacacttccagcaaacacacatgacttgttggtgacagctgagaggacacatgcctggggagagagaggactgtgtgtgaggtggtgaggcatgcatggggcctgccaagttggggagggagtctgggccaagccacggtcccatatagggtggtgaataaggtgtagagtagaggtgcagcaggaccaacccttcccaccccaccccttcgacagggacctgagggagctcagggagggagagaagccagaagaccaggcagagactgaagagagctggcaaggcctggctagaaaaactccaggcaaggcctgtgtaagttggggctcccaggctgtccagcagggggccctggcacccagcaacctctgcttgggaggtggctacagaggggtgtgggtgttggctaggggcccagcaggatggatgccagacggacttctctccaacaataacagccctggctgttgccatccaccgagctggcagggccccagtttgggtggggagaggaaccagcctttcccagtctggcctgagaccctcaccacttccctccagttttcttccacctccagccccctctgtacacaactgcagccactggccaccagccttgccatgcctggcagatcttctgaccactagccctgccacccccacagacccagagaccaggaaaggagggtggggagcgaggaagggggccaaggcagagggcagaggagggctaggagaggaagagagagagactggacaaacatgagggcaggaattagggggttgtggacagacatgaagccactctcaagtcatggggctgtgcctggaaaaataccacctaaacccatcttcctgccctctggttagggctggcggggatgtgggggatgggggtggggtgggggagggttgggaaggaatatgtgtgtcatctctgtggggcatggaaacagaaggctggggacacccattctggagtagcttggggagagccactgaccctaattagaaaagccacctctctccttagggccctgtctgtttctctggggacagggtaggactaccttatccctatgatgtgaggtactgccagttgttaatcagtgtctgtggcttctctaggggacaagcccttcgggtcagtgggcatggggtgggcagcgtgggttggattttctcctcaggacctttccagccttaggatcatcctctagcactgagtactgctggaagggcagggagtgccccccaccccaccccatttattgcccgaccaaagagagggcctccctccccctcccttggagggacttgctggaccacccctcagcacgcccacaccttcctccttagctagtgaaagacatactcagcaaggcttccgcctgtcaggatggctgggacaataggattcactgaggatataaggctgttcctagctttttctcttcccattcccacctgtgcctcagttttccaaagtgctggatttagaaagggtgaattatgagggagctggagggctttgccccacccccctccgcgcgcacacgcaagcacaggcagaggcacataccccctccaagtcaaagttgtgagtggggtggtgtttgcgcgtctgtggctgggactggatgtgtcagggatgggaaaacccatcatgctggtcacagaaaatgcgcggtggggacagaagcagttttgaaggaaaagaagaggagggggactgaaagaaagaagggggcgctgaaagggagggcgctgggaggaaaaaggtgcagtgtggaggaagcgcggcgtgggcagggcttgggaagggataacggaatatctgaggtggagtgggccgtggagcgtcggggccggtctgagcagcgggtgtgtaaatggaacagtcccgagatgaattttatgggagtctgcgcaggtccttaatgtgtggctgtaccctccagccccatgtaccccacacgatggacagacagccttggtgtggcagggcccaaagaggtcctatctaccgcaataacacgaccaggcggccctgggggcgcaggggctcggggtgggagcggcggagcgcgcggagtcgccgcggggtggcaggggtgggccgggggcggggccgcgggcgtcggggaggtggcagtgggcgcagggcggggcgagctcagcggagggcgggtttgaatgtgccccggcgggagagggaagctgcagcgagagcgcgcggatctcagcgcgggagcagtgcttctgcggcaggtgctgcccggggccggggactggggactggggactgccggggcggaagacgccgctgcccgcctgccacggagggcagggagggcgggcctgacggctccgcagcccggagaagggacgccgggtggggccccagtgcggagcgtgcggagccgcgcagcacgtggcgcgcacgggccagggagcctgaggaccctgcggggaccgggacccaagctgggcggggcggcctggctcccgggcctaaaacaggctgcggtcacgttgacctccgcaaggggcaggcgagtggacgggtgatccccatcgatctggtcggtatcagggaggggccgtgccgctgactgcgctggcggaggggtatggggatggggatggggatggaggctcgcgagcggaggtgcggggctgtctctttaaccccggtcttttactggctaaactcgtatccctggcgtctccttcctgcgcacgtcttcatttactgatttactgtgagggtatatgagagggtgaagacacacagtcctcggctttgcttaccaggagagagcagtcgtaggtcaaggctggctccaaccctgccctcacacctctaggggtctctctgcagccctgtggtagtccctttgcctactcctctcggtggcctccagaccctccaactttcctcctgcttgtgtaagctccccatgccaggatgtgtgtgatggggcggggctgagctgcctgacactcaagtcaggctgggaatgatcttggtctccacctcatttttccctttagttgaatcagagttccccccacctcccagtctacagggctaactgagaagcagcttttatacctctctccattccaaaaggagcttgaacatttaatatggattctagctcctccactcaccagctctgtgacttcaggcaagtgactcaacccctctgaacctcagctggccccatctattcagtgctagtactagcttatgggtggttgtgaagaaaagacaagagatctgcaggtagtggctagccccatatgaaatcctgggagtggagaattgcaggagaggtgttgggagtctggaggcagggaggtactcaatttggtggctactttcaggggcccacctcagcaggccaaggcatagttggagggacaccagatgctctgagctggtatcagatccctgtttgccgctgggcaaaggcagacaaaagcaaaacacgaaggctggccagctgaatgttaggatatgggcaggaggagagggctggagttgaattgtgcccaagactggtatgggaactcctgagaacagagagagcaggggtgtagcagggggccagggaagaaataaatacttcttctctaagcctaagccagttttacccaggagaacaggagctattctccccaccctaggcccccatctgctttgaagctacacctgctcttaactgccaggaatcttgcctgtggggtggagtacggggtatgcgggtatgaagtaagaacctagaggaagagtccctactacctaatagaaaacctgagacctaggcagggctcagtggctcatgcctgtaatcccagcactttgggaagccaaggtgggtgggtcacctgaggtcgggagttcgaaaccagcctggtcaacatggtgaaaccctgtctctactaaaaatacagaaatcagccgggggtggtggcaggagcctgtattcccagcttcttgggaggctgaggcaggagaatcacttgaacctgggaggcagaatttgcagtgagccgagatcatgccattgcactccagcctgggcaacaggagcaaaaactccgtctcaaaaaaaaaaaaaaaaagaaaaaatctgagacctgaggctttcccccacccccactccagtaatgccctcttgccttcatctctctagaaaatgtaaatatgattattcacccctcgtgcctaggacagtgcctggctagcatgcacaggtcctcagtaaatatttgtcgaaggcctgaatggaggaatccttctgcctctatctggaggtgtggggctgaggggctgaggaggacctctgagagcttggagtttccctggggagggttgagaggaactacagggaggtgggagagcccgtggaaggtctcatggtgcccagctgcttctgtttgtctgagtggggccagaagcaatgctgcacctgcgagagctcccctgctgagactccctgttctcttatctcccgagcgacaggggtggctttttatctcctgggtgtgcttctgcttctttgcttgcaaggcttctcagaatggggccccatgaagcctgagggactctctcctgataacaccctgtgccacctttttcattctggatccgcacccaggagcccgtggacaaggcccactgcctgagcctgaactaggagcacctcctagggactgcccaggcttgctctgctctgacccttctgctggccagtctgggcacctggtgagtgcccagaaagggagggaagggaagctgtcctttcaccccaaacagcaaggcctgggcccagctaggcctgagtgtggggaatgtgtcagtgcacatctgcctggcttcccatgccacccaatgggaaagctgtttaatctgctggtgccagggggtctccccctacacaaatggggagcaggagagggacgctgaggcagaaggataggtgctttgggatccacccctccaatcttcttttcaaggtcactcttagaaaggggaagcggacaggagcctgtgacagagaggaactaagggaggactaggtgaccctggggtcgggaggggggagggggaagggctgtgcccccacatccattatgaaatattttcttggaaaaccggccagcaactaggaagcccctgggcagtggctggaaagaaaggttaaggtgccaacagcagagagactggaatctgggttgccttcaggagaggacagccccactctagccatgaatccaggggctccccagggagggtggagagaccagacttgcagagaggggcctggggagcctctggtttgacctcagtcatcatcgatgttgtcgcagctgctgcagatctgcctgttccgtgtccttcctcctcctcccccgacctctttgctgtgtctcctccatttgtctccctccttcccttgtcatcactgtccctgacccctctcgtcctcttgcctgccttctttgactgtctttccctccctcccatcatctttcctcctccttccctcctgctctccaccctcctgtttcccagcttataaactgcttcggctgctggataaaaatagcggtggcagcggccaggccgggagccaggtagagtctgagcaggcaggggggccgcgcaggactggcctgctgggccagggggctgggtgggggtcaagttgagtcgtcctgaggggcagggtgcagagggggtcttactggactcctccactggcctgttctgtcagccctgccccctctccccctaagagcctgaggaggcctatggcagggccaagacagggcctcacactgttcctgcccccagcaggcccctgagggagggagctgtcagccagggaaaaccgagaacaccatcaccatgacaaccagtcaccagcctcaggacaggtaaggggtaaggggctgggctgtggatccagggaatgggttttcagggagctgggtgtggtgtcctttggaattgggggttgccattgctggctggccttccagccaggtagctatgagtcaggtctgcatcaggggtggggaccccgtgtgccttggctgggtgctggctggggtgtctgcgggaagggcagggtgcgtgggcagcagtccttccctggcctgtctgtgtttccactgttgctctccagccagttagcggctttcggctcctcccgccaccactgtggggagatacttggctgcacccctccttccaatgcacatctggcagaactgccctggggcctctgccttagatgacctggcccaccctggttcttgatctgatcttcctctcaattccctgcctctggagcctgtgaactcccagtcaagttagacttgcagttatgactgtgaatatgtattttggaagaagaggctgtagcttaattcaatttctcaaagggatctgggacccaagaaggctgaggaagtgatccctgagatccaaagctccttcaaagcgtcaggctctgtcctgccctccaactcaggccccagaaacccatcacgtctgccctacccaccccatctccctcctgtgccaaaggctatgaaactaggccacttttgcctgtgggggctttgagcatgtagcttaatctctctgggactgtttttccacctgtaaaataagctaaaagtatctacttcccaggaagtggatctagaagtaagggaatttaaggaggcatggcaataagtccaggccccaggttgcttccctgcctcctgtgctccattcccaggctgcctgcccattctgtccccacctccgctctcctgtgggcagttccctgaaggcctcgccggctccatttgccttattgcacagctcagtcatttcccagcgtactccccccaaccccgatcctctgtcctatgtgactttgggagtttttccttctgctctgggcctccgaaccaagcctttagcttctccaagggaagcatgtatgtgagggggttgggggggctgcagttgcattaactcggacctgctcacgtggtgtgctcaccacgccatccctgtatgaggcctgccagcggtccaggctcctgcactctggccaggcctgtcttctcactgccttgggctttatccctgccatctctgaagagagctggtgttggctctggggagggtgtgcaaacccaactggagatctacatgggccgggctggggttactcagctttcaggcaaggcctatctgggagaagctggcgtgacccggaagggccttgaggtatagggcttggggcattgccctggccaaaggtggacagtccttatttacaccctgaggcccagatggcctccagtggccccatacctcctggcctgccctgggtggtatgaactacaaagttctatttggccaggaagaaaatggctctaaggccctctcttcacagcggccctgaggcaccctgcccacctgccctgtaggtccagaatagtatgggagtttcttaacttcagaatcctctctggggagtaacacagtccctgaccagacagcataattacttccagcctgcctggtgggagtggaagacacttgctgcttgctttctcactcatccacccaccccctgcccttcggcaggatttccaaaaccatctccggatgtgtgggtcacactggttcccagcctgcagagtcccccgagccttccagggctgataaccatggtcctgtcagccatgccattcagtcctatgaccctgaccccatccccaccccaaattccaacgagcaatgtacccttttctccccccacacccataagaggacacatgcaaacggacacaaacacagacgccctgtgccctgggacctagagagactgacaacggacaggggctttcctggggctcattgtggagtggggcaggatggtgcgtcatttggcccatctttcctcctccattgcagatacaaagctgtctggcttatcttcttcatgctgggtctgggaacgctgctcccgtggaattttttcatgacggccactcaggtgaggctggagggactgggctccatggggcagtgcccactgtgcttgcaggatctgactctgtgctggtaggcacagggaaagagatttcaacactcctctctgcaacccctgcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggtgagtgcccaccccctccccagcccccagcctgaccctcactgtgtcctgcacccccttggctgagccccagctttgcccacttgtctctgccacccttggcctctcccggcaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattgtaagctgggccaggagggggcctatgggaggaggcatgcccaactacccccactcttttttcagacccagcgttagccagagagaagcccagcctccgcctggagggagtggatgctgtgagcagctgggattcagaggcctgagtgggcctggaccagggctgggagggggcagagagaagggcagctcagcctcaaggctcaccaagagtaaagtaggaatgacagggatctgtcttcttgggcacccccaaccaccagccctagctcccctgctcatgcccgccctgtttccccagcatttggtgccatcctgcagggcagcctgtttggtctggctggccttctgcctgccagctacacggcccccatcatgagtggccagggcctagcaggcttctttgcctccgtggccatgatctgcgctattgccagtaagtccggctatctacctgcccagtgccctggtgtggtggggagaggggatggggcctgtctctgatcactgacaccaccccaggtggctcggagctatcagaaagtgccttcggctactttatcacagcctgtgctgttatcattttgaccatcatctgttacctgggcctgccccgcctggtgagtaaatggagggagctggggtttggggtataggggtctggggttccagaccacgggtgttctgaggacaaaacctgaaggaggccgggattctggagattctgcctctaaatccacctcccccgtctcccttacttgataggaattctaccgctactaccagcagctcaagcttgaaggacccggggagcaggagaccaagttggacctcattagcaaaggtccgaagagcctgaggaagctggggtggaggatggtataccaggcgggggatagcatgagcaaagagaacaaagatgagtgccctgtgttagctagcagccctgagccagaggaggactgaaggactacagcagggagagggggacaataggaaataagggccggcaatgataaaatgggggcagatcctggatgaccttgaatgcctgaggtgtttggactaaaggcagtgggaagcaatttcagattcttgagtgaggagtaacatgacctgaggctcctgggagaggccaggcccccgggtcttgagttgtagggatttggaggcgaggtctgggttagggttagagtacggctgggactggttaaggaggcgtctactttcaagtaatcccagccgttttggggaatgtttatgttgtcttctgttgctctgtcttccccacaacttggagatttcttccatcccgcaggagaggagccaagagcaggcaaagaggaatctggagtttcagtctccaactctcagcccaccaatgaaagccactctatcaaagccatcctgaaaaatgtacgtaggggaggttatcctatcttctaccccttgtcctctttctctcctccttttgctccctccccctgccacccatctcctccctttctgacctgagagtggtcactcctggattcttttgtgtgtgcgtgcgtgcccatgcgtgcgtgccgggggtggggattcgtggttccttttttttgagacagagtttcacacttgttgcccaggctggagtgcaatggtgcaatctccactcgctgcaacctccatctcctgggttcaagtgattctcctgcctcagcctcccaagtagctgagattacaggcatatgccaccatgcccggctaattttttgtatttagtagagatggggtttcaccaggtcaagctggtctcaaactcctgacctcaggtgatccacccacctcggcctcccaaagtgctgagattacaggcgtgagccaccacgcctggcctggattcgtggttctttaatgcacagccaccatgaagacacaggcatttgggtgactctaccccttctatctagatctcagtcctggctttctctgtctgcttcatcttcactatcaccattgggatgtttccagccgtgactgttgaggtcaagtccagcatcgcaggcagcagcacctggggtgaggatgccacaggtttccaggatgggaacagacaggatcttgagttgggctggaagtggggaagggagggagcctgggtcaccttctccccgtttcctgggtccatttgcccttccctgggctggaagcatcttctccattttactgttggggaagctgaggcccagtgaaggttaggcttgctatacctgcctctgtgagcctgataaccacccgttcatctcctcttccagaacgttacttcattcctgtgtcctgtttcttgactttcaatatctttgactggttgggccggagcctcacagctgtattcatgtgggtaagtggaggaagagggccccaggcccctgtgggaagtaagagtccagcctggacccagagagggaacccaagaaagtatggtagtaaggggaccatttgttttaaagtcgaggcataatttatgtatagttaagtacaagtcttaagtgtacaacttaatgaatatatgtatatacacatacctgcccagatcgagatgtagaatatttccagcactccagaaggctccaccatgcccctttcaagagtaaccccctaaggagaaccaggctttgaggtttcagttcagatcctgaggggccccagatggatccttgggggcctggctgtgccctggggtggcggcctgggctgaggccctgcctggtgcccacagcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagtgagtagggctggcagggaacttggtggcatcagacaggatctagagttccagtgggggacactcagtagagggagggcaaaaggagagtccctgctcccagagctgagaggagagatggctcaggaggggctcccaggctgaggggatagtgactgtagtggaggggggcgccaagcttacttgggtggaggtggagacaggtttgcaggaaggagtgaaagacaaccccaccatacacgttccctcaaggaggagaagccaggttggggttaggcagccaggatgggttgatcaacagaatgaggttcgacagtcaagttgctccaccccacccctccttccacccagaggctctgggctggggtacagccattctgaggtagccttgcccttccttccccgcttaggaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggctccctgtgtcctccagccgtggcttcatgccctggagtgggtagagggctggcagcctgagtctgggagatgagcatgacccagctgggccctggccaggactggacctgggtccaagggggaggaggggggagtagtcctcttggcctcagaggggctgcaatgccccctgctggggccacaggggagggacaggcctggaaccagaacaccaagactgttagccaagactaagaacgggtttttctttgctgcttcattctttctttcataggacagaggatggagatagctccccatctttcctttgtcttcactgccagcccctccactctgtccccagccccagcaatgaactctgcaaaactggccagctcctggccatactcccataccaccaggcaggaagaggccgaggcctgagggttctcccctacctggcacccagccttaacaccaaagctcagcctgccagacttcctggggaacaagggccctgtgtgtctgcacagtgaaaccaacccttcccttctcaacacaaactctggcctagggaggggtgggttgttatggaactatgagtgtctcagtggagaaggccctaccactgggacccccatctcaagaatgacctgactggaagtgagaccagagctctggccacagtgcagcacccctgcaatctgcattccttaccctcccacaagtctcagactcctcccagaaagcagaagacattcctgaattctcagcgcaggctgctcactcagccctggccagcagatggctacagagttggcacctttgtcagcgcttcctttctcactggagtttaatttaattgagaacttcaggcctcattaagggctgttagcgcatttttaaggctctttgatgagctctgaagccctaatggggtagctaagtataccagggcactgggaactgaagttcatgtgctattaatcatttgtcagaccagagtatttatctgcggtgctggaaaacaaggtattccttttggatcaggctcaaaagctgaggggttccctgagtatccttcccccagtctgcagtgctgtttggcagtgagtcaagctgaacatacaaacctgagctctttctcgtcctcagtcctccgttgtacccaaccccaaagaaccctattggtttccttcctcagcaccagcagtgcctcaggattctgtatttcttcctgaggttgctttaccacctcctgcctggcccactggggcttccaggtctcttccagtccatcccacacatggccacaagaataatctgaaagtgaatctagcaggcgctgcttgttctctggagcatgcgcctgtgtcctgagcgttttctgatcctccaccaccaacagccagtttgtgcaatttctttgcacctcagagctttcataattttgtgacttttctatcatgttcttatcttactccagctaccacgctgtcatgttttttaggttaaggtgtactttttactcctgttttggcttttcaagctatgtcatacctgcctcccagaggtacttggaaaatattggcttgacagcacatgcttatcccaaggcggaattcatctctacagtcttcacatgccccactccagccgtgtggtagcacgccttgcttgtgaccctgggatagagatggggatgttaagtaggttcctctcaaccccagcactaatttgagaggaaaaactattaaggataccgttcctttctcccttcctgtacttaaattgatgttgaaggaaattactagaatattttctccccaaaattttaaaacacaaatgctaaaaaatgtcagtctcttcattctcctgacctcagtgttttcacaggtaaacctggaaggggtgaggaggttaggaaaagcagctcctaaggtctcctgcccacccagctgcagggatggctcccgaccccaagtgggcgctcgcaggcccctgccctttgg

SEQ ID NO: 12913 - DNA, 10784 bp, Human
cgtcgagtcttgacacagaaaggatccagctcaggggaagcccatccacaggagtgattcctgctttggatttaggtcctaggggtgagatcacatccctgctccatttctggagcagaaagggagctagtgcagcaaggactctgagtagacgggccttgggagtcactgaagccacttccctgttgacagaatgtgcacactgactttcatccgctcacaggagagtgagagtttgtgaatgctctctgtgaactggggagcagatttttaatgagctctgcttagaaggagaggacacgttaagggatcacgctcccactggtttgcggttttggtcaggaatagagcacccaacgccccttcttatagacttctcccagccataggctttttgcagaccataatgaaagggagaaaggatatccaatcgggatggtgatggcaggcatggcgaagtggacagggacaaagaagaggaaagcaagggacaccctttgttctttggtattcaacacatgaacaaaacttgttaacgaatcgtagactgggtaacaacagggctggtgagggaggacgatgtgggtggctgtggggaaactcttcccaagcatcccaggggtgggccaggaaggggagcagatggacatctacagggcacagagcagggagtggctattctctcctggaggggttgtgggtccagcaggctttcggatgaggccttggaaaggcaaggacagcttgccaactggagggcaggcaaaacggctgagccaggccagacacggcagctcactggccaggggcatggcctaggggctctggtgccaaggctgaaggggaacaacttggccagccgctctgtggccggcatcgtcacgcggcctccaagagctccggctgccctgcactggttcccagagactccctccttcccaggtccaaatggctgcaggagcgaagtgggcggaaaaaaagcgaaccagcttgagaaagggcttgacgtgcctgcgtagggagggcgcatgtccccgtgctccgtgtacgtggcggccgcaggggctagaggggggtcccccccgcaggtactccactctcagtctgcaaaagtgtacgcccgcagagccgccccaggtgcctgggtgttgtgtgattgacgcggggaaggaggggtcagccgatccctccccaaccctccatcccatccctgaggattgggctggtacccgcgtctctcggacaggtcagagcgggtcgccgggtggggtcgctgcaaaaaccctgccccggccgcagccggagaggcggagcctcgcggggagggggcgggaccgccgagacaggcctggaaactgctggaaatgccgcagtgccgccgccgcgccttccgccgcatgtcggcaaagagtccccgccagccccggccggcgccctccccctacgctgagctgcccctcagcgcgaaccctccgcccttcctctactcctgcgagagtcgggatctggggctacccaaggttgggtcccgaatgccagtccctctgtcgggacgcgagatgtgtagggcagatgctaggaagaagattgggtctgggagcggtggtccgcgtggttagctgcctccgctctttttcggtgtcccccccagtcccgcccttgggtgtggggacgcctgccccacaagtgtttagggaggtcagtgggttcctcgcccgtagagacaccgtttatgccaaatgagcactcctcatccccgctcttgatggagtcatgtcctagacgtgaaactatggggctgtgatcacaagcaaatgtgtgggcggatccgttgcttgggttcttccccgccccctctttttttcggaccatgacgtcaaggtgggctggtggcggcaggtgcggggttgacaatcatactcctttaaggcggagggatctacaggagggcggctgtactgtgcttcgccttatatagggcgacttggggcacgcagtagctctctcgagtcactccggcgcagtgttgggactgtctgggtatcggaaagcaagcctacgttgctcactattacgtataatccttttcttttcaaggtaaggctgagatctccgctaggcttctttccctttagtgctgtattcgtgttgtttttgtttttttctgtcctttagggagccttagtctagatgtcggggtggcttgtggataacgctctggatttttatagggtgagggtagtggtgggtgaggttttttgagtcctcctcggttttctctagtgtgtttggggggtggggctttctctcggcgcctgctggccgtagcgaggtgggctgtggggttggggcagtgggcggctggcagctgcacgtggtggccgcgcggcccgggacgctgccatttttgcccctccacttccggacgcggctacggggcgtcggagggggaccgcagggtggcgggggtgcccgctcgggtgactcagcacggccttgtgggactggctttgtcacctctcttatcggacgcgttgttaaagccttcttgggtgctttgtttctgtgagggagggttgacggtgtgggaagagagctttcggtctccagcacccgatactccctccttccagatctttcttgcagtcccggtggaggaggggcggggaggggagcaggttctggaagattcatgggctccttcctccgcccttcctcgagagctgagattgttctggaagcttctggattctggcgccccgccccagtgcccggatgctggggcgagggagggtgcactgcggcgccccctcctcgcgtggtcctggccgacgcatgtccggcagtgacgagtgtcggcctggtggctacggccaccatctttcttgggtttggtcctgttctgtaattttgtgctgtgaaagggtcgtggtggagcttttggcttaagaattctttgtccggatttaattgctcctccggtgggtatcgtatggatcccaggttattcctccctgccctatggggcaggagtgtcccgcccttggactggtcttaggaactgacacctcagggggagcagtttaaagttagtgccatttttatcttaaactagtcactttgacctcccccaaataaagaactgtaggtagtgattttcacatttaaatttgtgtaaggattacttgggatctctagatacctgggttggaccaacattatgatttttctgccatactaccagatgatgctgaggctgctggtcaccattctttaagtaggtgggttctgtgacatttggttgaagaatatttagcttattttctttttccttctgaattttcaggcctcccacttagtgtgtagtctgagatctttaagagaatgcatttttagtcttgggaagggatagtactccggttaaaccagtctgaactcactgtctaaggtcctaacaaatgatatgacctttaggatttttaaacatggggccttagtgttcttttgtaattaatgagatttttattttagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgtaggtgctctggtttccacatttggcatggtttttttttttgatactctagaaggaggggaaaggagtggtttggcctttgttggggactactattgaagggggtaaacttgcagctattccaaaaagatgggttttactctggccatcttgaacttggaagggactatgtccagaataagtgggctcatggaactaactggttctaaagcctcaagatagggggcaatcagatttgaggctgagagaggtaaaccaagattttctttgaagatacgggctttaagaaagcaaaagtggctgagcgtgttggctcacacctgtaatgccaaggcaggaggatcacttgagcctaggatttcgagggcagcctgggcaaccgcgagaccttgtctctgcaaaaaattaaatattagttgggcacggtggcatgtgcctgtagtcccagctacttgggaagctggggttgggaggatggctcgaacctgggaggtcaaggctgcagtgagctgtcatccttgccactgcactgtagcttgggcaacagagcaagagtctgtcttggaaagagcaaaagtaagttgctgtttgtatttccaggccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggtattgcagttctgtaggcattcatacttatctgtgttctttggttttttgcttctttaaaacttgtgattgactttaaacttgttggcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtaagttagcttttctgttacaaggtagttgggttaggattttctgggctcacaccagtagcagaaattttgggcatcctgtctgtaaagcagttcttcacagcagttctgctgatacttactaattgctggtctcaactgcatatactttttaccctgttacacgcttgtaattgactcttctaggtgagcccattggcaggggtaccaaagtgatcctccatcttaaagaagatcagacagagtacctagaagagaggcgggtcaaagaagtagtgaagaagcattctcagttcataggctatcccatcaccctttatgtgagtatggacttttaaatcttttacacttaacgtgcaggatgtttcctgttctggagaatctcattgtccctggcttttgctttccctggtagtgttttgtactccaaggctaacttctgtttttgttacttagttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaaggtgtgagaagcctttgcatgttggctcaacatgcacatatggagaggaatgagttaggtggaagagtgttgggtaatagacacacggaacttgtccaactgataacagaaatgtgatagccatgtgatttcacttactgattaccctgtcatagtgaagtgccatcatttctaatgacctcactttctcttcttatggaaatctgggtaatgtctattggcagccttacacatccagggttctgatcagaggggactgttttctacatacagctagtacccatctagatcgtggagggcattaaggctcagttttctcaggagctgcttgttgtgtgtgctctatcccttaggcttagggaggatcattgttccacttttagataatttggtgttggggctaaaaggtcctcttttgaaatgtaccacttatttttggtttctttcagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcagtgagtatctccttggcctaatttagttgggtgaagtcttgggaggttttaggcattctgctaggatattctaaggtaacagttttctgcaatacatagtaggtgtaagggttcaggaggctattagagccttctgtttgaatctggggaccaggtctggtctagctgttttttactgagctttctcaccctggttgatggcagattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaaggtaaaaaggcaaataatgcttattccctttaccactttcttagtaataacaataaattattccattcacattgaaagtgaagttattgtagttaagctggattgtttttcctcttcccacccttcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgcgttgactctgattgaagcctttttggaggagtggggagcacaattagggcttcctgggaactggcagtatgaggcattttagtcactgagttcatttaattaccctacaggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtaagccattctggggctaggatatattttgtaacatcttcgaggtgggctccctcacaagcatgtttctatacaattagtggtttgaggcagcctatttactgtttcatgccttcttgcctcttgttctcttctctagtcaggtttaaggctattttaataaaatttggcacagattaggcattgcttcagttaacttctgagagtagataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccacctcggcctcccaaagtgctgggattaacaggcgcaagccaccatgcctggccgattttttttttttttggactggatctcgctcactgcaaactcaagtctcctgagtggctgggattacagatgtgtgctaccacacccggttaattttttgtagacagggttttgccatgttggccagcatggtctcaaactcaagtggtctgtccacctcctccccctgctggaattaggcttgacaatgcctgttttctctttcaaagtggtaatgtcaatctaaggcttttgtgatcgtccacaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtaagtagctttggtacttggtgtggcaaggagtttgtgcaactcgtctcctctatggatttgacttaatgctatttggtcaagtctcacatggcttaattttacttcaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttatacagttctgctttcccttgtgaagtggatgttatccttccctagcttcttcatccctccagctcttgctgttttcatgagcacagcaagttgagctggttttgtagtgaaaataacagaataccagtgagtcttaagagttcacacactgaagctaaaggcagtttggaaaaactaccatataataatgccctttcagtcaaccaaaacacaggaccaagtccactgcagtaatttaatttaataaaataaaattataagagcaaaaagttacatttctaaagtaccaaaacctgcaacaggctcatggaacagagcctagggatccaggagcataggaggtggtggtgctgggcagggctctgcatcccctttcctcagcacagcaccatcttcaccctcctgggaaagcagcattggagcctacaccgcttgtgcttttctcaccagggtaagaaatgcaggtatttgcagaggggagtgagtctggaaggtggcagagcacagctagggcaagacttaagggaacttgtgggaagagtaactgtggaacctacctatgctctcttgaccccaaactccccaaaacccctcactgaggactgtctacccccggggctcagaataaactgcttactggaagatgggtgacttaaggcaaaagggaaggctgcctcctgggctccccaatcccctgctgcagagctggtctgtgatactgagaaaacacctgcattttgccctttcagccagctccctcagaggttacagcagaaggggatggtgggagggtcctatttcacttcacccctcaggccctttccaccctcaaaccttctgcacaggagactcaacaggcacagccttctttccccgttgctttagacggccccgcgcgtagactctgagcaggagggcagcaaagaccacagccacccccagccctcccaccacagtgacagtgtggccatagagaaggcaggaaagaaggatggcaaaggcctggcggagggtcatgatgatggtgaagacggcagccccaaactgcccaatggtgtaaaagatgaagagctggccacatgcggagcagatggagagtagcagggcatgggcagcaaactcactgtgtcgccccatgaagcgggttccctccagtagggccccctgttctagcagtgagcccactgtgaagaggcaggagaagaaattgaccccaaacatcatctgcaccgatgacatcttataggcaaacagggcatcctgccagtttgaggtgaagctgtcaaaagcaatataacctgccagtaagatgaggcctgagagtgtggtggctggggagctgcggggctctggtccgctggatagcagaaacatgctgaccccaatggagatgagggtggctgtcaggtactcccagtgttcgtagctgcgccgagacacaagctttcccatcagcatgacagggatcaccttagaggccttggccagcacctgggtggggaagctgacgaacttaagagcttcgtattggcaccagctgctaagcacattggacaggctggcaaaggagtaccggtacatgggtgccccatgccggggctgcttgcagagaacacaggagaggccagccacaatcagtgccagcactcggttcattagcaccaggaactgcgagtccgtaaagcgctcacccggtgatgtggctgtggccccatagctgcgggtcatcactctttcctgcagcacaccccaagtcagataagacacctgttggggaaggtagagacaaaggagacaataagcaagataatgaaaaggtagacaaaaattgacctctctctcttcaggattatgcctaagtgattcaaaggaaaatatacactttttggttcctctgtagaagtttcttctcccctcctaagtctggattcaccttgtagggaatcaactgtgtgtgaaaaacctattcagggaggcaagaactctcagaattgggtatctgt

SEQ ID NO: 12914 - DNA, 10367 bp, Human
gttagctgtcttctctggctgtgaaaaaacttcagagtattaccctgtggagccactggatgggacatggagatggggtgaccacaaaacttacctctcaggagctgcaaagtgttatggtattttatacattttatattaataatatcattacatagtattaaatgagggaggaaccaacagtgtgaggtcacacgtgagtgaggatgagaagggtggaggtgtctccccttgagctggtcttcagggaggtttgggcatccacttggtgaatgaggaggaagccacattgtccaagggaccacactagggtgtgacatgccaatgagctggtgtgtgcagagaactagagggaagggagcatgttggagaggggtcaggggtggactgggggagaggatctagtcctagggaagtcataagggccaagctaaggagctagactttccccctcaggcagtagaagctggtgaagggttttaaacagggatgtgaccctcttagatttgtgtttaaatgttcactgtggccagtgtatggagaatgggttgaaaggggtgagactggagacagggagggttagcttattttaaccctcctgtaagctccctaagggtagggaccgtgtctgaggcatctatgtaccctctagaatggcgaggatgcactagagactcaaacatttcttcttattgtcaccccctgtcactgccaccaccattagctgcctcttgcttcactccatggctgtcagcacccccattaacacacgccatgccatcgatttagctcctttcccagcgctttctcagggatcccagcctggagcagactgggacatcaccagctcagcagcttaggtcaaaagtgagattcctggtctggagtcaggggacctggtcttttcttcagctctgctgctgagtcattgtgtgaccccagcaggtcccctccctgtctttagttttctgacctgttcaaagtaggagctggattaaaccagtgggtctgccagctaagtgtttggagaatcagatgagaataaaccagacattgctggtttctgctgtacttttgctgcagggaccatgattgagaattgagtgggagggtcagattgaacatttgagtcttaggtattgcatgtacctttgacaagaccttggtaactccccctcccccattccctacccctccaaaaggtaatcttaggcattgcaggtaccttggcaacatgtcccccgccattccctatccctccaaaaggtaatttaggaagctgctggaaataggggaatgggacaggcagttggaaccatatgtatggggagagtccctgagtgaagtgggaatgggatgagcctgggatcctcagagacatcaagttgcccggtgtgatcacaggtgtgtcttaggccagggcatcagctcccagcaggggagagggatgcgaggaggcctcatggctcagcagaaagaaacctggttaggatccagctttcagtcctgaatcctgggctgtcggccaggccatggctgtagctgcaaataggcaaggctgacctaaggtctcacaggacaaagggcaccctgggagagctggccccaggccccaggggcctcctcttcttagggatcctgggagctctgctgaccaaggggctaggggctcacctcctatgccatcacccagctacctcatcatggtagccttggtccctgaacactaatgggtaagccccagagccacgagccagtgacctctgaatggatggcttccccttcccccaggcaccaggcaagacaggtagaggtccctggagacctgatggctggggagggcccagtcctgggccagcccctgagggctggattctggctgcaggctctccagtccatccactcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgaggtacttaagcccagaagttgagagacatgtgagagggatgggcctgccattgccttgggtggttactgtgtaggcattagatgtattactttacctcttaaagtctcagtttaccaatctgtagatgggggctatgaatataaggcacttttagttcatggcttgtagtaacaggatcctacacaagaactgttatcatcatcattaattgggaggtgattaaggcagggaagggctaaagtggcttcagggagttgagacaaagagctgagaaggcaatttctgcagcaagaggtggagaaacaatagaggccttcttttctcccttcctcttttccagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggaggtaccagaatggcagagttcgcctcagaaggctccagggtctggagaggaggagctggtgcctgctggagaggggctgatgttcataggaggtccctttctgcctgtccttgcagtgggatctggtgtgtgagcagaaaggtctgaacagagctgcgtccactttcttcttcgccggtgtgctggtgggggctgtggcctttggatatctgtccgacaggtggggtgaggcactgggccaataagaaactggctgggggaactttctcccactagctggggtatgagcctagtctacctatgccttagaacctccttccacagggaactgaccctgcatgacccctttgcaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactgggtgaggcaggcaagaaacaggcaggacctagagggctggaagaaggcagttgtcagagtgaggctgagcccatctggtcctcactaaccatcttcctgtctcctgtcctggcccagagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgaggactgcaggcagctggggagcgggagatacaggaagtgaaagatgagattaatcagagcctgagatttgaggatagagagattgagagatgaagggaaagagaaacgaagtgaccaagagacagaaagagacacagagaaaaagagacagagagacagagatcaacagaaagaagatggcaaggaaaagtgagaaacagagaacaagatacagagagtcagagataaagacagagccaaacataaattgaggctggccccttggagagttggggataggggcagggccagcatgggggtggggagctcaggcaggagagtgggaggacaggcagggtgggcactacattgcctcctaaagatgacttggccttggatgacccttctggatatgtctacatgtctgtccctccttcatctcattccctcctgccacccatgggagaagtgagtggctggtgctgggagctggtcttgagggtaaggacaattcagttgaataagggactcccaggctatggaggacctgggcctgggcaaggaagtgtgggaagaggtgttttatttttatttttattatttttgagataaggtcttgctctgtcgctggagtacagtggcacaatcacagctcactgaagcctcaacctcccaggctcaagtggttctcctgcattagcctcctgagtagctgggactacaggcgtgtgccaccacacccagctaatatttattttttgattttttgtagagacagggtcttgccatgatgcccaggctgatcttgaactcctgggctcaaacccaccctcccgccttgacctccaaaagtgtttggattacaggcatgggccattgcacccagcccagaggtggcttttaaactgggcattaaaagatgaataagagctcatcaagtgtggagggcttggggaggagatgatgttccaggctaaggggactacatgagcaagagcctggaagttgagagcctgtagtatgtccaggaacatgtggcttagggtcatgactttctggctgatggaccttctgcctattcctaggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatctgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagacaaactcgtctcagctgccatgagcatctccatccccaccactgcagatgggaggaatagagaggggtggggggagagtactgtgtcccattgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggtgaggaggctggcttgggtctggcatgggtgtggtgggagggaggagcaaactccaggctggtgctgagtgtgagaagggctctgagggacaagtagagtgtcactgtggagggcaggaggataaacctccatgggcgatctgcctggggaagtcagaaaatgaagcaggtagcagagacacatgggttcaagctcagactcccacttccttacttggaaagggacagatgacttagccactcagagccccagtgtcccttctgtaaaacggactgttgtcagttccatgtcagggttgctgtgaaaattagggtaaaggcgctttgactactggcgcatgctgcacagagggcattatggatgtcagggaaggtcctggcggggggaccgggggttgcagagacagaaggagattgcccttgtaaaatgccaagtcttcctgagaagagaggccaaagagggatgggaaggagggtccgccaagtggcactgagactcctttcaggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccggtgagcccagtcccataggttctgcccaccccagaagccgggccaggaaccctgcccactccccggagaccccacctcctggccaagaacccactcctcccccagatccctgctcttacccagtgagctcagactctccaccacttaagtttggcccactctggagactccgcgccctatccagaacacccctggctctcctccaaggccctctcactacctgaacccgcttccctccagatatgaagtcctggagcactgtcctggcagtgatggggaaagctttttctgaagctgccttcaccactgcctacctgttcacttcagagttgtaccctacggtgctcaggtgaggaagcctgcaactgatctgggggtatggggcttgttagtcacgtgtcttaaccaacacttctacatacacgcaccacaacctggtctctcactcattttttttttaattttaatttttggtagagacggggtcttgctatattacccagactggtctcaaactcctggtctcaagcgatcctcccgcctcagcctccaaaagtgctcgtattacaggcactattacaggcatgagccaccgcacccagcctctcactcgttctccacactacacccagaatacagagctaatcagggccctctgtgtttgccctagtcttggagaaggcagagcatcttatcttctgtactatgtgaccctgagccacgtcagacatcctctctgggcctccttaagaaaacaaccccaaggccgggcactgtggctcacgcctgtaatcccagcattttggaaggccaaggcgggcggatcactgaaggtcaggaattcgagaccagcctgaccaacatggtgaaaccctgtctctgctaaacatacaaaattagctgggtgtggtggcgaatgcctgtaatcctagctatttgggaggctgaggcaggagaatcgctcgaacctgggagatggaggttgcagtgagctgagatcatgccattgcactccagcctgggcgagaaactctgtctcaaataaatacataaataaaagaaaaaaattaaataataataataataagaagaagaaaacagccccaagaagccccatcctgcccacccccatcccattcacccctggaaggcagagatgcccttgaggactgtcccaagagcaaccccttgaaaggcccggggttgggggggtctttcagctagctactgagaggtgggaagaggaaaattctaggcatctggtcatgtttagaaagaggtttgcctcctcgaacaacatggcagggcctgtacaaactactgaccttcttccttccacatcaccctttccttatctcccagtctggtgacttgtcttctcttttagtgatacctaattggtactctgtcagaatgggggccctgtcctctggtgggtgctggcttgaggtctcctggcctgaaggtgggtgggaagaccaactgaaagaagtcctagttttcttagctatatggggagaagggagtatcagggcctgccagccctggagggaagccctgtggggcatgactccaggtaggtgtgaacaccatctgcctccctcatcctctttctctgaacagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagaggtgtgtgcacaggactgtgtctgtgtacgtgtgataacatgcatatggatgcaggtgctcagatacctgacaccttaggattcagacaggaaactatatctgcacatgtgtacttggtgcatgtatgtgtgcgtgcacaggtgagtgtttcagggtgcatgattgggggcatgtaaactgcaagcataaatgtgtacatgagtgtatgaacacaaatacataaggttgttcaggaagatgtgtatgtgtgcacactcaagtatgcctacacatcaggggtgtgtacaagcatgtgtgtgagtcacttgtacaggcgtttgtataccaggaactggggtgagccctgggacagccctgatggggcaggctggggtggtaggctcggggattaaaccccaccattgctcacaactccttcctccctagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagtaccttgaagctccagaatgtgctggggaaaggggttgtgatggccaggaggaggatacccttcaaaacgggctgttccctaaccagatagaaatgggaaagggaaaaaattggcagagaaagtctagactctctggcctaccatggagcctaggcccaggcccccaagatcccaccttccccaacccccatgggactggagatttttgtagcttccattggaccatgaggggcatgatgggaggcctgagttagggtgaccttttttgtgagcgtctcatttgaattttatcttcactgggtcatagatgtagcagcccacatcgccagtgttcacacctgagagagagagccctatcaccaaaggccctgggtctgtggtgcagggttcaggcctagagggaacttggtgggggggccagggtatgcttaaccacaggggaagttgtccacacatacccacagaccatgtacatgccatacttcaggcatgtacatgccatcccagtgtctgggatggggctgcccacctttggggccaaacaggtagccgtagcaggggacgtggcagtaggggactccatcatgctgagacacagagagaaagagagctgtctcagcctggttctcttcccatctccagcctcctcccaacataaccactcattcctgccctgctcacctcagcatgactcccagcagtcagggtcttgtggcaacgctggcacctcagacacggtcggtgccaatttctgcctaatgacatcaccttctcagctggtggtggaaagaagtggtaatgcttccattctaggggtagagtagggagacctacctgccttggatcacctccctcccccttgctgcccaccctgtatccccctccccaagttttccactgttacttaccaaaatagacgggctccccacagccagggcacagcgaggtctccccagtgaatgtcttcatatggggagggcctttaaaggggaagaggccctggctatgtctgaggtggagatgcccaccagcacctgcctgcatatggtgctgtcctctttcaaaagccatgctcattccagagtgccccacccaggcgcccaagagtctgccttctacaggcccagagctgagccccctctgactccacctcctgccccatccctatgtgtattagggactatctgc

SEQ ID NO: 12915 - DNA, 40546 bp, Human; identical to SEQ ID NO: 12847

SEQ ID NO: 12916 - DNA, 20204 bp, Human
ctggtgggcacctgtaatctcagctacttgggagggtgaggcaggagaattgcttgaatccaggagacggaggttgtagtgagccaacatggtgccactgcactctagcctgggtgacagagtgagactctgtctcaaaaaaaaaggtagtggaagaggaagataaaaaatgagtaggaaaaaaagttgaagtcaggattggacataatctgactctaaattttatggttgcctatgaatctataattcatatatcccaaattttctttctttcttttttttttttttttttgagacagggtctcactctgtcacccaatgctggaatgcagtggtgcgatctcttctcactgctgcctcaacctcctgggcagcacaagcgatcctcctacctcagcctcctgagtagttggggccataggtctgtgtcaccatgcctggctaatttcttattttatgtagtgatgggatctcgctatattgcccaggctggtctcaaactcctgggctccgccttagcctcccaaagtgctgagattacaggcatgagccactgccaccagccccaaattttcttagtcccaatttcaattattctgtgttcattaggataacaaatgtttaaaatgtggtctctttatgtgccagtgagggaatcaagtgagaagtggtcatccaaggaccgcttatcctttgtcacaatgttgaagtcctacagtgaaatcatgactggaaattcttctgaggctccatgaaatcttttcttgcacagtgtctacatgaatgtgcctgcagcactctcctgattttctcacctgctgcccctgagttctcatttactaacccctcaacaacatctgttcttctgaagcagattccttgaacctaaaatgatagggagaatttgatgtagtctaagcagatcttcctatgataaggctgacatttaaattactttttttaaataagaaaaataatgactctctctcctggggagggattataaagcaagttctctcacaggccttcagtttcccaagccttattgatactgcaagctaatttaggtggatatgacagcttttaacattttaatagtcatgcttttacttaatatatattagaaatatatatctagaaaagtgataatgatatgaagtttctcaggagttggaagccagccttagcaacatagcaagaccctgtcttaaaaaaaaaaaaatctacaatgtgatgattttaagtctgttatccaccaatacatacatgataagcttcatatgcaccatgcattctcatggaaatacgtgattcctgtgcttctctgtaactcaacctcttgctctcccactccagaagatactttggaaggcaaccaaatgaaaaatgttgtaagaatcattattgcggccgggcgcagtgtctcatgcctgtaatcccagcactttgggtgtctgaggcaggtggatcacttgaggttaggagttcaagaccagcctggccaacatagtgaaaccccatctctactaaaaatacaagaattagctgggcgtggtggcacacgcctgtaatcccagctactcaggaagctgaggcaagagaatcgcttgaacccaggaggcggaggttgcaatgagccaagatcgcgccaatgcactccagcctgggtgacggagttgagactgtctcaaaaaaaaaaaaaaaaaaaggaagcagcagcagcagcagcattattccactctaattcatttttgcaatatgtaaactatttacaaataggtactttcactcttactagcatttttcagcatacctcaggactgatcgccacctgatggccacttggcagagcataagcatgcttgagaaagagtgatcttacaaactagtttgggtctgagatatcatgtgtagagacccctattggggaatttgtaccgtagggagtgctttccttattgcctctgacctaataatgtcctcttttctctttaacacatatagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaaggtaaagaggggctggtctatctttacttgaaaacaacacaacacaaaggctcccgacaggcacctgttggccttggcaagaggagatgtgtcatggtgagagccctcagagccggtgtcatgtcgctgatgtgccaaagctcaaggcacatcagggctgcctccggcttgcaggaagaaatgcaaataaggctactttgccccggtgcccacctagcctctccatcttcatttgccactccttctctctcccctgcctcctcccctctaggcctccttcctggaagtaccaggtgctttcttacctcagcattttacacacaccgtttccctgcctaaatagcatttcctccaagactctttctctcgacctgtcatacactagatcccctgataaactctcacatcacctggcactttactgtcagagcacaacttttaatatctaatttcttgcttcatgtctctccccccactacactgcaagctacctgcaggcaggaatcctgtccattgtgtttgtcgttgttagatccgcagtgcctggcagagcacccaggcccttggtaatgaccggttgatttattaggccagtagtccaagaactaaccataagcaagaacgggtcttgaaggagctctgatttaaacagtttattttgtttcaagctgccttgggaggtttggaatttctcagatgtctaatatacattcatatgtatgcaatttacatatatgtgtttgctttaccaaagctgaacaaaatctcaccacttgattccctccaattttaagtttttcaaatatatttaaacatggctgttccacgtttcacaagtacttctgtgtaatgtgtttagtgttgtttctgttatcagttgctacttaacgaaccaccccaaaattagcgacttaaagcaacagcctttttatttactgttgattccataggtcaggaatttgggcagggcagagcagggatggctactgtccgtgccacaggtctggggctcagctctggtctttctgagacaatttacctggagccatggactctccgtggactctccacgtggcgaccattgggatctcaaggtcccaaaagggagcatctaagagcagaagtcccaaatacaaacacttatcaaacctctgcctgcatcacaatagctagtatctcattggtgagagcagatcacgaggcaggggatgccatgggatgtaagtgccaggtgtgggtcatggcaggccacaagggcagccatccaccacacccatactcacgtttggaaagacacctggagcctaaaccaaagggcaagacactgtaagaatccactccctcatgccctatcaataagccctaaaatattctttcttttaaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaaggtaagcaggtgcgggtccagttctggcttcttaagtccagagtggggctgaaaactctctgcctctggatggggatcagctctcccttcccctcttaacttctctggcagggtgaaaagagcttcatgttcccaactctagccatccttcctgtgattcttcaacagcagatgggcagtgtggctgaactgacaacccacagctggacatgcatcagtgaattagtgaaatttagattctagaaaatacaatctaaatagtcagattttgattctctgacaagagacaacatggctaaaataacataaaactggaacaactcacttttttttttgctaatcatatatgaacaataattgttgactcttcttaaaactctgtgggatgaggacccaaaatattacagtagctttattcacccctataatacctaaagaaattgtccttacctccagaaattagcaagagtgactgagaggacacttaatttttaagctgatttaggagtttggatttgtatctgacttatttgggggctatcaccttgcatatgtttattataaagtagaaagaagaatagaggaggtggatgaaggatttctctctagggaaattagagcatgtgtgtgtgatgcgattatgtctttgctaatatggtgtttgtgtttcctcttactctcaagtcagtttaaaggtcttggttcatcttttaaatgcagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtgagtttctcttcatttcttccattctccttattgccttcacccagaagtgccagctggtttattttgatccagcagttgttaaaagaactttaggcacaataggcccttcactctgtccttatcagctaatatcataagagcagtggagatgactgattgtttgagagatgctcagacatgttcctcattaccaagggccttcttcattcattcaggtacttattctgtgtctgcctactgtgagccaggaactgaaagatgaacaagacacacacctcaccctggagttgaataggggagacagacacgcagataagtaattgtgatagcagtgcaattagaataaaaacagatttagagaaggtgcagtgtaccccaagggtgcacagagccaaaatacaatagggagtagtgaagagcttggagaaatgtgatgcttacatcccatctaacagggacagctgctactagatctagctaattattgtcatgcagccttggggagccaatactgccagatcttgcagtttgtaaagagaagctgaatttgtacatgaagtatcatgattttaaagccattttgcgggctcaacaaaagagctcttcagacaggatacagtgggaggagggcccccagttctccaatcttggaataagacagccgggtaagggacaggatgagattgtcatgtaggcaacatggaaggagagatattcttattagagggaataatataaacagaaacccggggtaggagggacctagggtggaaggacaggaggagagacggactggaactggatttccatgcctcaggggaaaacattcccttttagactcgttagcctgaccccaccaacagcaagttgcggcatgcatttctgcgtgcaggccacttccaaaggtgccttccctaattgtcactttggatgcacaggctttcaggtaatctttcacaagctggtatttttatgcctgggtggctctctgtcagttttcctggtaatataaataagcatagaccacaactgataggcaacaggtccaggcagcattccaaacctctctctggtgtccaagatacagccccctctcctaccttagggcttctgcatcgtccctgctctccacaatttgtagctaagaaagggcccatcctgtccagtggcagagctgtccttcatgttcactgtctaactttcgaaggcaaatccagatgtgtaggaaattagctagaaacggttgctgctgggaattgttccccagtgtgcctgtgtgtgagctgtgtatccttctcagacaaaaaacaggtgaagccagctgccttgaggagcccagaagaatgtgcctggcctggcctggatgttttgttggccaggcctgacccgccttatccagaactgccccctccacgcttggcattctcagttctggctatctgctagggatccataatgcctgcctgttttgctatttaaaacaaaccctttgaaagtaagggaccagaggagagaactggaaagtcagcatgagcagtggcagcctgggctccacagggggccgggccgttcacctctgagaggcagtgcagcactctttctttgatccccaggagcactctggcatattggggaagcccacaggtgctggcggaaggtggcctgcactccagtgtctgtcatttactggccaaaacccctgagcacttttctttaacatctgtgatcatgtttcctcatctgtaaagtaggggcaattgctgtgaggattaaatgagctgatacaaagcacttcatatggtacctggcaatagtgaatgttggcccatgattcccccaaattagcatgcttagctttgcttagtaagtgtatttataaatgatttgtagaaatattttaaaggaatcttattctagcttatatccatgtaaaatgtaatttaagaaagaaatgaaattcaaagaatcatttttgtaatgtaggatttcaaaaaataaaaacaaaaaaggacccttccttcacccgtcacttaattttgatgcacagttgaacttcagtcagctctgatccagttacccatatgggaatatttaggattgtctagtcacgcctgggtaatagaatgtcaagccctgattttacaagctaatatgtcaaattcattttttcctgtttacatgtagctgtctgattcatttgtccccgaggcacgtgatacttggctccactccaattttagaccctaacaaaaattaaatatgcttgtgtttaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtttgtaaaattttcttattaattccctattaatacaaaatagagcatctggcaagacctctgggttgactaaacgcaagcctttatttatgctttgtagttatagcctcatttcagtgccagatctgatggttaagaattctctctgcatgagtatctgcagtgtgtgagaaatgcagtgcccactcattcatagaaaaggaagcatgatgcatgttcctttaatatgagggtataaaaatccagagtaccaggtggtcgtggtggctcatgcctgtaatcccagcactttgggaggccgaggcaggtgtatcacctgaggtcaggagttcgagaccagcctggccaacaaggcgaaacctcatctctactgaaaatacaaaaattagccaggcgtggtggcacacgcctgtagtcccagttacttgggaggctgaggcaggagaatcacttgaacccgggaggcagaagttgctccctccgccaaggagccaagatggtgccaatgtactccagactgggtgacagagtaagactccatctcaaaaacaaacaaacaaacaaacaaacatccagagtccccctaattttacatgttgaatgatctagaaatctggcaaaatatcaggaaaataggctgctactctgttacatcatctcccatttagaaaaatactatgtttgcttgtcactcaccacgcagtaccaaggaccctgagaacactggacataccactttgcattttttccagaattggggtggtgagctagcaccattaccttcaacccctctcacctccgaactctgccagatgtcctggtgctagaaatcttgccagcctgtttgctgaaggctggctggcccttatcacagatagacagactaaatgtggcagagagtgatagctttcaaacgtgcagtggactcaccgggagcgcttgctaaaacagattgccaggccccaacccggagtttctgtttggaccaccttaccacgtgatgctgatgctgctggtccagcggctatacttagaaagccattgcactagagaaacacactgctagagatgatgatggaatcttgtacagttcaagtttattaaccaggtggtgtctctttgggcaaggtgtggaaggctcttctatatttacagaggtgaagttatctttctccattcagaatggcttggggagagaaacatatcaggaattggcataatagctatgataccacatggagagagagagagagagagtgtgagtgtgtgtgtgtgtgggtgtgtgtgggtgttgaaaaggtttgctgcatgggcctactgcataactgcataattcccggaattttctgcatgattcacagcaaagctttcctcctgctacaaagaagatggagaaggatgagggaaggtagcacagggccagagggctgagtgcaaggatgattaggacccttcctcggcacacatccctaaaagggatgcccctgccctctttcatacctgtatccccagcctccatcccctgacctgaagagaagtacacaaagattactggtaaactcacagggctatgtctaactggctgagtcgttcatggactaggttgactccctgtgataggggatgttatgaaatatcgttctttctcaccagcatcttaataaagattataaacttattattgggactttcaccttcttcattatgtcatcaaacgttgtcttgggttctctcttgcttagtattctggtaattctttctccactagattttcctcatgaggcatgtcatgtattagtctaacatttctattatatttctacctctattgatcctttagtttgttaatctattactattattatcattatcatcattttagagacagggtctcactctgtcacccaggctggagtacagtggcacagtcattgcccactgtaccttgaactcctgggctcaagtgatccttctgcctcagtgtcccaagtaagtaggactacaggtgcacagcaccacatccagctaattttttaaacaattttatatagagacagaatcttgctatgttgtccaggtgagtcccaaactcctgggctcaagcgatccttctgcctcagcctcccaaagtgctgggatcccaggtgtgagccaccgtgactggctctgcctatccttttctgaaattcattcttcaccagtatcaacatgggtatgggcgtgcaagtgaacatcaaatatgctctgtgtaactgcactactattttcagaacctcaatctagctgtaaagattatttaccaagcactgaattaaggtgggctttgaagtatcatgttgatgtaatattgccagggaaagggcaatataaattgcagtatacctattattatttttaataatttggaaggcttaccagtccatttgcactaggttttgtttttttgtttttgagacggagtctcgctctgtcatctaggctggagtgcaatggtgtgatgatctcggctcactgtaacctccgcctcccaggttcatgtgattctcccactcagcctcccaatttgctggaattacagacacccaccatcatgcccggctaattttgtatttttgtagagacagggtttcaccatattgcccaggctggtcttgaactcctgacctcaggtgatccgccggcctcggcctcccagagtgctgggattacaggcatgagccaccatgcccagcccatttgcattaggttttataaagaatgtgtatctgcctgtctctataatcagatgcaaacaactcactcaaaaaatacatatattggcacatcaaccctgcccccttgtggtttaagacagatgcataacatggtttaataatgaaaccatatttcaaaataccaatacagtgtggttattactacttaatagaaaggttctctccctactagtgcccaataagaaactaatgaatattttgtttgtgaagaatggcagcaaacacccctttattggtattgctctggtttaaagacattattgatattcgtcaaactgcattgcatttactggttccattttaccaattgctaggatgcttctgagtttctgaggttttgacccatctggaagtctctgagccaccttgtctgggaaggaaaggccttctgctttagtggaagggccttgccaagagggtagaggcttaggtagagcccaagctgttttgtcatctggcgatgtttgcaatcttgagcaagcacttgtctgaatctcagtgtagtcaacagaaagttgagagtaatagcatcagccttgcctcccaccagcctgttctaaggcttcagtggtgttattccttcaattagaactcactgcagacctcaactgaaactcgggccccttggtgctgtgttgtcctgcttagaggatgatttactaggttcaagttgagatgagggtgtcggcagacattaaaaccaaagtagcaaaggagggcaagtctgaattctagaggcttaaaatgtcttgcttgtcccggtctctgaggagaagcaaagatgagccagacacggtgttacctgcctgctgcggccctgtctttcccctggactcctcaaagcagatctgaacctagagagcaagggaatggctcacagcatccagaaacctaagcaacctgggcataaaagaatctggtatgtgctgagttccagaagcctgtgagccacagatgtggatctgttatcacatccaaaataggaggcaactgtgaccatgcggtggggacatgggcacaaacaagcagtctcctaagtactgtcccagctccgactctaaattgtggccaacagatgcagaattctagtgcttgcccagccaagacttttcattcatgaagctctaatccatttccaagggaaaaagagctttacatttctcccatgtatctccccatctggccacagaatttatatctcagattttatgtcttctcatttgtattgtatctgagcatttttcaaattttcctttttttttttttaatatagtgttggctctctctgcgtctcttagggtctaccagtctttttttcaatgtttcaacttcagcatatagaaataaatcacattttctggtaaaacaattacttccctcttaagtaaaaggtttggtggtatgtagacaaaatattgtaaagacatatacaagctaaagcacgcttttatttggctggtgggaggggttttcctttgaatataaattccatacataagcatggtctgtgtttgcccagtaacagtgatattcgcataccccaggcttccatagctggaagaaccatctttaggtttaggtaagagtcatatgaaagtgagtctttgggcctgtaatcccagcactttgggaggccaaggtgggcggatcacttgagatcaggagttcgagaccagcctggccaacgtggtgaaacccatctctactaaaaatacaaaaattagccaggtgtggtggtgggcacctgtaatcccagctacttggggtgctgaggcaggagaatcgcttgaacccgggagatgaaagttgcagtgagccgaactggtgccactgcactccagcctgggcaacagagggagacttcaatttaaaaaaaaagaaagtgaatctttgggttattaggggatgacgaatgagggtcaaactggaatatgaagattttcagacatttcttcaaatgcaaattgttcttcctttttctatctttgagggtaggcagaccgcaggttgactggagccttgattcagctgcagcacacactgatacgtaggtgttgttcaagtccctgaggccatccaaaatcactgtcatgtgactgtcaaaaaagtcaaatctgttctattaaagtgtaactgcttctagccaagaagaaatttgctgcctttttttaaagggtaccatgactttttttttttttttttttttttttggtgtcttctgccaactactcattactagtaccctgaattctatttcatcattatctccaatgttaaagaatggtgtaatgttagccgggcgcgatggctcacgcctgtaatcccagcactttgggaggctgaggcgggcggatcatttgaggtcaggagttcaagaccagcctgaccaacatggagaaaccctgtctctactaaaaatacaaaataagatgggcgtgatggtgcgtgcctgtaatcccagctacttaggaggctgaggcaggagattgcttgaacccgggaggcagaggttgcagtgagctgagatcgcgccattgcagcctgggcaacaacagcaaaattccatctcaaaaaaaaaaacaaaaaattgtgtaatgtcagtttcaatgatagctctgcttcattttttatgcacttgattttcttcgatttggttggttttggggaagtcaacaaaaaatacaaaagatgccaacagacacaacaccatccagcacaagttaccttgctgaaacgcatggattttctaagtggcatgaagactgtaaactagctcagagccctggaaaaggaaataatatgcatagcttcttccctcacatattcctgctttgtggaacaaagttgaattaagactccagaaattcatctaatatattctccccccgccacaccacatagtttttcttaatccaaataagaggaaaggaaagaaagccaggcctggtggctcacacctataatccctgcactccagcactttgggaggccaaggtagatcatgtgagctcaggagttcaagactagcctgtgcaacatggcgaaaccccacctctacaaaaaaatacaaaaattagccaggtgtggtggtgtgtgcctgtagtcccacctacttgggaggctgaggtgggaggactgcttgagcatgggaagtcaaggctgcagtaagccctgatcacaccactgcactccagcctgggtgacagagcaagaccctgtctaaaaaaaaaaaaagaagaagaaaggaaagcaagaattaatgtttgttgatcctcctgttctgtgttacttacatttaatcttcacaaccatcctgggtggtggtatattatccccatttcataggtgataaaattgaggcttgggaatgttcagtgacttgagaactagaattcaaatcaaaacctgactaggttctttctgtcacaccaagctatgatgatgggtacacgctatatttatcacatatcaaaggacctcctaaggggggcacagtgtaaatagctcttcaaaataatgccattgaagctgagtgtggtgcctcacacctgtaatcccagcactttgggaagcttaggcaggtggattgcttgagcccaggagttcaagacaagcctgggcaacatggtgaaaccccatctctacaaaaagttaattaattaattaaataaaacaaaataatgccactgaaacccaaggaataaatgcgtaatcaggttaccaaattattaccaatttatgattgggtactacctaaacatcaaaaggatatgtatcaagcagtaggaataaatataaatggaactgtgtttaaaaaagagagggcaaagaggaacacacgaagtgaaaatagaagtttacacagttgtatagagaaagggagaaggaaatgtggcattttcctcctcaggagacaaaaaatgaagagtcaggaactaaataggacagaaagtataataaaaggcaacctaggtcagatagaagtttgttgaagttcaagataaacattgttttgctaaatgccaaaatttttatttttcactttaaccgtttctgggggaaactgttacgtgtgcctcgtatttttctgccctaataaataattattgagcataactgtttggggagagttcaagatcatcttactattgtagctcttcattctcatttatgttattggggacttaggcagcttcaccttaaggtaatatgatttgacgctggagtaaacaaactagatgtgacacgtaggatctaaaataagaaaggtcttaaaatataaatggctttttaaaaattgtactcctgaaattttgagaggggctgtcgagactatcatgggttgacggctaggctgggccacttcgttggctgtgtgagtttgaggaggttattttaataagccagagccttagtttttttcatctgtaaaatcatgataataattgatgacacagagctgatatgagaatttaatgagaaaatgctcatttggtagttagtacagagcctggaatatactaagtgctcaataaatattggctgctgttactggccaatcgattccatgcttccaagaagccttgtgattataattttgcttcccatgtagttgcactacaagacaaaactattgagtccctcgcacacgtaaatattttgttgtaactaatacattgacaccgtttttatttaggattttatggaatccaccaatggttgtagtacagtttggtgactgagtaaataacttggaagtgacaggaatggatcttaggttgtcatctgtgttctctcactgtgataatacgtactaatataaatgggctattcaacaacgaacaaatttaagctataaatcagattagtaattttgactgtattttaagttacatcaaaaataagttttttccctctctaacacttaatattaactcacaacattgagttagctaataaatattgcatatattgttcttaaatatttataataatttttatatgccataaaatatggtattaatatttaattttatttttgtcttgcaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgtaagtatgcaatgctagttattgttattaaaatattatagaactcataatacttattcacccagaaggaatccaaaataagtctaggaagttcaaaagtagatccatcgagacagaaagaaaggatagtgtcagacttgcaattggcaggaggtggaagaggtggaaattatatgaaaaaaaaaaaaaccacaaaaattcatattttttccctgatggcaatttttaaaaaatggaagccaaatcctatctcttgtgatatcttttatgattaaaatgtaacccgattaataataaagaataagcaatgtagcaaaggtagtttatagtttcccaggatacgacacaacacccattccacggcatacactttctactataaaaaatgaattggataaagttccttagaattcattttataagtgaaatctgatccacaaattttaacactatattcagcaaatgataaacatattttgcagcccttttttcatcgatgcaagtaaaatttcagtctttaattccataaaatatatatttctgagtcattttatccgaagacaggaaggcatggactaatttgagcctgagtggatttatgtgaaagaactaaatgaataagtattgatatagttggccagattttgcctctttctctttgatgtgaatttctctgagaaattcaggattcttctattttgcttagtggggcttatgccaaccatagcagtcattctatatagagctaatcctgggagaaggtagtcatctcttctgtagtgaaaactgagttggtattttattatttcatcttgaggacatcatggaaaaaacatggtttttagtttataaaactatagaattcagagcctccatgctccatgggttctccccaaggtgcctagatgtgaggcttatcaattgctaatccttttaggaatttctactcctgccgagaaaatggatagagcttgaaaaatctcaactcactgtgaatctttgtctaaaaaggccctttattttcctcctatttactgtgatatttctattctatttaaaaatatgattttccctgtagtgaatctaaacttatatgcaacctcataaataagccacacctttagaataaagttatgaattgttcatttcccattagttagactaacacagtacacattgaccctagatattagttctaggataatatttgaaggtaagactctggacattgaaatgaatgtgtaaaatacataccaatgagtggttatgtaaatgtcattccccattttttcccttctccaccatatataataaaagcatttctcagtagacattgcctgtagttagtttagcatttgtcttgtcctgatcatttcctccactaaaaaaaaaaagaaagcctaaccaaagattcaggctgatatgaacaaaaccaggtaaaatcaaagcttttaaaggagggtggatgtggtggctcatgactgtaatctcagcactttgggaggctgagaggcaggtggatcacttgaggtcaggagttcaagaccagcctggccaatgtggtgaaaccctgtctctactaaaaatacaaaaaattacctgggcatggtggtatgcacctgtaatcccagctacttgggaggctgaggtaggagaatcgcttgaacccgggaggcggaggttgcaatgagccaagattgagccactgtactccaggctgggtgacagagcaagactctatctcaaaaaaaaaaaaagaaaaaagaaaagaaagaaagaaaagcttttaaaagaagcaataggcttgtaggtcagctgaaaagaaattagtaagttgagaaaataattctacttgaaaataatcttgatatccaaggaggatgttaaatacacacttgggacaaagggaaagagttatctctttacccttctgccccacgaaaaggatggtggcagaaacatctgctgcttccttctcttgacttacattgccagatgaggtacccatctgtccttatttcattttgtaattcttggcaacagcattcacaacgctggtctctgtcaacaggcattggataactcagcctgcaggaccaaatctgttgctggcccagaggtctggtagattgttacatgcattgcacaaaggctgcattttagtgatggatatcagtgttttcagtgtgggcaccacgaaccatcttaagtcactcatataattgtctcttgtttcttctcaggttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccct

SEQ ID NO: 12917 - DNA, 66428 bp, Human
taaatgtctagatagccatgtttatcagtgccccaccattcactatggtaaccctagatgctgaaaataaccatattaaggaaattagcctgtgtacattcactctcgtcatcatcttggttttggtgggttttggctggcttctttactgcagtctgttttatcagcaagatctttatgacctgtatcttgtgctgacctcctatctcatcctgcgacttagaatgccttaactgtctgggaatgcagcccagtaggtctcagccttattttacccagctcctattcaagacaaagttgttctggttcacatacctctgacagggaggcctcaggaaacttacaatcatggtggaaggcaaacgggaagcaggcacatcttacatggccagataattacactacaaattttagggtataaataagattactttaggagagaatatggagtaagagggggctttgctagagtcctgaaagctctaaagagaggcgatatttagagttcacacagcttagtaactcagatctctctgactctaaaactcattctttttctaggatactatgctgcctcttaaagaatagatattgaatacaatataattaagttgatattaataccaaatgcgaacctttgcaaaggggagataaagcaaggggaatgattaagatcaccaggaagagtgtgaagagtaagaagagaagatggcatagggcagaaccctatggaatgtgaacatttctaaagaaaatgaagagctgccacagaggtgggaggagaaccagcagggtgtagttcttggaaagagctaacagaataaaggggttcaaaaaggagggaataagggccgtgtgtggtggctcatgcctgtaatcccaatactttggaagactgaggcgggtcgattatgaggtcaggagttcgagaccagcctggccaatatggtgaaaccccgtctctactaaaaatataaaaaattagctgcctgtggtggcgcacgcctgtagtcccaactgcttgggagactgaggcaggagaatcgcttgaacccgggagacggagctggcagtgagccgagatcgcggcactgcactccagcctgggcaacagagtgagattccatctcaaaaaaaaaaaaaaaaaaaaaaggaataatgaaactaaagtcctgcagagttgaaatacggtaatggcttaaaagtatctatttgttttagcaacactgttgagaattctgtctgtaaaggagaggtgagagaaagaccactagcttatctgtgtttggtctgtgtttgatgagggggcttggggtatggggttaagaaaggtgactttggaatgttttagatgagagaaattttgacagcctttaagtcctgatagtaaagagcgagttagcagagagccgttgaggagtcatgcaacggaagggttcatcagaggagcttgactctgagtcggcaacagggaatagagatggaagagggctggcttagatcaaaggagagtagtcgtttattattattattattgcaaaaagaataggagaaaggattggtgaggggtacaagaaaattagaaaatttcatggcgaaagtagaggcagttcctgtcagatgaattctattttgtctgtgaggaaacgggcgacgctgcctactgagactaagcaggagagacggggcaagcttggctcttcatttatgccgcctactcattgctggtagattctttatctagcctgcatcctctcattttcctggatccctatacggcatttgacgctgtttaccacaagagctgtcgaacgaacgtgaaacactcagtgatactccaaccggaactactactcccagaatgcagtacggctcctgggaagtgcggggggctgggaacgcagcaggcctagccgtgtcgcctgctgccattggaggagcgctcccactcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcagttttcttcttgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatggaaatgttaaatgtaaaaatgactttgctctagagctgtgtgatatgtgaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccaggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacacgcacacacatactcttctggcaataaagtccctttaaattggttacttataaacctttattattcaagcagttggtttgtttcatactccccactaggaaatgttcatctatgtaaaactgtataaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattaggggagccattttaacaatattaaacttctgatccatgaacatgggctttctttctattcatttaggttttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttgtttgttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctccggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagccccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcctgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggagatatgcctgtaattctttctgttgttctttattgttttctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgtgcatacatctgttgggtacatacccagagtggaattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattgtaagtttttgtccttttagtgtatggctttatttttcaatctctaagaaattaggtactagaattatttctcaatgattaacactctgaaatgagctacatatgtcttttaatagtgaaacacatgaccaggcagtggctttcctatgaagtcactatgaaatatctctacttaaacccctccttcctattgagaattattatatattctcaataggaagagatctataaaactgacctcacagaaatgtagttattttaaataaagacatttctggtttatatgtaatgggtttattgtttttatttttaaattaattatgtatttttaaagttttaatttctaatatggcaaatgctgataattataatcccccttaaacaagaactctttggagtcctcagtaatttttgagtgtgtaaagaggtcctaaaccacaactttaaaaactattgctaacaggtggggggtgctttaccctgttcatggtcagataaagttgcctttcctccccatcctccagtcatgtccagaagcccaaagttacctccaagcagataactctgaccctgcttctcctctaccacagcttgagggtcctctgccttagacagctggatttatctaaaagagaagagcagtcatagatctgtagattttatactggaagtaattgtcatggccttgaatggttccttgctcaggtttctctttctaatatcacattttaggctcctgagcttagcttcttacttattatttggtctgggagtttaggttgatttgtgcagctgaattgttaaattcagaatatatttactgattacttattacatgcagagcacagctctaaatgcaatatcaatctttgcgaaaaggtgttgtcacctaacgagatgtacttcagcttgaaaaatccttatattacagctgtgacaaatagtcaactttacatcaagttggtaaactttacatttgtggcatgtgtatgtgtgagtatgtgtgtgtatgtgtgaatatgatgtcagaagttcaacctattcattaataaacagaatttgctgtaatctgccccccaaccctggcaatatttatagttccctacaaggcaaaatgctttgctcacttttggagcaaagggcatgcaattcatcaatgcatccttttccaagcttgcaaataatgaaatcagtcacttaaagatctcaaaaagttgtaatttaaagcaaaataaagccaggcataggggcttatgcctgtaatcccagcactttgggaagctgaggcaggaggattgcttgaggccaagagtttgaagccagcctggtcaacatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatatagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctgtcttggaaaatacttgtttagtgtgttccattactacataactgctactctaatggaatcagaagtatttcttaataaggctctactttcctatatatattatttagaataatatgattgattcaagaaaataaaattgctctcctcctccctccaggtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgatttgcttgttttagaagttctttctggaacctaatttcttctgatgacatttgccattgtttacagaacaaaagtattttacttatgcggaaaatatattaagaagtgttacctggagacttccagtaaagatctgtagcatagtctcaggtgtgtagaatttcttcaaaagacacaaatgaacttaaaaaatatatagcccatgctgaaaccaatgaaagattctgagatgatcacacagccttcacaactatcgtcctgagtgcatgatttagacagaactgaaaaagaaccccagggattttcatccagtttagcacaattctgaaaaatctttctatctaaagttaaatgactggttctgaaagagactcaagcggaaggcataatggtgggagggaataattcattatagcaaacagggtacctaaacagaaataaaagaaaaacaggcacaaatcaaatatacaaatagataggtcacaacaaaataatcagtcacttgggacctctgaacgtaaggtggctaaagtcaggtatagaatatatttttgtacaggctgcaataacttaaaaacagcctatttaagttctccctaggttttatccagatttcaactgaaatgtgcattctctaacagacacttagagaaaaataaaagatggttatttatttggttatgaataaagaaagaagtgacaccagctatttctctttacttcaaacccttggcaaaaaaaaaaacagtgttacaatccaaaagtttccttaatagtgaatgtaggtgcctttagataatggtttcttcttgcttgactcttggtatctatcttttctggcctcaagatagacaaagatactgggttgcttcccagggtatcttgatggaaatgaatgtaacaacaacagcagcaccgtagaccctaccaaagtgttctacattagaagcaagtctatgtcttgcaatgccatcttctcaagtataataaacagggtggaagtagtggttgtggttgccatgtatatcagcgtgaatccagtgaagacagcagaggcaagacaagtgttagggaaacaaagagtttaatataggattcaaggttacaaaaatgtgtgacaaactgggaagtgaaggtctggaaggcaggtaccagaagatcagaagaacagtcctagtgctttcacttgaggcagtgacataggcagacaggtcggagcttgctggaaaacctaagaagccctgtatgtctgcttgctgatatggttttgctgtgtccccacccaaatctcgccttgaattttaatccctataatccccacatgtcaagggagggacctggtgggaggtgattggaccatgggggcagtttcctccatgttgttctcatgatagtgagggagttctcatgagatctgatggttttataagtgttcgacagttcctccttcacacactcactctctcctgataccttgtgaagaaggtggctgcttccccttccaccatgattgtaagtttcctgaggcctccccagccttgcgaaactgtgagtcaattaaacctctttcctttattaactgcccagtctcgggtagtatctgtacagtagtatgagagaagactaatacacttgccaaagttggtgtgtgaagagagacatgtggaaaggtttatggaagccacagcttcagtagatctgatgccaagtaccaagtagtaggcttgcagccccagttggttagcatgactaacagtccacagaatgagttggatgtggaatggaaaaggttgaggaaaagctgcgacacaccaggcacctaagcatctttgtatcctttgaagggtactggcctctacttttgttctgctttccaagtctcatataagtgcaactcactgagaaaggctaaccctaaaaccatctagggtaaggggattctatgaaattctcagcttctggcaaaagcaatggtgccagtctagcatagcccag

SEQ ID NO: 12918 - DNA, 10943 bp, Human
gcggcggaaggcaggggaacctgcagaggaccaggagagcaagctgtttcagggagggatcctggccttccctgcacacctgggcgtctacagcctccggcagctctgccaccctccctcgcctgtcttctgcctttacgcaggctttctagcagacattgccaaggttcttctccaggccttcaaggccctaggttaactgcaccctccatttccctgctctgtcctcagcccctccacactccagctcagtacgttggcactaactcttccctccgattgaaatatttttcccccatttgacttccctccacaggaacattattctcccatatacccgcagggctctctccgtgtctctgttccaatgttctcccctcttcgcataccgtaggaagtaaactgcaaataaaacaaaccagggtcccccctctgtcttgttcacagctgtgtccccaagacctaaaataaggcctggcacccaagaggtgctaagtttcacaacatttactctgccttgttcagggcgctttacatttgcttcttcactttccacaccaccatgtaatgtagatactaatattatttccaatctcatttcacagatgagaaacgaaagttgatagatgtcacaaatagaaaagtatatacttaggtataatgccccctttattttgcatagatgttggtggctgctatcatcctgatctgtgcccctgtttaaaactacttgaatagacatggtgccaacactgtctcttatagtcagagatgggtgagaatgggagccattacttatttaaattcctgcggtcgagcggaaggcagaaggacagttaggtatccgtgttccaccgcttccctgtctgggcacgtccttcagggcacagttggacccccagacccctgggcttttgtgtacgctggctgggcccagagagagctttccactagatgtccccagaagtcagaaccttaaggtcctcctttgggcatttccgtttctgcgagagcttcccgtgttctggcctaggcaggaacggattggcagtctagcaacacacagggcaatttttactttattattttattgtatgtatgtatttatttatttgagtcggagtctcgctctgctgcccaggctggagtgcagtggcgcgatctcggttcactgcaacctccgcctctcaggttcaagggattctcctgcctcagcctcccgagtaactgggattacaggcaccccccaccacgcctggctaattttaattttttttatttatttatttggaaagaggttgcatcatgttggccaggctagtcttgaactcctgaccttaagtgatccacccgcctcggcctctcaaagtggtaggattacaggcatgagccaccgcgcccgggaaaaagagaccaattcttagttcatccagagtaaccctctcctgccttagtccagcctggactaagtccttccggagttggtgtgcatcagaacaaaaacctcgtgaggggagaacaccctccggaagcacagttttaaagtttatttttaacattttaatactctactttttaaattgcccatcgttacccacgatagtgaaatgaaaattaagctcccctggggttgccccgtcaaccctccccgcaccaagtggaacaggcggagctcgagctatgccacataggggcggggaagcagcccggcggtcctcatgggaatgtgccgtacacttcacctctttcgcttctcgctctacatcatccctgagaagcctttttaaacacttgaatgtgcttgtttcagagtgtatttgtaaagtgcagtcagattttgttgtacggaagacgggactgtgatgccttgcaatttccctctgccttttgcattacatggcgccgccatcttgagcagaaatgtatcatggggctcgccattttgcatggtcgagcgggtatttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaaggtagatttcaggacccgagattgcagggctgggggattccgcgtgtcgtgtagggaattccgcgtgtggtgtggcaggccggtggcgcgcgagttggcggggactgacagacttctctgccccattgtgaattggggcgtgcggacccgagcctaggcctcaacccgggcgaaccacattgcagatgagaacctacgtgtacatcagctcgcagctgctaggagggttggagagttggaaacttttaaaatatcttttgccttctccttcgtagtgtggccgggggcctacgggccgggcggggcggtgatgaccccaacatgccatctgagtgtcggtgctgaaatccagaggctgtttctgagctgccgcccggcccaaggctcgtggggaggcaggtggactccagaggacctcgtggctcaagtctcggcctactttttctgcccctggttctccccgtccctatccctgtgttcctgactgcgtttagacgcttcttgtgcttccgctttgctgctacactgttaagaattgtctgacttttgaatcatgtctggctgttaatcgtaaaatttgttgagtgggacaggtttcagtaaaagcatccaatcctgtagcgcctgaagtggcttttccagcattcattactacatttctgtcggccctcagaggtaggcataggaggccccagctactctacagccacaaactgctgtgcatttggttgcagagaagacacaaagtggctgttgagttcgtctgagtttcaggaaagggtgtctgtatttctggcacctaaattaagttctcaggatacaggctgggcgcggtggctcacgcctataatcccagcactttggaaggcagaggcgagtggatcacttgagatcaggagttagagactagcctggccaatggtgaaaccgcatctctagttaaaaaattagccagacgtgctggcaggtgccagctggccaagtaatcccagctacttgggaggctgaggcgggagaattgcttgaacacgggaggtggagtttggagtgagccgagatcatgccactgcactccagcctgggcgacagagcgagactccatctcaagaaaaaaaaaagttatcagggtacagtttacctctacgtgcgtttttagtctggaatagagccactcagtcctggtctgtaactgctcttgtctgttgtttccatccctccttaagcgtccttagttgttgttaacccactcatgaccttgacacttagtgaattatccagtgtgttaaacgggctgcgggttcctcactgatttttcttctgttttacctcctttagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagtagctgctcacttagctctggggccttgggaagaatctgggcagaagtgaggtggatgcaattggctggtttcccaggggagatccagtccatttgggaactggaaagcagagcacacctacagaagatgtttggcctccctcactttaaataagttactcagcattgctgaggagtgtggctgaacatttttgccaggtgcaaaagttctgagtgggcagcagtttgaacatgttttaccttgaaagctcaggtaattggcaggtggaattagagggtcctggtgatgacagatggcattgtcagccaatccccaagtgggagtgaggacatgtcctgcaattctgaagggattctctgtcacttggctcttctctttcatatactcagtcacttgactctgtgatcagagccaaatccagggttgtatgagtgatgcaatgagacagagacaaagcccaggaaatgagtctgaccgttgaatgagagtgtttgctaagtctgagaatgacaaactcctccctctcaggggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggtaaagtgagccatctccaaggatctcttccaccctcttaaactttgctttttttttttttttttggcgacagtctcactcttgcccaagctggagtgcagtggcgcagtctcggctcactgcaacctctgcctcccgggctcaagggattctggtgcctcagtctcccgagtagctggtactacaggtgcgcagccaccacgcctagctaattttttgtgttttagtagagacagggtttcaccatgttgcccagggtggtctcaaactcctgggctcaggcgatttgcctgcctcgccctcccaaagtgttgggattacaggcgtgagcccccacctgcctatctttgcctttttttttttttttctcggagacagtttcgcttgttccccaggctgaagtacaatggcgtgatctcggctgaccacaacctccgcctcctgggttcaagcagttctcctgcctcagcctcccaagtagctgggattagaggcatgcgccaccatgcccggttttgtatttttagtagagacagggtttctccatgttggtcaggctggtcttgaactcccaacctcaggtgatctgcccgcctcagcctcccaaagtgctgggattataagcgtgagccaccgtcccccgctttctttgcctttttaaagtcttgtctgggctgggctcacgcctgtaatcctagctctctggtaggccaaggtgggaggactgcttgaggacaggagagcagcctggccaacatagtgagaccccatctatttaaacaaaattttatttattttttttcttttttgagatggattctgggctagatcgcagatttgggatcgcagattgggggctggatcggggatttggggatgggtggggggcggtgaaaaggtgaaagggagttgccgcagctcagaagccgatggttgggtgtctgagaagattacaggcgtgtgccatcatgcccagctaatttttgtatttttagtagagatggggtttcaccatgttggccaggctggtctcaaactcctgacctcaggtgatccgcccgcctcagcctcccaaactgctgtgataacaggcgtgagtcaccgtgcccggccttatcactactattttgttttgttttgagacagtctcattctgtcgcccaggctggagtgcagtagtgcgatctcggctcactgcaagctctgcttcccgggttcacgccattctcctgcctcagcctcccgagtcgctgggactacaggcgcctgccatcaggtctggctaattttttgtatttttagtagagacagggtttcaccatgttagccaagatggtcttgatctcctgacctcatgatccatccaccttggcttcctaaagtgctgggattacaggcgtgagccaccacaccaggccctattattattattatattttttttggagatgaagtttcacttgttcgttgcccaggctggagtgcaatggcacaatcttggctcattgcacccttcgcttcctgggtttaagcagtgttcctgcctgagcctccccagtagctgggattacaggcacccgccgccacacctggttaatttttgtatttttggtagagacagggtttcaccattttggccaggctggtctcaaactcctgacctcaggtgatccacttacctcgccctccctgggattagaggcgtgagcttctgcgtccagccaccatctctaaatttttaaaaaattttcttgtctggaatctaaagggattctattgagcttaaaggtttgggttcttggtttttgaaaggtgctgccagccatcatcctactgaggggtagggctgggaggtctagcatttcatgggataggactgtttgccctaatttcctttccatcttctgtaggatgagagccactcagagtgggtgtcttgtgtccgcttctcgcccaacagcagcaaccctatcatcgtctcctgtggctgggacaagctggtcaaggtgagcgtcaagccaaggcaggggctttaccagtcagggtgtgctcccaggtggtcatacactccaagtcctgtggaaagctttgcagatgccctcagttgactctttctcttgtcacatggtctgatgtcccttgtaagtcagcacactgcattggatatgtgttataatctaacgtgaagtggccaggacatgttactgaatgagaaatggctaccgtatccagaagtgccaagcccttttttgttgggcctgaccctagctcatcaagagctaggatgttcacctgtcaaccgcacgtctatgcaggtatggaacctggctaactgcaagctgaagaccaaccacattggccacacaggctatctgaacacggtgactgtctctccagatggatccctctgtgcttctggaggcaaggtatttggggacaaggcgtctcctactcagtggaagacagcgtcatggaaggagcacttagccagcgtctctaacgtaaaatggcaaacattagccaagatggttttaggaggataatgagataatggcaatctgagaatatgtttccaaagattactttcagcaaatgacagttaaggcatactatctggaagaaaaagatgattttctataagcctgtgggttttttttgtttttttgtttgtttgttttttgttttttttttgagacggagtctcactcggctgccaaggctggagtgcagtggcgcgatctcggctcactgcaaccatctcccgggttcaagcaattctcccatctcagcctcccgagtagctaggattacaggcacccgccatcactcctgggtaatttttgtatgttagtagagaggattttaccatgttggccaggctggtcttgaactcctgacctcaggtgatccgcccacctcggcttcccaaagtgctgggattacaggcatgagccaccgcacccagcctaaagttggtttcttgaagcagttgatgagattgggatcctggttttcagaaatgattggagtgatttatgtaagttgggaggggttttttgatggggttggtaaggtcttacgttaaaggaaaggtatacagagataaatattggtacttgagtcattagctttcaaagaagcctggggtaatggaggaaaggtaagaattgattctgacagaatcttgagatgggcagaattaacatctggaagaggtcacagtgtcctgatttaccttacctgtgtccaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggtgagtgtgggttacaattgactgggtacctggctgcactctgagccctggcaatgttttggttattatatatgccatctgactcccacctgggagctaagctttctcagcctccacgtaatgacattttggtctgagtaactctgttgtggtgtgcagtcctgtacattccaggatgtttagcagcatttccagcttctactagatgtcagtagcaaaccatccttccactagtggcaactgaaaatgcatgtaggcattgatacatggaccccagggagcaaaatcatccctttttaacttgagaatcttgaggggcttttaagaggagactctcttgattggtaagtcttaaggttgcttttgccctgttccccaggatttagagggaaagatcattgtagatgaactgaagcaagaagttatcagtaccagcagcaaggcagaaccaccccagtgcacctccctggcctggtctgctgatggccaggtaagtgggtctgtcctctcaggtgattctgcttccagttaattttctccctctcattctgttagtatatctagtctgtcagacacaagagcagtgtccttggcataaagtgaaatgacaagccaggttgatgaggatgccctcgtttgccatgccagtgaatgtgtttctgcatcagagggaagactgatgtggaacgcagtggctgtcagccttcaattaataccttaattaatctgaccagttttcaaatgtctggagccttatcaccagctgtttcttcctcaaggaatacataaccaccacttacaagctggctgttgaaatgagagcggtttcttacagtctacccggcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctgaatctagtgagactgcagaatttatgccagcctgacctgtcactgtcatttcttccctgcagactctgtttgctggctacacggacaacctggtgcgagtgtggcaggtgaccattggcacacgctagaagtttatggcagagctttacaaataaaaaaaaaactggcttttctgacttttaggtttttttttcttatatgcaaaaaagctccattctatctacattgcttacacattaagtttgcactagcgaactggatgcaaggtatggactaagtaaacaaggctttgaaggggagctgtccgtctaagttctcaggattggggtagcatcaggtgggatgtttgtgagaagtcacatagcagtttccctgaacttaaaccccatcagcgtcctacataccacgtgcagatcatcagggcctaccttcaacctggggaaccttcttgagggaaagaactgatttcaaagtggttgcagtcaatttttagaaaaagcagactccgcaggtccaacccctgacacgtaagagtggaagatgaatcctcattcctctaaagatttgaacataattcagaaaacttaagcttcatgttagcagtctctgtcaacatggtctttgaggaaagtcaagggtttttaattctttaagcaaggcagttctcaccagaagaacttaattcaaaactaatttattcctcaggtcaaaagttttggggtggttggtctggaagcattcataaatagaaccataaagttggccctactaaacatttcaactgctactataacctggccctcaatccccctacacacaaacacagtttattcatgaggatagatgccttgtgaaaggccagaagtgagccattaaactacaattacagtttccaatagaaacctcagtacagggatggaatggttcaacatgcggctgagaccccactacccttgcaattttctgtgctaagcaactacagcatattgaaggcccacatgcaccctccacttcctactcccctcaatttataatggtgatgaggcatttctggcttcagtttcaactacgtgtggcaaacatctctaagtagactgaacagttagtaagttaggttaagatattaaaatggggagcagggtccacatccctgttgaaataggagcctgcctggtaacaggtgcaaagcatgcctttaactgcaactaaccagttcagttgtgtggcttctcactgcaggggcggcaaaggaagaaatcctgagttacaccctcacctgaaggaacagacctcacaagagaagcaaataaacattttatttccacagcacgccttcccttttcccaaagaacatgagttcacctcagccatcaaagcagagggcgaaagctgcaagtgacaaggcaagaggctcctagaaaaatagattatacccaaggctctcctcctggggacccaaacccgtccccaggctccccctcagagcttgccaaatggagtgaaaggcatggaaaggggctgggagaaaagccagctccactgaacaaaggggagaggagcctggcagtgagcagacctgggaggggtgtggggtgggatgagctttgctccttggttgagtgctggaaaagggaagggggaagaaataatttatgttgatgtaattaatgtaatgatgatgtaatggtgcgtggtttcaatcatggcgaccattccagatctctctcaagtgaagctaaattctggccggtctatggaggtagaaattgaggacggaaggaaagtttagaatccctcctccccaggagaatagacatttattacccagctctaccctttggcccagcctgcctccccaaatggcttccaaatccctcagctaaaatctgcatcagaaaatggaattggaatggggatgttgccttgcccaaaccctccagcctcagaactgataaagaggttgaagagcaggggtggggaaaaggaagttaaggaatgaaattacaatttcccctcatcccctactcaaattccagtcccagggctgggctaggcagactgggagagaagaccaggcagctgttctcattatcagggacccatgcagacctgttggacagacatagtaggtgagagaaggctgagctggaggcc

SEQ ID NO: 12919 - DNA, 9997 bp, Human
  misc_feature (1)...(9997): n = A,T,C or G
gaaactgggaggaggggtttgcagtgagctgagatggcaccactgcactccagcctgggtgaaaaaaaagatatagtatagtcctttgcccttagtggatgtaatactagttcctttttttttttttttttttttttttgagatgtagtttgctcttgtcgcccaggctggagtgcaatggcgccatctcggctcactgcagcctccgcctgccaagtagctgggattacaggtgtgccaccatgcccggctaatttttgtatttttagtagagatggggtttcaccaggctgatctcgaactcctgatctcaggtgatccacctgcctcggcctcccagaatgctgggattacaggcgaaagccacctcacccagcctcgttacttacataaatcagtagtgcaagacaatctgttataagtgacatgatcaaaattgatactttaggagtcaaggtttatctttttttcttttttattatttttatttttgcccccccccttttctagctgaaaattctatactttcccatttgaaagttcttagaaaaacagttcaactagttgcttcctaattccttccatttattttgtagtatagaattctaataatggaccaggtgccatggctcatgcctgtaatcccaacactttgggaggccaagatgggtggatcacttgagtccaggagttcgagaccacatgggcaacgtggtgaaaccccatctctacaaaaaatagaaaaattagctaggtgtggtggcacgcacctgtagtcccagctacttgggaggctgaggcgggaggatcatttgagcccagggggtcaaggctgcagtgagccaagattgtgctactgtgctcctaggcaacagagttgagaccctgtctgagaaaagaagctaatatttgtatctctaagaattgataactaccttcctttttttaaagaatgtcttactcgatcaggtaaatcttgaatttttctttctttttttttttaagagatagggttttgacatattgtcctggctggtctcaaactgctgggctccagtgatcctcctgccttggcttcccatagtgctgggattacaggagtgagccactgcgcccagtcttggatttttcttgctatcattttcttaagatgtcttcctgatctagagttggcaggcagcattctgaagcaagttaattttttccttccatgatgaagcagataaaaactgtagtgtacacactcgcgctatcccaccccccttttattactctgtacatgcctttgagtcagtaagctaattcagttagtaaattcatggggtttttttgtttgttttttgagatagggtctcgctctgccacccaggctgcagtgcagtggtgcgatttcagctccctgcaacctccgtctcgggctcgtgattcctcccacctcatctcccaagtagctgggactaaaggcatgcaccaccacacctggctaatttttgtatttttttgtagagatgacctttcgccatgttgcccaggctggtctcaaactcctgagttcaagcaatttcaggcctgatcgtttgcctcagcctcccaaagtgctgggattacaggatgagccaccatgcctggccaaattcacgattctttaggatccttgatttgttatttttctttttgttcctactttgtggctattttggtacctgcacttaaatgtgagagtgcagagggaaggggaaaaatagatacaatttattcttagggtagttgagaaaagtaattaattggtgaagaataaaaattttttagatttgaaatagcactaataaattaaacttacaaatagttctcaaatcagcttttagcattacagccttaagttcttacttttaaagagacattttcttcctaatgtctaaccattggtaccattttgctgcctacactgtttcatatagagagtgtcgtttaactgttaaaatttactgaaacaatttttccccagggtcttatttttgtggtagatagcaacgatcgtgaaagaattcaggaagtagcagatgagctgcagaaaatggtaagaaatatactttaaattcatcattttcaaggtgtgcttttctggattaaactggtggtggtttagtacattttgactatgattagattacacaaatggattgggggggctagaaataaacttaagaaactatattatccacaggttcttaataatgtacttcaaaatctcttatagagcgttttaaaaaacacatggaagagtagctacttcagtaagttgggaggaaggcagagcagtgttgttttttttttttttagaatgcctcatgggtaatcttgatgcctatctctggctgaggatatctgatttagctcagtcccttactttacagatatcaaatctatagtgctgtagtggttttgaccctaggaatcttggttcagatgttttgttcccaaggtcatcggttccattttctctatgctgtgccaataattacttcagaaatgttttttaatagtaaccatttaaggataaggaattccttctgaaagtagagacaaatgtttggttcacagtggcattttgcagccttcccatagattggattaatgttgtcatgtgttcatgttgttaaatgtactaaatggaggaagactgctgagaatccttgtcatgattttaaacttgtagccataaaatatttactgaaatgaaatcttaattcttgttcattcctcctaagattagagggcagtttgtaaaaccattgtgccagtatatgtgtaactaagtcattgttggatttttgcctgagtcaaatgtcaccagctttccctcttcaaaaaaaaaaaaaaaaaaaaaagcttggttgagacatacttcacacactataaatgtcatcctttttaaatgtgcatatcaatggcttttagcatacatagttgtacaaccatcatcacaatctaatactagaaaattttcatcaccctcaaagaaatcttggaccattagcagtcattcccatttccttcctctcgtacaccacactcccagcctctgacagccactaatttgtctttatacagtcacctattctggacattcatataaatgaaaacatacaatgtgttcttttgtgactgattttttcacttagcataatttttcagggttcgtctatattgcatcatgcatcagtacaacttctgttcttggtactttttttttgtatatttcatgatactgccaacacccagataattgtgttattgtcccactgttgttggaaaggatagaagtccgaaaagaatcatcatctatctaagtacttctgctactaagtaccataagaacctgccataaacattttattcccacatgtatttcttgcccttatcagtcctgacaatgggtaatcatgaaggctgaatgatgagtgatttgctttaatttaatggggtgtaggatgattgacttggaaaacagttctgtcttacttgaaggcatatgattgtttgctctggatttaaaaactgaaggatatgagacttcagttgtaagagtgaactttgtgtcgagaaattaggttaatgtttaataatgtatttaatgctgagtaaagtatatataggaagacattttcaaaaattggattccggttggtagttgttaatgccttaccttttatttccagcttctggtagatgaattgagagatgcagtgctgctactttttgcaaacaaacaggatttgccaaatgctatggccatcagtgaaatgacagataaactagggcttcagtctcttcgtaacagaacagtaagtatttggaggttgatattaacctcttgactattaagacttactaggatagttgtgtaagctaatattcagtttaaacatttattatctcctttggacaaataatgagcacatcatttatttaaaaatatggtaataaactttaaataccttatttgatttttgtaaagaaacggaaaactactgtagaataggtctaaagattattgatagtttcttttttcttttttttttttttgaagggagaggtggaaggaatggaaagaagattattgatagtcttaattttaattttgtatcttttaagtaaccctacagcaaatattttgaaatctggctttcttattaagggtccagtaatgtttgtttgcttgttttaaaagtggagatggggggctgggtgcggtggctcatgcctgtaatcccaacactttgggaggcctaggtgagcagatcatctgaggtcgggagtttgagaccagccggaccaaccagggagaaaccctgtctctactaaaaatacaaaattagccaggtgtggttgcgcatgcctgtaatcccagctactcaggaaggctgaggcaggagaatcacttgaacccaggaggtggaggttgcggtgagtctcgatcgcgccactgcactccagcctgggcaacaagagcgaaactcggtctcaaaaaaaaagtggagatggggggtctcgctttgttgctaggctggtctttgaactcctggactcaagcaatcctctcactatctcagcctaccaaagcgctgggattccagccatggtgnnnnnnnnnnnnnnnnnnnnnnnnnnnnnnnnnnnnnnnnnnnnnnnnnnnnnnnnnnnnnnnnnnnnnnnnnnnnnnnnnccaaaccagcccgggcaacaaagtgaaaccctatctctacaaaaataaaaattagctgggtgtggtggcatgtgcctttagtcccagctacttgggaggctgaggtgggaggactgtttgaacccagaagttggaggctgcagagagctgtgattgtgcccattgcaccccagcctgggtgacagagcaagactgtttctttaaaaaaaaaaaaaaaaaaatttgtacttctctaaaattgcttatcattgatcagtgattcagtgatggagataaattatcagaaacttagtgtcataggctttttacagtagttttgcattaacctgtaaataagggaaatactgtggctgtggtaaaaaatgaaacaaacaacaaagaacctattgcaggccgggtgcagtggctcacgcctgtaatcccagcactttaggaggctgaggtgggtggatcatgaggtcaggaattcaagaccaacatggccaagatgatgaaaccccatctctactaaaaactacaaaaaaattaggtgcagtggcaggcatctgcaagcccagctactctggaggctgaggcaggagaatcacttgaacccaggcagcagaggttgcagtgagccgagatcacgccactgcactccagcctgggtgacagagcgagactccgtctcaaaacaaacaaacaaaaaaaaaaaaacaacctattgcctgtttgagatatctcaggctgatttgaagaacataaactgggccgggtgtggtggctcacacctgtaatcccagcactttgggaggcgaaggtgggcggatcacttgagaccaggagttcgagaccagcctgggcaacatggtaaaactctgtctctactaaaattacaaaaattagctggtcgtggtggtgcatgtgtgtaaccccagctacttgggaggctgaaggcacaagaatctcttgagcctgtgaggcggaggttgtagtgagccgagatcacgccactgcactccagtgtgggcaagagtgagtactctgcctcaaaacaatcagtcgatcaatcaataaataagcaagcaacactaactgtaaatgatacaagttttccatgctgtgaaggtatgaatttgagcctttccccagcctcctaggttactgagatttggtattcaaataattggcaacatggtatacctgcagtggccttgcaacattaaactggtcaaaaaaattaataaaagtaaactatgccttaaatgtaaattgttttctaggttttttttgatactttcacacagttactagagataagattcgttgccatttaaaagcaagaacgttttggaatgcatgagactaaagatggtgaaattgtctgaaaagcttgcccttaaaatatcaacaaaccctactctttctttctttctttttttttttttttgagatggagtcttgctctgtcacccaggctggagtgctgtggcacgatctcggctcactgcaagctctgccttctgggttcatgccattctcctgcctcagcctcctgagtagctgggactacaggcgcccaccaccacgcccggctaattttttgtatttttagtagagacagggtttcactgcgttagccaggaaggtctcgatctcctgacctcatgatccatccgcctcagcctcccaaagtgctgggattacaggtgtgagccaccacgcccggcctaacaaaccctactctttcaaaaatttgcctcttctactttgagtttagttttatgggaaacgagagttataaaaaccagatgggtagtttattagttactaatttccccatgatttcttttttcagattaagtggtagaaagtttactaaaagggaaccaaaaaccagcactgaaaagaaagctgaatgaggggggaaaatcttgtctaaatataatgaataggtagaagtagcttgattgattgagacggagtctcactctgtcgcccaggctggagtgcagtggcacagcctcggctcactgcaacctccagaataggtagaagtggctttatttttaaaaaataatttaatctaaaaaagtagagacaaagtctcaccatgttacccaggctggtctcgaactactaagctcaagtgatcctcccatctccgcctcccaaagtgctgggatttataggtgtgagccaccacgcccagccagaagtagctttaaatatgggagagttttgtgagatgcaagaggtgtgaaaagactcttaagtttgattaagaaagtttaaacactggtgttatatattaactttgttaatcaagtattttcttgtcttctctttacagtggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaattgtgtgtgttctttttgagttttgaaggtatttgaaatgtattttcttatgtagccaactttgcttgcatattttatgtactgtgaacagtaacacagatcccactggtaggttactaattgtataaagtggagatctagattgttttcatgtgtataacagcatggggaacactattaaaaacatagttttctaaagtcagatcaagggtaaaaggagggcctggcatggtggctcacgcctgtaatcctagcactttgggaggttgaggcaggagggtcacttgagaataggagtttgagatcagctttggcaatgtagtaagaccctgtttcccctgtctctacttaaaaaactaaaaacaaaacaacaacaacaaaaaaatcaggtggggggtggggaggggcggcatgtggagtggggtagggagagtaaaaggctgtaataaaatgaactgcccaaaaagcatgtatgtatgtgttttttagttaaggttaattaaacaaaaaaattcaggtgctacttgtatggccaatatagagacttagtgatgctactttcctacaaaaaagtttcacaaccacttttctttttaacagggcaaattttagaactttaacagaaagctgcatataattcatacaaaggtatacctcataaactacatctattaagttttaagggctcaacttgataactgagtaacttagtttctgtctatattctcatgttgcattcttaatggcttgtaaagattcagctaaatttatggattgaaaattccaaaatcaaatgcatacttttaaaaaaatgtatatttttgaattgtcaaataaataacaatggccaggcgtggtggctcacacctgtaatcctagcactttgggaggccaaggtgggcagattgcctgagctcaggagttcaagaccagcctgggcaacatggtgaaaccccatctctactaaaaatacaaaaaaaaaaaaaaaagggtctggtgtgctggtgcatgctgtggtcccagctacttgagaggctgaggcaagagactcgcttgaacctgggaggcagaggttgcagtgagccaacatagcgccactgcacacggtctgcaagactctgtctcaaaaaaaaaaaaaaaaaaaaaaaaacactggattaaccaaaaggaaattagaattggttgatgattaggtagggcaaagtgtatgtttagtttgtgttacttgttagaaatgcaatttccctagccaactggatgaattctcctttcttccttccaaagaagacaggtgtcatttcctataggataaaactgaactatagtataattgttgtgtgtgtagtcttatggggcatcaactaggaaatataaaacatcagtgaataagttcagcgttagggctaggtatttaacctagttatgcaaaggtgtttacatggactgtaaagggactagagaatctatgtaatcttactcgtgatgtaaagcagctcttagtaccattggaaattacctttttttttttttttttttttttgagatggttttactctgtcacccaggctggagtccagtggcaggatcttggctcaccgaaacctttacttcctgggctcaagtgatcctcccatctcagccccacaagtagctggtactacaggcatgagccaccatgcccaggtaatttttatagtttttaaagaaagtattaggctgggtggggtggctcacatctgtaatcctggcactttgggaggccgaggcaggtggatcacctgaggttgggagttcaagaccagactgactaacaaacatggagaaaccccatctctactaaaaatacaaaactagccatgcatggtggtgcatgcctgtaatcccagctactcgagaggctgaagtgggagaattgcttgaacctgggaggtggaggttgtggtgagccaagaccgcaccattgcactccagcctgggcaatgagtgaaactccgtctcaaaat

SEQ ID NO: 12920 - DNA, 6501 bp, Human
cgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttgatttttctcttggctgagtgattttggggtccggagatttattttcctttcacaccttctcagcagctgccaagaatcaggtgcccagctcccgctgcctcccggccggcctcctccagaggccagcgccacattggttgttgaagggcaggactcggggctccttgctgttcccacgccagcccaacagcccgggttgaaggaagccacagggccaattctgtgttgaaccctccccaggcccctcctccagtacccccccaccccacgccttcccaggcccccctcgggccatctgggagacagaatcaggaacaaggaaggggaaggcggaggcctcctgggctggacgtggacggctgaagtgtagctcacacacttggaccggtggggccggctcatgtggcagcttccccggggacgtgaggatgtcagggtcctccatttccaccttccctaggggtctggagcccaggccccaggccttgccagccctgaccaccgcacactgcgaggcagccgcccctaccacgccccttggcatcagacgatgggtcccccacccgccctggaaccggggccccagcagccgcatgcagcctccggcctccccctccgaaggctcctgggggctgccttccactgagtgggttttcccttctgcagtaactgccaggccaaagctgaattgtaaaagttgcgaaatgatgggccgggcgcggtggctcacgcctgtaatcccggcactttgggaggccgaagcgggcagatcacggggtcaggagatcgagaccatcctggctaacacagtgaaactgcgtctctactaaaaatacaaaaaattagcagggcgtggtggcgggctcctgtagtcccagctactcgggaggctgaggcgggagaatggccggaacccaggaggtggagcttgcagtgagcccagatggcgccactgtgctccatcctgggcgacagagcgagagtccttctcaaaaaaaagttgcgaaatgaagaaaagtcttggaatagagcacaaggcattttagctctggggattttcttgaaaggaaattgtgtttggggggagttatgcctcacacaaccccctgggtaccagtcctcgggcggccagggggttcacagctccccaccccaaggctaaggggtcacctggcctctgcaggcggacagaagggcttctgccctcgcggatgcgcgccctggcctggccacaccttccggcctccctcccccgggtccgggcggggaagagccgcctcaacggcagggcccatccgcgagaggccagcgcccccggccggtccagcccaggcccgccgcctccgccctgggctgctccctccgggccctgcaccgccctcctgctacttggaccgcttcctcacgcccttctccaccccgcgcgccagcctcccgcgcgcagcgtggggatctcggccaataaaggagaaagggcgcggcccgtacgcgcgccaggtgcgtgggcgagaccagctcacgcccctcctccagccgccaaggccccggcccacagctgcctggctgcagtcagaagcgtagcccgagacaaggaagggcgccttgactcgcacttttgtccggttcgaacgttctgctcagtggtgcgtggaatgcgagcgcgtcttaaaatcgatggcgcctaggagtccatgaaatacggtacaggcttccggcgacggatgccccgcccctcacccacgctccgccctccggggatgccccacccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacgagccaggccttccctggtgaagatcacggaatgcccacccagggaagggaggcctggaggcctccgggagagcccaagaggtggcccagggagaacagagtgttcctggccgtcttgcctctcctagggtgtgacagcccactccctggacactgccctgaggaaagcgccagctcttgctggagccacaacactgccagagctcccttctcacctcctgcaggaagccctccctgacctcctgccaggccggggcagggtttccctgagcgtcccccaaccatcacagctcaggccacctcgagagactccctttttagacagaagccctggtgcagagctgcctttgagagtaagctgaggcctgtcaggtttctaccagcccagttacagatgggctgctcagctcagagagaggggtggtgactcccctaggaacacacagctaagaagtggtcccttaaaagacagacccaggtctgcactctgacctggaagcagctccgggtaggtgatgggtaacattccttaaatggtgcatgtcactggcctttcagctgggagccaaccaggtaccccttgccaccggccaaccctggcccctggggattcccatgctgccgagtcactcctgtcacttaccctgacaggcctagactcccgaggcttcctctttggcccctccctggcccaggagcttggactgggctgcgtgctcatccgaaagcgggggaagctgccaggccccactctgtgggcctcctattccctggagtacgggaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggccgacaccttcctctccccatgccttcccctccccaacccaggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaagagccgtctcctgtcctcctgttccccagggcagggagccccaggacaacaccagacttcagctgtactgtgggcatgtgctgcttggcgtgatgcccagcagaacctgtcctggttctcacctcaggagctagaaccctccaggcactgcaggaagaggccatgtgggcccatcttctaggggagcaagcgagggctcttctgcagatctagtggctgtaagcatgactttattagagtttaggaggtcagaaatactgaagtcaaggtgtgggcagaggccagtcccttctggaggctccagggatgtcctacttgtcctgcccagcttctccaggctgcctgtgtcggggcagggccgcgtcttcaaagctggctggctctggccctgtcatgaaggccctgtgatgacatggggcgtagctggacaattcaggatcacctctccagtcttgaaatttttttttttgagacggagtctcgctctgtcacccaggctggagtgcgtgcagtggtgcgatcttcgctcactgcaagctgtgcctcctgggttcacaccattctcctgcctcagcctccctagtagctgggacgacaggtgcccaccaccacacccggctaattttttgtatttttagtagagatggggtttcaccatgttcgccaggatggtctcgatctcttgacctcgtgatctgcccaccttggcctcccaaagtgctggggttacaggcgtgagccaccacacccaccccagtctttcttaatgacaaaagtcaccctttgctgtgggaggtcccatattcagaggttccaagattagaggggatggcctgccacccacactacccaaccccatattgccacagagcccccttcacccccagccacactcccgatggccccccagggggtgctggatctggcttcccttccccaccagcagcaaggacagaggtgcccacagaaaccggtttaatgtgaatccaccaggtgagccccatgaaggggcccaccgcccgcagccagagaccctcgggctgtgcagcctgcagcccacatctgcctctggccctcaggggcgctggggaaaggaaggccaaagtgtatcatgttcataaaagaaaatgctggtgggcccaggccagcgagcttctgaagcccacgtctgtccacagtggcccccaggctcacagcccctcctcagcacgtgtctggtgggccaggcgtgcagtgatgtgggcgaggtccgcggccttgtccagcttgacgtaggtgtcggtgcggatgcggtggaggctgagccagtccggcagcagctcggagaggagcagcaggtgcttctccatttcccctgggggaggagaggaggacactgaggctggtgctgggccccagccctgcacgggcagcacttgaaaccagcctgaccacccaacctctgtgcctgcctggtcgccctcagggccccatcaccaggacttagggcagaggtggttctgatcagaggcccaggtctgggtggtgtgaacagtgaccggagagagccaggcctacagttgaggccctgtgaggaggcaccgagcatggaggccgccagcccatgaaagccctgaggcaggaggtgccctgtagcgtcaggacccctatgtgctcagggcctggtcaccagaggcctgggaggcagtggagggtgcatgtggggccccttctgaccaaggactgcaggtggtcagggaaagggccagagctgtgagggggaagctgcctccagaggctgcaggtgtggaggggccgggcggaggctcaggggtggctccaaggagggcagagcgcccaggacacaccagtgcaagaggccagcgcccactgcacatctgaacagaacagatcagtgacagacacctctgctcagaaagctggggaggcagctgcagcaccaggcaattccaccctgcacgccccttcaccccgccctgcacgtaccagggctcatgat

SEQ ID NO: 12921 - DNA, 12377 bp, Human
taattatgttgtaacttctgtatccacagcttccaaagacctctttctatattctgttgtttctgttggtccttatacacattgtcttttattcccatgagcctggttatcgttgattgtgttttaacatttcatttgaaaaaaataaaacactttgcagaaataatgacctgggatgatgtcattctccttcagagaagatttttgtttctttcagcaaggagcctgggggcatgagcaataattccaggagttgagattcctttcctgggacacttagatgtctcaaaaccagtttgcagcccttgtgaatgttggttgttgctcactcatcctattgctagggtgcagcccttctgaaagccaaccccaaacccatacctttggcaggccgtaggccccagtctttgaccttcagctctgcaagatggtgaaatcactgcccaacttctcacctctcttttggagattggcaaatccctgtgcaaaaagaggtccccactactagtttcacttctctaagatttctgtggctcctgagagcttggcaaagtaatcctttactacatagctagcttgacggtgccttcgagcaaatctctttttaaaggttttgtctgtttgtccttaataggatgcccccaaatacctaaactgccattgccaggaatcaaatgacttttgttgatccaatgttaagatattttaacttgccagaatcttgcattctttcatactcttgggaacattgacttgatatctgaaggtggtgttgacttctcacctgaaataaacctattgatgttgcaaggaagaggaggtcccctcacacccagggggcagctggcaaatggaattgaggggcacagacctgctggctttctccctgttctgacccaatcccaggtgagtgctgctcctgaattggatcctctccaagaaaggaggccgcaccactgacacccagacctctcccgcctgggccagtagctcagggacactaagcggtgtctgaggcaatgaagcctcctgccgttgtctctcaacaggctggagccaacacacacaaacacacacagtcgagagtcgttgtggtgcccagagagcctggacacaaggtcctgtgtctcctggatcccccacccctgggccgcccctccacttctctcccacctggggagcccttgagtttggaaacccagtctacacacgctggctcagagaagttgcaaaccacaaaacaacacctctccctgctccttagtcctgctaccatctgactctcgttagtgactatttctatacgttctaaaaatcccgcacaaagtgtccacagcgtggcctggctaagcatgattcacagcacgagatgcggagtaggaacatggcctcagggatttgggggaacaagaggcatccccaccttcaggtgaaatgagcaatcccagtgatctacaaggcgttagacagaattgagtccaatgcctggctcttactagtggagtgacttcaatttctccagctgtaactttcaaataatttactccaccgaatggggctggtgcaagatgatatgatggaaatagtatttgggacataacaagtgctcaacatttttttcctctccatccatgataagtgcctgatgacggacaaaccctgaattttctgggaacagatgaggcaaggaagcgtcttcagcaaaaccttccttatcccccaaggttaaggtcaaggtttccgagtattgcttggggacagctggggaatggaaagggggtgtgggggctgtgttctccttaagccacaagcaaagccgatgctttccagcagaggagtctcaggagctctctggactgggagcagggtgtctttgctgggggaagagagcccaatggggtgggcatcttgctggagcctagtggaaggaaacatcctttgagatgacctcatacctcctgttggtgcaactaagcagcccataggaagtgggtgtcccccagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccaggtgagacagacctgggttttctggtccctaaaagctggtaacaaccccactcactgacactcgggtgtcccaggcaaaaccttttatgcacatcttcctgtgaagatgcccaacagatctgttttatcctcaggcaaggacatggaggctcagggcagctgaggcattgcccagggtcatggagggataggggagggatgtcaccaggtctgtctgcctcgaaagcccaggatttgcccattggagcttcataggtgggtctggaatctgtcactgagaaggaagaaaatactgttgactttatcttcttacgggcttaccagggaggcactctaagaccctctaatacggtggctgccacacggacttggggggtttgttaaaaaggcagatttctggctctcctccaagagagtcggaatcagttgatagggacaagggtttgaacggtggtaaggtgtttccctcactgattcaggagcaggtggttctgtgacgctcagcaagagactgctcctaaggacggcctggtgcccctggctgataacatatttatgaaggaaacataaatagtaaattacagcctgctctagtggaaggaggactggaaacacagaaaggaaataccccaaaaatggcagtgccatgtctccggtgagagcactgctccgttccatggtctctaagagcgcccttagcagggcgtgtagattttgtaatgaacaaaatgaaaaatattttttcaaagaagtaaacaactttggtttggctgcagctgtgccacacctggctctgtgtccttggaccccacactgcccctctccagaggacctagaaagccccttccagcccagtaattctacaaccacattcccaaggtctgggagggaaaatgctttgtcagccccaattccccaagtttcttagaaatattgattgtcattagttattgaaagtgcccgctgtttattaagctctttctaaatgccataaattacaataagagatttaaaatgcacattctttaaccaaatcctggccgcaaccttgttattatccccgcttggcagcccagggcacaaagctcagaggagttaagttacttgctgcaggacacacagcactgaggagatggggctcccctaggtcggggtggcctccaaagccagagctctgccccccatcacatctccgcctcaccagtgcctgaggggtgaggacagaccaaggccccagcagagcagaaaacctcacttcccagccactgttgggccaggcactgagtgggcacctgtgtttctctgcagaggtgaaggtggtgggcctggagggctctgacaagctcaccattctccgaggctgcccggggctgcccggggccccagggccaaagggagaggcaggtgtcattggagagagaggtaggtgcgggccgggtggggaggccaggcatggcaggggcactggctcttgctctttatgaaactggatgcagagttgggcaacacccccaccgtggttcctagatcaagagcctgggtcaggcccctgctagagccaggaacagagctgactcccagggcccaacagggttctgaaatggagggagggtctttcctaactatttcatgagctcacatttggacatgcttctgtagctctgtctcctagtccttgatccaataccagctttgctcagctactggcacgacttctaagctctgtgtccctccaccttctcacctgaaaattgaggtgaccgctttcttctgcacctgcctcatatgggaaaactgagactcaaagaggtcacaggctttcctacttgacaaaccagtaaggagtggggctgggacttggactggtctacttcagggcacagagggcacccgaatcctgagccctgagctctgcatgtggatttgcagggaacatgggagaatgaacagcaggcacctgccttgggtggttttgggtccccctaagcatggcataaggcagacgtgcacaaaaactcagaaagggcgctgccttagggggtgagctccccatgcctggacgcattcaagatgatgcctgcggagcacttggtggggatgtcccagtgtagatgggacaagctcaaatgtccctatgacttggactttcactgacgtgtctaggcttccgtgtgggtgtccggggccaggtcctctgtgcccactccgcaggctggacctgagagtgcggtcccgatcccctgctgagggaacactggggaggaagaccttccctggcaggagaagaatcaagtctggctcagacttcccttgaaccaggcttctaccagtgggcatggctggctaatataccctaaagcaagaaccagcccccatacactctccccagccactggggtcagcgagcgggctgggggctgcctcttggctggcatcggggacgggagggtcacctttctggccagaaccacgtggagcgctgtgtgacaccccaggagctcaggcgcacggtggaaccggatcctccctggcagcagcggctgcacgtggcgcccaccctctccgtgtggggatgtggtaggatgaggctctctgaggacgcattctttgttccagaacctggtcccttgctaggcagtagagctctgtgtgggtgacttgggtccaggcttatggtcaacagagtgtgaaacccaggttgctcccaaggcacaaacaggagcaaggtgcaccttgccttgagcccaaggtggggtgcaggcccctccctcaatccctcacctccatctgcagtcacccccaggctaaatccatggctagcaattctgagagctcctggaaccagaaggggttcaaggcagagtgggggagggtcaggacttaaccacttggggcaaagatttccagggagaattgtttaggttgcatttttctcagtgatatgtctttggaattttcaggagaacgcggtctccctggagcccctggaaaggcaggaccagtggggcccaaaggtaaccaggggacagacagcgaggaggccttgagcagggaccttggagctgtctgtaatgaaatgagggagggagagacagagacagagacacagacacagacacagagagacacggcaacagagagagaaagacagtggcaggcggacagggaccctgggatattccaggcctcggggcccctccccaccattgagacctgggcgttgtgatgccttagtgagcctgcagggctggggagatgcagtgtccaggccgggagcccactctggaccagcctttccgtggcccacacatctggggtcaaaagctcattatcctgcctcttcctccaggagaccgaggagagaaggggatgcgtggagagaaaggtgagccacccgtgggcccaggcagttgtctctgcaggctttgtccaggggaggggtctcagaggcctcagtccgcctgcccaccgcccacgtccctgtcaatccaggctgtgggcagggaggggtggaaggagtccagcgggctttgttgtcagaatccacgagggctcaaaccctggtgtctacagcagtcactcccagtggccagcaggaccacatcagtgcatagatggtgacacttcaatatttcaatttctgtcttacttatgctcatttatgcaaaaattgtaaaagtttaaaaaagccaaatgtgcaagactctaatacactgtaccacgctccacccacaaacacaaatgaaaaccggagccgggggctgagggtccgccgatacctgagtcccaagaaacagaggccagggcggaggcagggcaggcttggagtgaccctgccaggcttgaagagttattccgctgttatcagtggcgaaggccccactaggggtccagttcgtccagcaggacccgcagcgcctgccacagcccaccaagctcaagctgcacagcaggggcctatggacaaccatgtggctggtgcctctggggaagtcgagtctggccatccttccctaggcctgtgccacgtgtcctggagacatcagaggagctgcctttgcccattctctattctgtgctcagggagccactggggctgaccaggacaaaggctctgatttcaagcttatgacaagtgtctcctctccccacacaggagacgctgggcagtctcagtcgtgtgcgacaggtgactgatcacaccctgacctcggtacccaagccttgcccccacccctggggccagctgcacacgttcacgctacggaatctaaggacagaaccctgtctgcacctatcatccccccctcaatcactcgagtaatgggcagctatcacctgaatcccttccatgacaacctgggctctactattatctaccctagaaggccgggtgcccaggaggcaaaggtggggcagacactgggaggtgggagggtcggcagactgggtgtgggcatcacagctgcgtggccctgggggccgtgtccctgtccaggcctcggagtcctgctcggtccgcacagaagcctgtggccctcctcctccctcctgggcctccctcccactgcccctgtcctgcccagggcccccgtcctgcagccattccccgggttcccttcccaggcccacgcaactgcaaggacctgctagaccgggggtatttcctgagcggctggcacaccatctacctgcccgactgccggcccctgactgtgctctgtgacatggacacggacggagggggctggaccgtgagtgtggggctgggcagaggcggtcagcctgggagtcccggaggccaggctgcacacctggttgtagaacacactctggaattctctattcccctggatggggacaatcatagatgatgggggaagtgacccgtgggtaaaagtccaggccatcggggaggctgggaggggaccggtgctctcctgctgtgtggcttggggcttgttgcctctcttctctgagaccgcatttcctctttcatcctgtggagtctgtgaggagaccagatgggcgtgcgtgtggcaccggcctgtgatgctctgccaactacaaatgctgctcctctggagggcgggtccccggtgctgtgggacctcggcctgccccgcctaactctgtatcctggcttcttcacaggttttccagcggaggatggatggctctgtggacttctatcgggactgggccgcatacaagcagggcttcggcagtcagctgggggagttctggctggggaatgacaacatccacgccctgactgcccagggtagggccactgccgtggctcaggggttggggggccctgaggtgctcctgccccttaggcctgggccatctgcaacataagcacctcttggcccacaggggattgggccctgagcacactcaggtggcactgggacctctaagggctgcgtcccctgccgcaggctctggcaacatcgggaagggaaacggttagagccctgggctgaaggcctcttcaggtcttggtcctactggcatcttagatcctgagagtgggaagcaggagagagaccactggggcttggggtagccttcccccatctccagctgttgatctgcctctgaagctggcatcttagtcccatggagagcccacgctcgcctcctccagcccacgcctcagcaggccccccacagccgcactcacctgagtgagagggcctccccccaaccctctggggcaggggatgagtttcacagctggtcctgaggcagtctgtataattgctggtccattatccctgcccactgccctgtggcatgattgaaggaatccactcaggtgcctcaaattcctgcaaaagaaactacaattagagcttcgcccactgctgtgttagtggctcaccaacccttagaaggagaaggtacactttcaaaatgaaagaatgctcccttccacccagtgaactccagtggggcatgttcagttctctgaaataacgggaaaggtgtttagaaacagaaagccatccctgagggcctgatagcaacaagggattttctgacatttccggttgatttttttcctggatgccacgttcagacatcccttaagaatatatccatccccagccgggcaccgtggctcacacctgtaatcccagcattttgggaggctgaggctggtggatcatgaggtgaagagatcgagaccatcctgaccaacatggtgaaaccccatctctactaaaaatacaaaaaaaaaaaaagtagctgtgtgtggtggcacacacctgtaatcccagctactggggaggctgaggcaggagaattgcttgaacccaggaggcggaggttgcagtgagctgagatggtgccattgcactccagcctgggcaacaagagcggaactctgtctcaaaaaaaaaaaaaaaaaaattacccatccccagccctcatgcctggtgacagaaagatcttaaaggctggggccttaaaatctttttccaacaggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtgagtgtctgcttggggctggtggcctgagtggggcttggaaagcagagagaacctggctctgtctcccctggtgaccttgggccctcctctctctgaatcccatttctccatctatgaagcagacactagcatttgtgtctctgtacagcgtggggctcacaggacatagcggctggtattcctaaggctatgtctgccgcacagtgagctgcctgggcagggctgagacgacccaccagcatcactgctgaaacctggaagacgacgtccttttctcatgggtgccttggagctgtttcccaaactgtgctccatggaacaccagccttgtgggacattctttaccaaaaggagtctctggctacacgatctggggaggcatttcctacagggcgtctgcttagggaattcccagtgcacatcgttcgtgaaaggcactgagaattgctgcagctggaagtctgtgtaactaactgctccatggagcaaggcagtcccaggggagccttggaaatgacagccttggagtctgtgcagtcctttcacaggcacgatctcacgcgtgacctccaaggaaggcagcagggcagggaaggtcacccccattttgcaggtggtaaaaccgaggctcagggggtgacatttctcagctataggagccagggatgagcttccggctcagggcttgagatagaggagaagcccccaggtgagggctgtcctgaacctaccaagggccaccaggggacgtggggagagaccggaaggagcggcgcaggctggaggagggaggtcattccaggagagagcaggaggcctgacagtttgcgggagccctggaggaaacaggtggttgctggagcaggggcctcaggttgtggagagagatttccagaccaggttgccagaggttgcctcctgcttccccttcctccaaggcctgggtgggtcatttgtgcacctgtagctcggctcatgcgtcgctaaagtgaggttggctctgctcagaggcaggatgtggtgagggtctcacagtggcagggctttttccagcatctgcaaaccccacattttctgtgagcaggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcaatgtgtgtttcttgaacaccagtggttttgatcactttcctgtgtctgttgcacggcaggtctttccctggaatttggtaagtcgggaagagtcaggacccttatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaacgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtg

SEQ ID NO: 12922 - DNA, 13609 bp, Human
gtactgaattaggggaacatggtttctttttggggagatagaaatgtaaaattttggtaatggttgcacatctctgtaaatatactaaaatccattaatttttgcattttattttatttattttatttttgagacggagtttcgctcttgttgcccaggctggagtgcaatggcatgatctcggctcaccacaacctccgcctcccaggttcaagcgattctcctgtctcagcttcccgagtagctggaattacaggtgcatgccaccacacccagctaattttttttttttgagatgaagtcttgctcttgtctcccatgctggagtgtgatggcacgatcttagctcactgcaacctacgcctcccgggttcaagcgattctcctgcctcagcctctaatgtagctgggattacagttgcctgctatcacgcccggctaatttttgtatttttagtaaagacggggtttcaccatgttggccaggctggtctcgaacccctgatctcaggtgatctgccttcctcggccgcccaaagtgctgggattacaagcgtgagccactgagccgggccaatttttgcattttacatagatgaattatatggtatgctaattatatcttaccaaaaattgaaaaaaaggaatagtactatcagccccaatgtgcccatcatcaatattctacatgtttccaatgttattgtatctgtttgcctacagtcgaggccctgatatcctgtttgattttcttgaattgccaaaatttgcatacatgcttacaaaaataatgcctgttgaatttgctagatatgtaaaggtttggagcaaatcaggtgtattaaatttattaatattgtttgaaatgtctaaggcaataattcccaaacttcgttgagggagaaggaaagcttttaaaatcccattgcccaggtggcatcccatactgttactgggaattatgcattgggatggatcctttaaccgaggagattattatagccggagctctgaaccagcaatctcagttcttgtgatagtgagcaaagaactacaaactaacaccaaaatgcaagcttaaagcaaagtttattgaagcacaataatacactctgagggacagcgggcttatttctgcgaagtgaactcagcacttctttacagagctcaaggtgcttttatggggtttgtggggaggagttgaggtttgggctgtatctgagtgacaggatgatgttatttgattgaagtgtatagctatacaatctaaaattaaactgtgcatggtcttacctataatttgttaagaaaagcctcccagggatgggggggcaaaactgtatgtaaattctattataatgatggcatgatgaacttggggtgaacttgaagacaggcttttgtgttgttgggcatgtgccaccttagggaatttccacctgtaccctcctttctctttctccaggatattttggccacagactttatcataaactccatcccttagggtggcattagggtagtcttgggcctgaatttaggtgggccagtggctgtcttagtgacagcctttccgctctcttctgtcatcccctcccaactgctaatgtctaactacctaacaattacccattaaatcagtgtgtctggggttaggagcaggcctcaatatgtttaatcattctccagataatcccaatactgtaaagtttgtgaaacacttgtcagataattcaattatgaaggctgtggaaggtgtttcagtaggatctaattggttaatgttatgacttaattaatttgaatcaaaaaacaaaatgaaaaagctttatatttctaagtcaaataagacataagttggtctaaggttgagataaaatttttaaatgtatgattgaattttgaaaatcataaatatttaaatatctaaagttcagatcagaacattgcgaagctactttccccaatcaacaacaccccttcaggatttaaaaaccaagggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccacccacttttggtgagacctggggtggaggtctctagggtgggaggctcctgagagaggcctacctcgggcctttccccactcttggcaattgttcttttgcctggaaaattaagtatatgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacactgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattctagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtgtgggggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagaggaaagagcagtttggggtaaatcaaggatctgcatttggacatgttaagtttgagattccagtcaggcttccaagtggtgaggccacataggcagttcagtgtaagaattcaggaccaaggctgggcacggtggctcacttctgtaatcccagcactttggtggctgaggcaggtagatcatttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgtgtggagcctcaacatcctgctcccctcctactacacatggttaaggcctgttgctctgtctccaggttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaaggtatggtggaaacacacttctgcccctatactctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccctgtaatcccagcactttgggaggccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgtttttttctgaaaagggtatttccttcctccaacctatagaaggaagtgaaagttccagtcttcctggcaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctggggtatgtgactgatgagagccaggagctgagaaaatctattgggggttgagaggagtgcctgaggaggtaattatggcagtgagatgaggatctgctctttgttagggggtgggctgagggtggcaatcaaaggctttaacttgctttttctgttttagagccctcaccgtctggcaccctagtcattggagtcatcagtggaattgctgtttttgtcgtcatcttgttcattggaattttgttcataatattaaggaagaggcagggttcaagtgagtaggaacaagggggaagtctcttagtacctctgccccagggcacagtgggaagaggggcagaggggatctggcatccatgggaagcatttttctcatttatattctttggggacaccagcagctccctgggagacagaaaataatggttctccccagaatgaaagtctctaattcaacaaacatcttcagagcacctactattttgcaagagctgtttaaggtagtacaggggctttgaggttgagaagtcactgtggctattctcagaacccaaatctggtagggaatgaaattgatagcaagtaaatgtagttaaagaagaccccatgaggtcctaaagcaggcaggaagcaaatgcttagggtgtcaaaggaaagaatgatcacattcagctggggatcaagatagccttctggatcttgaaggagaagctggattccattaggtgaggttgaagatgatgggaggtctacacagacggagcaaccatgccaagtaggagagtataaggcatactgggagattagaaataattactgtaccttaaccctgagtttgcgtagctatcactcaccaattatgcatttctaccccctgaacatctgtggtgtagggaaaagagaatcagaaagaagccagctcatacagagtccaagggtcttttgggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatggtgcctaggtttgtgatgcctctttcctgggtctcttgtctccacaggaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtacattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaatttattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcctccaaagaatcttatgaggtaggtaggagctattgctgctattctgttatgcttatgttgctgttatgaaaccaaggcacagagaggttagttaacttgctgaagaaaatgatgtgctggatttttattctagctattctggaataacaactacacaaccttatgtctgagccaaggaaacatacggtgtggcaacagttaccatgtttttaggaacagcagcactcctaatgtttgctgcagggaaaaaggaatctcagaatttgcctgatccctataatttttttcctaaatattttgaaa

SEQ ID NO: 12923 - DNA, 19008 bp, Human
gcaaggcagcctgtgattgcacagcagtgttcaagtataaggccttgtctggcaccaaagacaggccttagtttatttcccaggtgtgaaagaaattgcagatttaagatcacacagtccttatgttaagtaactgtaacctaaattacatggtatttaagtttgtaaaaatctgctttaacactaattttatttattgtatattcccggtttttaatggagaaagcaaacttctaggtgctaaaaacgtgttctagacttgaataaaaagataggtagactacgtctaacccttcatcttaaaatctttacctggaaaagaccatgagtaaaatacttaagggaatgtggaatttcccaggccacaaagcggcctgcagttgtctaggaagggagagtcctctaggagacacagtgtatgtgctaagtttaatgacgtctcctcttcattctcccccacccagcgcctagtccttactggccttcagttcagtgttcgaaggcttgtcaatttacccagcagttaagagttggcttctcctaaagcaactttcaaacttttctgcatgttacaagccccctacggagattttaagtttcaatcaggcaacacaccatttatggctgactgagcactgggattcaagcaaaatttgatttgatttgaatcttgaataaaccagttgaatagaataagatgtatgaagcaacatctggcgcagtgcttacatctttagttctgtactgccttagtgttgttatcaaaactgacgcatattaggttaaaagactattaccggggcagttggaaacccaggagacacacccttcagtatactacgaaggtgtgcgccacgaaaacagagggggagtccttccttaggcagttactgcccaggttcccactccggtccgctatgtaaatcagagtctcaaaacagctttccctcgattggttaatatttaaaatgacaggacagcctattggctagaagctggtggcgaaattatgacattacggcaaccgttgatcctggcgacgtagacagggacagacagctgggtctgaaacctaagcgagcctgcggtttcttccgggaacgccgagttagcaaaatggccgcttgtctccattttaaatttaagcacaacgaattgaccccaaacccatttttaatggctggcttctttcgggttcaggaccctttgtccctctctaagctgcaacacttgtccccacccctctccagttcctacattctaatacccctccgccgccaaataaaatttggcgtctggccacagctcttttagtgggtatctgggtggctcttaaaagagcctttggggttaggtgttaagacgcttacttggaatgtttacttggagctggtgtacttggtgacggccttggtgccctccgacacggcgtgcttggccagctctccgggaagcagcaggcgcacggccgtctggatctccctggaggtgatggtcgagcgcttgttgtaatgcgccaggcgggaagcctcgcccgcgatgcgctcaaatatgtcgttaacgaaagaattcatgatgcccatggccttggaagagatgccagtgtcgggatggacctgtttcagcaccttgtacacgtacacagagtaactctccttgcggctgcgcttgcgcttcttgccatctttcttctgcgctttggtcactgccttcttggagcccttcttcggggcgggagcagacttggctggctcaggcatcttaaaacaccagaaatgtgtcgaaagtaaagagcggatttctgctacttatagggcttttatgctaatgagggatggagagtacctcttagttaattggaagacaaactgcacagttgtcatccgtgggcagagctatgcaaatgaggtatgaaagtacagcttttctattggctatctgactagcatttgctaccgaccaatcaaaaagtcggatttactccccaggaactacctataaaagcggccatgttttacatatttcttgattttgtttgttttctcgtgagcttaggctgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggtaagttaattttatgccaaccttgagcaaagcgtattactgcttttcggtttttggggagcgctgttactaaaggttggtctgtttgtatgtaatagtaggtcagttacgtactatcatactctaaagaaatattctagttaatgctttgtaagatcgaccatagttagtgcctaacagtttacatgcagggatgcctcgtgatctaaacacttcgttgtgattactttaaaaatgtaaattgaaggcaaaactctaacgtgttggtaaccttgtttggtcctccgactagtcccccgtctatttttttctcaatttaggctgtaggcagcctcactttcctaattctgtgagagttataggttccattcctgctaaagtgcagagtatattacctaaaagttaaccagggagttgaaaggtgtctgtaaaacagactaatgtccctaatgtagaacggtgcctgacatgcaacttactcttgtattttaagaagctcaagcgtctaggttgccattacaggcagaaaaggaaatagagtggggcctgtggccactcaaaaacctttgctttctgctcacccctctaatcctaccactttgggaggccgagggggctgatcacctgaggtcacgacttcgacactaacctggccaacatggtgaaacacctctctactaaataaaaataataaataaaaaaataagttgggcgtggtggcacataccttgtactcccagctactcttgaagctgacgcaggagagtcgcttgagcctgggaggcggaggttgtagtaagccgagatcgtgccactgccctccagcctgggcaacagtgagacacggtcccccaaaaaaacctttgcttctagggatctggtaacagctgccccacccacaagaaatggagatctgggaccatggacaaatttctagagacctattttcctggattctgtgaatctcgccgaggttttcttccggatctcggtttctgcatttttttgtttgtttgcttgcttttttgaaacggagttttgctcctgttgcccaagctggaatgcagtggcgcgatctcggctcactgcatacaaactccgcctcccgggttcagacgactctccggcctcagcctccctagtagatgggattacaagcgcccgccaccagtagaaacggagtttcaccaggttagccgggctggtctcgaactcctgacctcaggtgatccgccagcctctgcctaccaaagtgctgggattacaggcgtgagccaccgcgcccggccggtttctgctttgatcggaattaagtgggcagaaaagtctaggcgggctaagtcttgcctatgcatctgcgcccagctgctcagactggccaaacagacccagtcgtttagtctaacgcttctggaactccactgaagcgttttgcattgtttcgtttggagccttcaaatccgagtgtgtggcaggagataataatcctagcagaagctgtttactgctgacgcgcctcccacttcccagatactgacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttcccccccccagcatttcctgtatgtccgagaatttcgatcctaaggttagaattgccttatgggccttggaatcctttttattcactgaccaaattgcctttgattccagctcccttggcctcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaatttaagttgtaaggccaggaaaacagtacttataacagctgactattctataaccacacctccttaagagattattgtcagaaaaatagaaagagtaaaacatccatacataatgggtaaactttgtccacataccagaatgttactaatggctttctaacctctgaagaatttaagggaaggaggaaaggtaattttccccagggaatctacacgaagaggtaaatcttgacaatgtattaatactgtaaacccagggaaaaaaagccagtacaatttttatttagggtgtggcaaataaaacaaagggacacgtgaaaacatggctcagtaaagagctacaagacttggtgcaactgacttattgtggtgagtgagaaaaggagagagagaaaacttgaatttcaattcttctctctgggctccaataacaagattttgtattcggtctatttagtagtgaatgatacattgtgttaagtttgttaacctagaggctttcatcttaagcagtacttaagatgtagaccccctcttattcaaatactgataatcagcatagaacttggcatacaagagacacttggctgttgggcattgagaaaatgttgaactgaatgaatcaatgactaggcagccaggaagcactttgttgtagagagttggtttattactaaggaagacattaagtattaaatattagactaataggttgctaatagtgttttctctttccaatagaaaatgtcttctgaggctgatctggtgtctcacatctgtaatcccagcacttggggaggctgaggtgggtagatcacctgaggtcaggagtttgagaccagcctggccaacatggcgaaaccccatctctaataaaactacacaaattagtcaggtgtggcggtgttcacctgtaggcgcctgtagtcccagctactcaggagactgaggcagaagaatcacttgaaccccgggaggtggaggttgtagtgagccaagatcgtgccactgcactccagcctgggcgacaaagtgaaactccgtctcaaaaaaaaaccaaccccatctctactaaaaaatacaaaaattagctgggcatgctagtgcacgcctgtagtcccagctactcgggaggctgaggcaagagaatcacttgaatataggagggggaggttgcagtgagagtgagactctcaaaaaaaaacaacaaaacaaaaagtaacaacaaaaaagaaactatattccaaaaatccaaatttcattggcagtttgttctgggagcttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagcaatgaatttcggtagcttcagttggattccaactcttgagcaagttttcatctcccttgcctgaatggccctggggaggactatttaaattggggcgagtggatgaggatgctaaacctagaggtctcccaattaccaaaggcacctgggcaccagggactaaagtttgtctcaggaatttactgagatatgaggctgagataaaatcattttttggtacataaggtatcttgaacaaagcagatcagtttaacacaaaatcaacaatcgtaatttccctttttaaatttccaaatctatgtagcaatatcctttcctttaattcattcatcatctctattcactttttgtattctgtaaatcatttgaacttttataagaattatattttccccttgaggtcacaaaaaagaaagtattagaaattttataaccaatttttaaaaaattatattttaaggttaaatacaaaccttctaaaggtttgtcatctgttgatcctaaattataattataaatttatatattcctgttgaatataatgcatgtgtgttacaagattattagcaatttgagaatttcccgtgcatattggagatgagcaaatggaataagtgctcatgtgtagcgacaggattctctattttatttcaatacttaatattgtaccaaaccaagtaagaggagcatcatgagaaaatgtactaaaggacagtcattacctatatttacacctagaaaagaaaactatattattgataaactgataaatctattttatgtatttattattttgctctgtcatccaggctggagtgtactggtgcgatttccactcattgcaacctcctgctcccaggttcaagcaattctacctcagcctccctagtaactgggactacaggcatgcaccaccacacccagctaatttttatatttatagtagagacagggtttcaccatgttggccagcctggtctcaaactcctgacctcaggtgatatgcccacctcagcctctcaaatgctaggattacaggtatgagccaccgcgcccagtctgataaatctatattaaaaagaataaatataaccattgcatcttcaacagaaattggaatatggcatgtagatttcaaaataaaatgaattctctggcattgaattactgtactcatgttgaagaaatgtcagaacttcattggatgttattatattacagttgtttgtttgagttgtagtttgggcagagtaaaggagccaacatgtcttaggatttagaacttgtgcacattgcctacagttgaaagaagaaagcatgctaaattccagcctctttggtatgtggttgggacgtaaagttttaccacatccttcattgtcttagcctactcaggctgccataacaaaataccagagactggatggcttaaacaacagaatctttttttccatatctaagaggcttggaacagaaattcattttctcacagttttggagcctggaagtttaagatcaaggtgccaacatagtttatggtgagaatctgttcctggctaacagatggctgccatctcactgtgtgtttgtatggtgtttccttggtgcctgcgtggagagagagctctaagtgtctcatcttctgtaaggacaccagccccaatgggattagggccctatcctgtgatctttagttttatgtaccccctaaaggctctatgtccaaatgcagtcacactggggtttagggttttaataaatgaattttgggggacacagtttagtccataacattctgtccttgacctgccaaaatgtatgtccttctcccatacaagataaatttattccatcccagccgggcatggtggctcacacctgtaatcccagcactttgggaagccaaggcaggcggatcagaaggtcaagagatcgagaccgttctggctaacacggtgaaaccccatctctactaaaataaaaaaaaaattagccaggcgtggtggcgggcgcctgtagtcccagctactctggaggctgagacatgagaatggcataaacccgggaggcagagcttgcagtgagccaagatggtgccactgcactccagcctgggcgacagagctagactccgtctcaaaaaaaaaaaaaaaattattccatcccaacagccccctgaaagtcttaactcattctagcatcaattctaaagttcaaagtgtcatctaaaaaatcatctaaatcaggttacgggtgaggctcaatgtgtgattcatccagagacaaaattcctttccagctttgaacgtgtgaaaccagaaatgttacatgcttctaaggtacaatggtgaaacaggcataatagacattcccattagaaaatggagaaataggaaagaaggaaggtgtaatgtgtcctaatcaagtccaaaacctggcaaggcaaattctgttaggtcttaagaaaaaccctctttggcttgatgccctgatttccaggcccagtggtgtctcagtgtcacctctggctctgtagttggcctactccatctgccctgcctgaagtctcggtctttcagtttggtggggtcccacccaggcagccatctgtgagagactcccacacagttctgcagggcatctttgaaacaggtagagtcagccttgactacatgttcccacccccaccctatcccatctgtactctctgagtctgacatcaaagtggcagccctggcggctcctgcctgtaatcccagcactttgggaggccaatgagaatggatcactggaggtcaggagttccaaactagcctggccaacatagtgaaaccccatctctactaaaaatacaaaaattagctgggcaagtggtggcaggagcgctactcgggagggtacagatttagagcctgtaatcccagctacttgggagtctaaggcaagagaatcccttgaacctgggaggtggagattgcagtgagctgagatcacaccattgccctacagcctgggtgacagtgagactgcctcaagaaaaaacaaaaaagagtcagccctagtgatcttgtaagttgcctttggtgggtcagtctttccttttcttaaagaatagtacacattgacagccaggtagctctatgatcctgttctatagaattcaaaaagtcgacaaccttcctttgttcctttctgttttctctgcctacgttagtttaaattggcagtgtctctgctggaataatcccatctctcttcctggcttctgctgagatggctgattaaatccttgggtcacacccattatctctttatcaaatggttgttcaggctaggctcagtgtttcacgcctgtaatcccaacactttgggagactgaggagggcagatcacttgagctcaggagttagagaccagcctaggcaacatgtcaaaaccccatctctataaacaacaacaaaaaattagccagggtgtggtggtgcatacatgtagtcccagctacttaggaggctgaggtgggaggattgcttgagcctgaaggcaaaggttgcactgaactgagattgtgccactgcactccagcctggatgacatagccagaccctgtctcaaaaaacataaaaataaaaataaaaccaagaaaaaaaaagaaaaagaaaacattgttcaaccatacctcttcaagaaaaactttctcaatttttacaatatagattgagaaatctatcccaaatctccaagttctgattgtgttttgcttaaaaattccttctttatttcggctctttcctctcacatttcactttaagcagtaaggaggacctaaatcacaccttcaatactttgcttagacatctcttctggtaaatatccagttttactgcttataagttctttccagtaaacactacagcgtaattcagccaagttcttgacacattgtaacaagaacagtgatttctacagtttccaataacctgtccctcattttcatctgagacctcacaagagttgactttaatgtccatatatatatattttttgtgtgtgtgtggcggggggagtggagtcctgctctgtatcccaggctggagtgcagtggtgtgatcttgggtcactgcaacctccaccccccgggtttaagcgattcttcagcctcagcctcccgagtagctgggaccacagaagcacatcaccatgcccagctaatttttgtatttttagtagagacagggtttcgccatattggccaggctggtctcaaactcccgacctcgtgatctgtgccctcagcctcccaaagtgctgagattacaggcgtgagccaccacgcctggcctaaagtccatattttaaccagcatatttaatattctatccatgatcgttataaatctaagtttctatgaaaatggaagctttctgtccagctctcttcctttctgagcctttgccagaattgcctttaatgtccatatttctttcaatagtcccttcacaattggctttttctagtatgaacctcaaactcttccagcctttacccatcaccaatttccaaagccacttccccatgtttaggtatttgttgttgcagcatcccacgcctgggtaccaaaacttagtcagcttggactgccataacaaaatactacagactggtggcttaaacgatagacatttattttctaacaattctgcaggctggaaatctaagatccaagttgccagcatagtcagtttctggtgaggatctcttcctggcttaaattatttcacagacaccaggcagataaccatatccattctttcctgtattcgttaatagtcagagctaaaagtgtagggctctaaatttacacttcagcaaattgttctgttattaagtattcacctcaaaatgaccagactatactatcctctaaattttagaaacttggagcttggctctggtccctagtctttgttctgtctcattaatggcttcatcaatactacggttccaaagactatctatatgcagtaaacttccaattttacatctccagcctgaccttttttctgaaatgcaaatgtgtgtagccacattttcacttgacatctccatttagaactctaataggtctttcaccctaaacacttccaagacacaggaataaacgtgctccttaagcctgttatcccttccagttctccccagttcaataactgacactaccatttactcaaatcaacattctaagagtgtcacttgctacatttccttcatctctacaaatccaaagtatctgtgagtcacgtcacctacatattcaatacatgcaataattcattctccatactccttaccatgacttaagggcccactcagtgaccatctctggcctctgttcacctcttctgctgttctcctttgctgttccagccacgctggtctcttttcacatcaagcagctaagctctgcccatttaagacatttaacttcttggcctcaatctctgaaatgcctgtttgatttttcttctggtgagctcattttcactcatcaggtcccagctctgtttcagacaaggctatctaaaatagacctacctaaatggattaaaaatctgagaatatgaaataacaaatatcagatgacattttaggagaccctttatatacctcatttgtgtgtgtgtgtgtgtgtgtgtgtgtgtgtgtgtttggaaatggtgatgggagggtgtcattgctaagtgaggaggaaacacaaaagccatctaggaaaggacacagactagataggtccaaaagtggtttaagacagaatatatgtaaagagagttatagaaagagcaataagttgggataaaggatttccaaaacatatacggggttagtaacctcaatttacagggacaaactgcaaaacgttagtaaaaaggcaaacaacataatataaaagatgattaaacggtattttatatcatgtattaaattcatatggccaatacatatgaaaaacaagaaacaaaaaaccttcctagtaattcaaaattatgcatattaatacaacaaagggataccacttttttttttttttttttttttttttttttgagacagagtcttgctcaggtacccaggctggagtgtagtggcatgatctcaactcactgcaacttccaccccctgggttcaagcgattctcctgcctcagcctcccgagtagctgggactacaggcgcctgctaccacgctcagctaacttttgtatttttattagagatggggttttaccatgttggttggccaggatggtctcggactcttgacctcgtgatctgacggcctcagcctcccaaagtgctgtgattacaggcgtgaaccactgcacctggcctaatttttgtattattagtagagatggggtttcaccatattggccaggctggtgtcgaactcctcctgacctcagatgatccacccacttcaggctcccaaagtgctgggattacaggcatgagccactgtgcccagcctgggataccatttcttacctatgaatagacaaccactaaagccagtatactcaggactgcaaaggatgaggaagaattgccattgtcatatagtttttcataacttttcctgacaatgtctattaaattgtattaatagacatttggaaagggagagtgtcaacaatctagaataaaggccccactaggtaaggttacatatgtaaggactctttcaaaactgtcacaagaggtcaggtacggtggctcatgcctgtaatcctagcattttgggaggctgaggcgggtggatcacttgaggtcaggggtttgagacccgcctggccaacatggttaaaacctatctctactaaaaatacaacgattagccatgcatggtggcacatgcctgtaatcccagctactcggtagcctgaggcaggagaatagcttgaacccaagaggcagaggttacagtgagccgagatcgcaccactccagcctgggcaacagagtgagactccatctcaaaacaaaacaaaaaaactactcaaaactgtaataagaaaaaaaaaaacctaattatacatgtaaaacatttaaataactaaaataagaatactgttgacatagtgagacatccatttatactatggaatgttatgcagctacctgaaacaataatccggtgaaacaaaatcacacacacaactgatgagagtaaatagagaaccgtatggaagaaaacataccacagtaattatctcagatagctgaaactaagttggtgcaaaagtaattgtggttcttaccattactttcactggcaaaagctgcaattacttttgtaccaacctaatagaatggggtgaggagaggtaaacctttataaacatctctgtgtgaactgttaaaatgagcaagtatattttttttaaagtataaagagagaaaaaagtaaactttctccatttcccacctcaaattatgttctgtcactcatcctgtttagattctttcaaatgcagtttgaagttttatttatgagattccttgttgtttgcctctttccattaaacctagctccacaaagtagggacctgatgtattcattcactgttatatcccagcatctagcagagggcctgacacttagtgggaacgcaagtatctggtatataaaccagagaatagatatttttttagcccagaaagctgtttcactgcacagagtgtaattatctgaatttctataaaaatgtctatctataaatcattgtcaatacattacctactcaccttacccagctaccaggaacactatgaagttttgaattacaccccatttgttttccacactcttaccattttcccagtttctgcactgacctctccagacatcatgtgtactgataattctaagttgtctagattgttaattcttttaagggcctgttctctgctagctggcatcatgcataaaataattctctttaatatgctctgggtctagggttaatagatgtttgcttaaaatcatggaaagaaaatggtcacacagctggtatgtgtgatcaaatttgtgctgtttcatccacttaatgtttactttgtggtaatggaacctcccagcttttattttccttccttccttccttccttccttccttccttccttccttccttccttccttccttccttacttctttccttccttccttccttccttccttccttccttcctccctccctccctccctccctcccttcctttctttcttcacagagtctagctctgttgcccaggctggaatgcagtggtgcgatctcagctcactgcaacctctgcctcccgggttcaagcgattctcctgcctcagcctcccaagtatctaggattacaggtgcatgctgccacacctggctagtttttgtatttttagtaaagatggagtttcagatgttggccaggctggtctccaacaccaggcctcaagtgatccgcctgccttggcctcccaaattgctgggattaacaggcctcagccactgtgcccgaccccagcttttatattctaatgctgagattattcagttaacactcttacctgctaggataagtttgttggagaattttaccttaccttgtaccctttaccttcacatctacctgtaccctggcccttcacatcctttccatataatatatcttcagtaaatacagggaaaaaaacccagaatgattatgttgacagcaaaacatgtttgtgcagaaacggagtagtcactatctaagccacagagacttaggagtgtattcctgagttatgtatcattttaaccatcactggatcttaaatcccagttgctaaattgaagggagatacatgactctttttagggctttgctctctgatacagtagccattagccacatgtgatattttaaatttaaataattaagtcaaaaattcagtttcctcagtctcaccacatttcaggttgctggtgtctactgtattggatacacagacatagaacatgtctatcatcacagaaaattctattgcattgcactgggataggtactttttgtgcccttgggctgataagttcaagtgcacttaactagcttcctccaagtggaatcagaggataaatttaccatacaaaatacaggatacccaattatatttgaatttcaaacaggcaacaaataattgcttaagtatgcccctcactgcacacccaaatattacatgagacattctatacatatatatatatatatatatatatatatatatatatatatatatatatatttgaaattcagatttaactggacatttggtatttttaatgtgccaaatctagcaaccctatctgaagagcaaaactggagtgtctagtctggataggtccttttacaccacagggagttatttgaggaattgagaagggctgtggtacctgtaaagaactaactcattatgaagaaaaggatctgtaagtttttctgtatgtgtaaggaaggccaagaaggtggtttccagatatatttactttttcttctctctctcttaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaagggagaggaaagcatgtgtcattaattttctgcctaggacacctccctggttaaattgccatttcctttcttccttgcataatgattaggaaacacatcctcctgacctgcctgccctcttttgcctactttttcatctgcagtcaaggtctggttttaagactgactgttacttttacaaatctgtgtgtattggtggctaagggcctgtatggtccactgctgtattcccaggtcccagcatggtgcctgacgctgcctggcaaatagtagtcacccgagaaatggctgatgaattcatgaggcctactctgtatggaaatttcaattctggccccgaattttcaggagctggcaagagagccaccttaatatcataggctgagttggaagaagggaacacccaacttattcttaagaagtactttgcccaggtactgtggcttaggccagtaatcctagcatttggggaagccaagttgggcagatggcttgaacccaggatttcgagatcagcctggacaacatggagaaaccccatctctacaaaatatgtaaaatttaactgcttggtgggcctgcacttctggtcccagctattccagggctagggtgggaggattgtttgatccctggaggtcaaggctgcagtgagccatgatcacagcaatgcgctccagctctgggcaacagagcgagaccctgtctcaaaaaaaacaaaaatgcctatacaataaatctataaaaagtgggttttgtgtgtctatacacacacacacacacacacacacacacacacctgcatagacactcaggtgttctggaaagacacaggaatctgaagccaaaatacttgtgattttttttcagctctgccactcaccaaatgtctgatgggattagttacctgccatctcagaatttctcttctgtaaaataaggtaatagtacctcccagagttatgaaaaactatcaaatgagatggcagatgagaaaacactatattccttgtaaaacctgacaaatatgtgcaagattatataaagactgtcttctgtccattttcaaatgtggaaaagtgaaagcaggacaggatgttgggatttctgtcagagatttgctggcttccacctgcagaaattgaagtaattggggttcttacacctaagtactaactgagtctggttgcagtttgcccccatggctacatgaagcttttagaagagtcagcatggtagacatggaatgttgaatggtggtggagtgtacccacacacctcccaccaagtcagctccaggttcagaagcagcagccccagtggagggcatgcgtgtttgtaactcagctgagccacctttcaagaagcagaggctttccaaacagggatgccccctgcttttggttcaacttgacttcctaccttcagtgaggacatggagaattcatctagactgggtacctgagcaaacttggcagagcaaagagaaatgtggaaggccctaggtagacaggccctgtggaaggaaagaatgaaagaggacagaaagaaactcccattttctttagcacagtcccttcagattaaggatgaagaggctggggttctgaattggttggccttaggtaatggtcacaaaaacaagtcaatggcttttccacatccgtacattgagatatatttctgcccttggtattcattttctctgacctccaattaaagatctatgcgtcattttaaagccttccttcctttctactctgtggtcagcgtaacattggtggtttgaaactggccataatagcagcatttacatcatgggaactagcatatgttacatcagggtttttttgttttgtttctggagagccagtaaacatacatcgtcacaccacttaaatattctctgcttaaatattctctgctccttcctggtaaagatagcctcatctctctctccccactccccaactccatccagcacgtgcacattggatcact

SEQ ID NO: 12924 - DNA, 22301 bp, Human
caaatattaaataatcattagttagctcctgactttttgcttttacaaatattgctttaaggaatgtcctgaaacatattattctgtgtggctgtgcttattagtctctggtacacaccgtgaagcagcaatacaagtgggaggatgcagcttgactccctcaaacaatagctcatttccccacatttttgcctaagcttggtgatcatagttttttaaaatgtttatgaaaactgataggtaagaaataataggatctggttcttttaatatccatgtccttgatagcaaagcgaagcacattttcccatgtttgttcttaatctatattcatatattattccaatagtttcctactttttaccaatttactgtattttatttttttattagcttgaagaagttgagcaaatgctactccatatctgatagaatgctgtaattaatttctccccttctgtaagtgatcttctatggtatctattattataaataagttttgctctttttgtgtcctgcagtatccttaaatatgtttaggtgtaaatttcatttcatttctctagcttgagactcattttgattcctgaatctgagaaatcttgtggtttcatctcttctgaaaaattcctatccgttatttcctaaagtattgccttttctcagttctctttattttgtcctcctagaagtcctattcaacatacattggaccttttcactccattttccaggttcttaactttgctgtcatccctcatcatctcactgagctttattctgtacaatttacatagctcattaccgttgattttgctaattctttcattagctatgtctagtcacttagtttcaaattttaatgcctaattttttttgtatttcaagtagtatctttcttaaatctgcctattctttttggtatctttttatgttctagggtccatattttatttcttcaattatttaaagcatacttacataatgtctttgtcagtttattctatttttggaagttcgcagtagtttaattttgctacacattgagtctgaaaacttgttttggatggatcacttttttgagtgtttataattttttattttgagctcataatatatagagcttcatctgcagtaattctgtgtaatctgttttgagtgaatcagactgggcttgattctttggtcagttttttagctggggatgagttctcagacaatgaagacagtatgaattccaaccctcaattctccataacctagatatgaactttcacaattttcaggtgaagtactttattttcaaaccataactcaggacaaagagggttgtcactgttattgttgaaaggggaagagcctctgtaaccaagttttgaacccctgtgaggcatctgactctatattagaatctcccttataatcgcctccctggcatgggcctaaggcttcatccttcatccccacaggcacttagatctcaggcccccacatcactgaaattgatgcttctgtgacccaatctcatggtcactgaagttagcacagacatctaactcggtggagatatctcttactgtctttgcagctacgtaaaagggtgtttgctatattttatgtaatatgtataggtgtttataatagtttttcaggtaatttaatccactggaatctcctagatgaaatttcaaataaggttgtcaagttttcatgtccatttgatactagtatcaatttagagacatgggaacacagaactagaaaggatattacaatttatgaaggcaatccaggccagatttctcacttgcgagatataaatactaagacccagggtaaactgcgacctttcaaagaccaaccaattggttagtgatagagccaggatgacaagttagttttcataaaccctaatctaccacttttcttatacagcaacatttgctcctagttcttagaaagaattggggtaatatcatataagattctccctgtattttcttttgtattctttttatttcagtaagtaaatgccagtccctaggaagagagaaccaaaatgtctaccggaccagatgtcaaggctacagtgggggacatttccagtgatggcaatttaaacgtggctcaagaggaatgctccaggaaaggtaaaatcatgcacagtaatctggtagtaaataaaactaggatctgtggcactgtaacttgtggtactaaataaaactaggatctgtggcatcttttgttgatacacatcattttccttgctaccaccaattgccaataattctatacggttatacattgttattgataattatttcatttctcataagaaactttgaaggtatataagacaggcaggtatcatgacattatttagagatgaaggaaaaaaatcagaacaggttctaagtaggaaatatagaaaccaaccttggcttgtctgattctaagtccaagacatgtcctattagatctctctgctcatgttaaatccagacctgaccccgaaccccaaaatgggctttttgcttctaccatgtcatagaagtcacctttctccctttctcttatctatattacaacatcatgctttttataatatgcattaagggaaactgtagaacatcttattttaccctaaatgcttaatgagttataactatgttatccattaattcttttaaggatatagtcatttcataagataatgacttcaaaaggcaaaaccctaaccaagatggaatgctttgtaatactcaacattttagccagtttgtctgttaagaattatgcatatcttcaagaaaagagatttctcctaatctcaaccatcacagaagaaatcaggaaatgtgcatgttagtactcaacctacaactagtcaccatttgacccagaatgaatactattccagtagtctcggctgaaggtctcatctgtttctaaggatttcagagtctactagactataccattggccaaattcttttatcctatcattctgtctctcccttaaaattaataatacgaagaacttatgtgtaaaattttaccaaggtgcagtatggcatactgggtaaaagcacgggtcagaaatcagaatgcttgagtttccaatcctgattttgccatttatgagctcattattaccactcacatagtgtcccttcctcagcccacctttgggcagtcattggaaagttcatttataatttgtctaaagtggaacttctatggtctttctggttccttctatagtctcctacaacatctggcctaccatgccacccagtcctctggtgaccactccaggctatagctgtatcagacaacaactttgtaacccactttaccctggcctgttgtttcaaacagcatcatgctactaacactcatcctgttttggtagtctcatcctacctaataaggcagaaccccagctactcctccaagccttaccaagttattttgttgtgtatccaagtatttctcacaaatgcttaggaataaaccttgcagagtgctttgtcagttggtgtccaacatcagttttattctcatccccttctctggctcatgcttactggacatggctggatcttctgtattagactcccagggcactgctggggctttctctgggtaccagtacccccatctccaaaggccactcatatctttgctgtgtttctaagacactcagtgagctgaatccaggggttccatgggatgtggagaaatgccccctcccccattatctggtcacctgcttatgcaaagtaactgttccaataacccagaaaccttgagtgaaaaaagctgggccttcaggttctgcctgaagatcagtagtttttctctatcagtgtcagttagggatttctggggccaggctgtagacagacatcactttgaccttctgatccccttttcccccagaagtccatgagcttctttctgtatcagtcagggttatatcacaaaatcaaaagcaaatctaggtatttctgagaagaaagaagattaatataggggactggaagattccacagacgttggaaggctagggaagcaaaagtcaggttggttactttcagaaaatccaggacatgacactgccaatgatcccagccatgtgcatcacaaagtgggtatttttcaggaggacaccccaaagtcacaggcagaaatcccatgtctaacatgactgatcctcacttatccacctgcagctgcctccagagcatagtggtttctcattgagttcggcctgccaccttgggccagaatgccctcatttgtggaatctgaatggaatcctgaggattgtagcttccagatatttgtccctctgttactgtggagaccagagaagggtgggaaaggcactgagaacaatatcagggacggtatcctttctccatatcaaatgcctgcaggaaagatatactgccccccaccatggggaagaatgccatctgaaggacaatttacaacaacatccccttctgaaagccatggaaatgaataaaacaagcacaacactttgagaaagtacttccaactagattgaaactaaggaattattcctaccacacactacaaactctaaatcttgcagacagatttaatacaatttggaagaaattgagagaggagccaagagctcataaaactcccatccttgaggcagggtgcagtgttataggaagaacaaagaggatgctgtggagcttcagcttgtgctcctcagcttggagtggcagtgtccagaagctgggcagaccacagaccccatgagcccctcaagggtctgcagtgctgggatgtgctgggtgaagcgtgcatgggtccacatcctgcagctttcccctcacgcttcactggcctttctgatctgcaatttagcatcaggggccagtgctacaaagcagaggaaaatatgagtaactgcagaaatcaacttggaaatttggaaggctttctctcaaattatacaatgttattgcagaattaaaatggtacagtagttagcttcccttgaattggtgaaagaattccctacctcctcctccccacccctgccaccagcccacccacatacaccaccacattatagctgggcctcaaaccagcatgggtggccctgtgcaggggtttcaaaatgtgagaacaaagtcacacacaactggcttttatggtccaaggctgtaggggtggactacaaggaacctacgtaaatatgtttgtgcaaaggaaagaataagataaggcatgtgttagataaaaaaagaaattgacaggtacacttatgaaagataacagttcattatatagctgtcacataatgagtgcatgccctgtgttagacactgttctaagcagtctttatgtattaattcattgaattctcacaacaatccttcaggaaaagtgctactagcatcatccccattttgtaggagcctgctcaggcacagagggatgaagtaacacatcttaatcatccaggcacaaagaggtagcagctggatttaaaccagctgttgttagcttttacatcacactgctgtgcttacgttattacggggaaattgaggaatattttcatcttcaatttcttaaagttctcaataatgacaataacaataataataaaatcatagagtgtaggaagtaaatcaacagaagaatatggaagaagtcccaatatagatgagaaaggaaactaaggaggaaaaaaatgtcactgcagagttaaaatggaattagtagcagcaaggagaagatagatttgagaaaaggaagaaaacaaagattgtgtaataaaaaatgaaaactagttaattaaacatccaattcactgagcctacaacttcaaagaaattacatagaaaaatgaaacagacaacttatagaaaataatgtgaactcaaatcatgaaaaaattggattaaaaatacatacaagagctggttctttgataaaaatgatgctactcaaggcaataaaacaatccactactcagattaatcaggcagagagattaaatacaagcaattatgagaaaataggagacagaagcattgaaaatgtataatatgctaattatagggaaagtacataagtaaatgattttctaggaattataatttataattataaaaactttaattacataatcataattaacttattaaaatttaatatttaaaatataattgaattataattttatagaaattattatttctaagaattatacatttttatgtttctaatttataaatatgaataaagaaaaaattatacatgtcaaaaaacaactaagaaatgaagaaaattgtcaaaaagttattccttttaaaacaaacacagaaacaaacaaatatattctagtagtttcactagaaaaattatatgagatttttaaggagaggaaaatgcctatttatcctgtgcagaagagttccaaatagttcatatagcactctaccttctgaagatggagcttagctccttgctccttaagtgtgactggtgcttgtgacttcttccagagtacatttgtacatattaattcatacaaaaaattaaaaggagaaaaagaaaaaagagagtaattttacagtggagcaacctgacaaacactacctcaagccagggcaccaagatcaactcaacagtaagaagtcttgttgacagtgtgtggccttaatatgatgtgatgagaatgagtttacctccatggccttcctctcaaaaacacataatcccagtctaatcatgagaaaaatatcagacaaatttcaattaagggatgccccacaaaacacctgactggtgcgtttcaaaactatcaaggtctttagacattttagactacaaagtatttagaatacattttagaaacaaggtaagtctgagaaagtgtcataccaaagaagagcccaaggagacatgacaactaagtgtaatgtggctccctatatgggattctggaacagaaaaaggacattagttaaaaactaagagatctgaataaactgtggactttagtagttaataatatatcactgcaggtttattaattgcaacaaatgcaccataagatgttaataacaggaaattttgtgtgagatatagaggaactcaacaattctatatatctaaaactgtcctaaaattaaaaatttattaagaaaaatggctatgtacctaaaacatttcagatcacagattgagatggaagcttataacttttaaaaaagaacaaagctagtatagcaaaaaatagcacatacatatgtacataaacaacattttaagctcaactatatatactaaataaaattccagctaaaatgctagcaaaatacatcatgtttttaaattttgtaatagcctattaagaataagaagagatcatcccaataatacgaaggtggtaggctattataattataataaacttacataaacttattcagttgttatcacagtgccttgaggtagactctgttattaatctcatttttcaggcaaaatttgggggccacagagagctcagtaccttgccccagaatacacagctataagtagaccacacaagctggaattggaatgcaggtgtctgattctaggattaaaatacattttataaaacttatgtatccccataaaaatatttaaaagtaggaacagagtagtttaatataattaaaggacatgtcacaccaacaactagcagcatacctagtggtgtaatgtgagaagcagtctcagtaaatgcaaatatagctgaggtgcccattcttaccattcctgctttgtccatttttttgaaaatgctggtgaattaaattacccaggagaatgaaatacgtgttgcaaacggtaaacataatcaactatatttttcattatttgtccataatttgtctttctttattgaatcaaaactcagtgggggaaaagctgatgaatatgataggaaaaagaacagttacacaacaataaaaagtaatttacaaaatttgtgaaggccttaactgaagataactataaaattccacctcggactgagtaaaagaccaatactggtacatgggtaggtatctcttcttgactagaagacaatcctacaaatgtggcaatccttcttaatttaatctgtcatatcaatatgactgatcaaaattccaatgtagattttcatgggtggtgcattggctgggttggggatggggaactaaatgctctcagagttgaaccaaaggtaagagctagaacttagcaagagcattactacacaaaatgaaaccatgctgtccattccaagagcatttgctccctttcaggaaccaagaaaatggcatcttcataccttgtgatcatacattacctctgggatttctctacagggatagtggatgaattcttcccgctgttgtcaaactaatgtatatggactcaaccacagggatatccccagagctcctatggaacactagcaaattttgtgtaagcatagattatagtattaagatgaagtttaaatacttctatgatctaaccatagcctatctttcaagtttcatctctccccagccccagacaagctaatcttccatgtttcctggttataaatggcacttccagctatcccagctgcccaagcagggaacttgggagtcatctccagcagtttcctctctctcactgtccatacccaatcggtcactgctcccagccaattctttctctaaatccacttcttcccattcctattctaatcttctcatcccagagccctgcctaaaaagctctcccctaatgcttgttctgaccaactccacacattcttcaagtctctgagaaatgcttctgagggagccacctcccccattacctcccaggggaacaaaattccactacacacctacagaggaatgtctgctctccctatatttctgcatctcagacagataccaatcttctccttcttccagacttagggagagtgggagaaaagcattctgattgtgatttttcatgcccttttcctctcaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggtaagtttaatgagactctggactctttctttgactcaaataatttgacttaaagagttataaaagagtgagattcatttaaccactaagtatttactgaacatgtactatgtgccaggaatggcacaagtacctaagtatcaggccgagcatggtggctcacacctttagtcccagcactttgggagggtgaggcatctttactaaaaatatgaaaatcagccaggcatggtcataggcacctgtaatcccagctactctggaggctgagacagaagaatctcttgaactggggaggcagaagttgcagtgagcggagatcgtgccactgcactccggtctgggtgacagagtgagattctgtcttaaaaaaaaaaaaaagaaagaaagaaagaaaagaaaggaataaagaacataataagtatctaaggggattgcatccctacttagtgcatatgagtgtaaccagggactaagttagaataaatgaaacattttaccatttagtggacataaattcttcccctacaatgatgaaaatcactacaaaatatgtttcacagatttgtctgctttttcttccttccacgtattttttttttactaccttgcttatgatgctttcttctttatagtctttgtttctttacgaactctcttatattttaatttttggttagttgtgtcagggtgagcggaaagagtatattgggcatatatttagggtttttaaatacatgatactggtatattggaggaactggagaaatgtaaacagaaagataactgccaattaatttttgcctctcaagtcctcacaatgaaaactgtcaatccttcaactaaagacaaacagtaactctctttgtcatctaggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggtaccaagatgttttccaggtataagtggaatataggttccagaatgacctcagatctccaagaatggaatttttccccccaggttatggtattaactggtcagtattcaatttgggtcaaatgggctcccccactggaaaggagtcaactcaccaccattgctggatcaggtaactggtaccctaaacctcactttacatgcactgtccaggagaactcagcaaagtcctgccaacagaaccaagatcttatatatcaatctctgtgtcttcatagtcctttccttaaagcactaccccatactgccttacttgattgtaactgaataaactgaatgcttactatgtgccaaacattcttgtgttttgcacatattttcatcttatcctcaaaataattttataagtcagctatatataattacttccatttcacacatatggaatttcagacacaaacagactaataacttctccaagatcacatagttaccaagtgaaggaacctagatagtttggcttgaaactcataccttcactcactgtgcaactcagcattgtagaaagcacatagagccccaagacgagtcctctcacccagaacatcctcgcctcttctgttcagggtcaatgctggggtccttcattgttctacttgctggtggtctcctctgccagaccataggatggccttacgtcttctatatctttggtgagtgtgcttttcaaatctccaatttttatgacagagacttctgtgatgcaatttatctatggttaaccaaatcctaatagatatggatatttacatagctaaagctggtagtgttcagagccaactacatttaacatttaagtttcagcagcccgagtgtgtagctagaataatcttatgacattagaggcatcataacattccttactgcttctaaatttgacctaaaggaattcagagcaaattatctcataaaatgttgaaaatactatcttaggctaggcgtggtagctcatgcctgtaatcccagcactttgggaggctgaggcaggtggatcacatgagtccaggagtttgaaaccagcctggccaacatggttaaaccccgtctctactaaaattataaaaattagccgagtgtgatggtgcatgcctgtaatcccagctactcgggaggctgaggtgggagaatcacttgaacccaggaggtggagggtgcagtgagccaagatcacactactgcactccagcctgtgtgacagagtgagaccctgtctcaagagaaaaaaaaaaagaaaatgttattttagtcagattacattttagtcatgctttttaatttaatatattctttaaaatttctccagttattattatggcaaaaaccacaattgcttttgcaccaatctaatatcatagctagaaaattgtgtgactgtgacctaatcataggtaaaatactaattagagtagagaatcaactagtggagactgcaggacagggcagattatgtgaggttcagaagtggacataatacacagagagatgctgcagaaaggttccaaagacacttggaaagttccagaggcagtattttactacgttacagttttaccttcatggagctgtggttggaatctgcctagctgctgttacctttagtttgtttaatatttgaaacattctccaaaatcgcacccctaaattgtttatggtaataccttatagtcccactagtgtgttcattagaggacaggcctgttagatcaagggtttctgtaaaatcaggtgaatatattcaccaaaaataaaatatgtaatgattccatagcatatcaacctttaaagtttttatcatgaaaactttgaaagggcaggttacaaaaattattcaaacaacaagaaaatcttactgtgcttatggtttcaagaaacagtaaggagcatatacacaatagaaactcactaaatatttgttgaataaatattaacatcctccaaccccaatgtgcaacattgctaattttcatatctatccctccgcacttgattatgttccttgatggcaaaattgtgtcttcgccattttatattctcaaaatttagcaaaaagcgtggtgtatagtggctgctgtatgatgtttgtgaaggaatttgtaaatgacatgctagccaaacaaagagagctcataagatttcttaagattctaaaaagggaatttgaagatgggccatatttccactcaatactgataatgttaaattcccaactctgtaataatgtatatattagaaaaaatgtctttgctgaggattcatttcatttcatatctacaaattgggtaattaatttcacataatgtactgctgctcactcttatgtgctttgaggaagataagagatagatatggaaaggtttaatgatgaaaggaactctgcaaagcatgactagcaggagggatgctgactggtacgtgaatggtgagggcattttcaagcacgtggggcaaacacgctactaacttgtaagggtgctatagctttaataatagttcatttcaaaacctcccaaaactcaatggtttaaaacaataatcatttattcccatggttctttgtgggacagctgggtggctccactctctgtgtctgtcatctgccttggtcaatggatgagctggagcatagtcttccaatagcagtgggcaagacccaagaggataagtttaaaaaaatcctttttaatgcctaggcttgaaactcctccatgccattggcaaaagcaagttgtatggccaaggccaaagtcaagtggtgaggaagtaccctcccccatgatagggccatgcaagggatagatgccaggaagagtggtgtactgaggccagtcactctgtcaaccacaggaatcatcttagagtcaaactgaaagaagtacttcaatccatccagtgctaactggatccccttttcctaggaggaattggctgtgcttgttgtcctctctggtttcctctcatttatgatgatcctgtgaatcatccctttatcagtgctggtgagaagagatacattgtgtgttcattggctcagcaggtacattgaggaactcctctgacatttctctatgtccctctagacgtctgagagatgaagaatgtgatagagagagctgccttctgacggaggggacattgatgtgtgctttcttccaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatgtaagtacagagaaagctcattctgatcttctgtttaaatgcttaaataatgagagctcatatataatcctctgtctgtcccatagtcacaaaatcgggggattaggaccaggcaggacctccatataggaaatgcaatctagttaatttggattctgattgatctcaatgtggttcactacttactgcaggaggatgatacatatggttctagtttgattttcatacactatcatattttattatactattttcatatatactattcatatttatcatattttaagggccctgtgcaaaaattttatactcaatcccatcaaaatttgcaaacaagatgctctgctggcagcataaataataaagattaaccaaacaaattctgcctttgagaaaattgtgacagagaaacataaacaacatatgctgaaaataagacattaataggacataaagtcccaaataagacttacatagacatttgcggagtaatgtttgttttaaaaaatcatttttattcaagtataacatagagaaagaaaagtgtgtatatgtgtacagctctctgaattttcacaaaatagacagatactctgaatggctgacaggagcctttcaattcctgctggatggatgtcttaaaagtggctatcagatttcataacatgttagtgacagttcacaaagccagtgttattcttgtactctcactctgtactcaggaagaagccttctcgtattgattgggttcctctggtgaaaatgtgctaagtagccaacagagagctgaccttcttagcagtagtcagcatctgcatgcaagcaggctgcaggcactgagattagaaagccccaggaggcagtggctctgggtcttttcaaagaggaagagggccagaaattaaaccagaaccttaatccaggggattgggacaccacataagcaggagtccagtgctaagcaacagacttcctgaggctggctgttgggaatgatttgtctttggtgtgaggctgggtgggcttgaccctcagaggccaaggctgaggaagaggaaaatgggaaaatgaatggaaagacaagtagtgaccagaaagcagagctttccaggctaaaaagtcaagagacctggattctcattgccttcagggcattttctcacaaagtcacataaccttgacagcctcggcttacgcatctgtaaaatgaactacttgaaccaggtgagtgctgaatcctttccattgtttggattatatacaacagaggagtctccttttcattgcattatattcgatagaattttagtttagaagtttaattgataacaacaaggttcaacattttaaaaactatattgaaacatagagtgggtcaggtgtggtggctcatgcctataatcccaacactttgggaggatgaggcaggtggatcatctgaggtcaggtgtttgagaccagcctggccaacatggtgaaccccctgtctctactaaaactacaaaaaattagccaggtgttgtggcatctgcctgtagtcccagctacttaggaggctgaggcatgagaatcgcttgagctggtgaggtggaggtttcagtgagccgagattatgacattgcactccagcctgggcaacaagagctaaactctgtctaaaaaaaaaatagaaagactgaaaaatctttctttcattactgttcctaatctgccctgtcctcccagcccattccaatgataattctttctatgtcttttttctttttctttctttcttttgagacaacgtctcactgtgttgcccaggctggagtgcagtgtttcactcatggctcactaaagcttcgacctcccaggctcaagcaatcctcctacctcagcctcctgagtagctgggaccacaggcgtgtaccaccatgcctggctaattttttgtggagatgaggtcttgttatattggctaggctggtctcgaactcctgagctcaagtgatcctcccactacagcctcccaaagtgctgggattacaggtgtgagccaccatggctggcctaaatttcctatatatattctttctttgtttctttatgagaatgcaagcatacatgaatgtgtattcttattttcccaacttttaaaatacaaaacagtatacttagtaatatgccgctatgcttatatactaggtttttgccaattaatatgtcatggaaatcttcatatcagtacatgagaaccttgctgagcagtatttggattgtttcccatctttgagcaatgctgcagtgaaaaccttgttcatttctcatacctttgtgcaaccctctgtggagtaaatttctgcatatgagattattgagtcaaagggtaaatgcactataaacttttatatttgttgtcaaattgccctcaatagagcaccagtaatatttgtgagaacctgattctccacagtgttagcacagagcatgccaaaaaaaaatgggtgtttttgccaatttgatccatgaaaaataatatctcaccatagttttactttgtatttctttcattatgagtaaagttggataccttttaacatgtttaggagccacttatttttctttttttcttcttttcttttttaaattgtctgttattaccctttgcctatttttgtactgggttttggtcttttaaatatttatttccaggtgatttttatatataaagagagccttgttcttttttttttgcaagcagagctatgaacatatacatactaaaagtatattggctcattatagtaacatggaatttgtattaaaagtgatgcgtatataaagaaaagccacaaatgtggacagtctgtccaaggttgtctgtgtcgtggtgggggtggtaagggcacatgcacctgacctagtctctggtcctcagagtgggatcctgtctgccttgccgtttgttgttggatgtatctgcattatccttggaggtctactggcagactttcttctctccagaaaaatcctcagactcatcaccatcaggaaactcttcactgccattggtaagggagagactggacacaggggtgaacgtgggaagctcagagcagccttcagtttactctgtgtttgtcctcctaccccaggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtagggacctcttttgcctcatcctttcagacactcaattcaagtctagcagccctaaatctactctgatgtgaaagtaaaatgtggcaggtacaacaggttgcaggaaatgtcagcaccagctctacatcctacatctaaataattcctggaagagactcaaagctggtggaccattgtgaacttagtttttctgggcgtgaacaagaggagtcagtggccatgctcagagtcaactgagggagactcacacaaacctctctctgttgaggaatgcagcacttgcctaaggcggaatcactgaaagaattcttgagattctatagggtatgctcatgaaaatctttaatgaaggcaaaggacacaggactgcaggagaaatatctgtctctgatacagtaaaaacagttgactgagacttccaaacatagctcccagggtgctgtcccagtcaacaggacatccttcatcttcagataatgaaccaccaagaaatgtgagagatgcccttgtcacaggggagccgacgtctcatctggtgaggggtcttttatacccacggagggtataaaagttacaagatcagactcaacagcagaagccaaaacaacaacaacaacaacaacaacaacaacaacaaaaaccttacaaaccaggtgcagaccatcaatctgaccatcttgcataaacaatgttgacaagttaatagaggttacccccttgggagtaccagtccctagcacaggattatactaatcattggtcagtacatttcattcaggtttcaccaaggcttacacaattccagtcatctccagaggtaagcacagagttgcagcagaccagctgatattaaccttttgtttgcacaggaatatttgcctccctctcccgggtattgagactttcaaacgtaggtatacttggttataatagagtaccatctctctctctcaggtacactggctttctcaaaggactattgcaagtctttgcacacatagctggagccatctctcctactgctgctggatttttcatcagtcaggtgaggtcaaatgttctgatgaatattcataaaagaaacctatagaggcatggttttttcacatatgcacggccttgtatcctagaagatgcttttaaagtagtcaaaaataaactaatttacatgatgacttaagaattaaagaaacttaagattcttaagtttcctaagaatcttactggtataaactttacatgaataaagaagtatgtggcattcttattttctgccatatacttcatttactggaaaaaaacactgccatataccattcacttactggtgaaaaaccacaggaaagttaaagaatgactttcctgtggtttttcactggtaaatcagaaaaataaatgaagaataacaaagaaagagtattctttatgaaatcaagtcccttctcttttcttgaagcttcagttccctcccaggcactagcatactgtcaggaaatggttgtttaaaatggaaattctcaaactgctcttgtttctcctgtcattcaatgacttattcattcattcattcaataaatattaaacagtagtatgtgctacgtgctatttaagtgaatgaaacacaattccttcccttgtgaaacctatattgtagaaaagaaacagaaagaaatctatggaagtaaaatatatgacatattgaatggtaacaggagaatagcaaatgcttagcaaatgctaagaggagaataaagcacaaggggtggaatttctaactacaatgatcaaggaaggactcaccgtaatcacttgcttaaaaagaacacttaagcaaggactgaaagggagtgaagatgtgagacaaataggtatctggaggaggagcgttccagccaaggaaatgcccagtgctttggactcatggcagaaatgtacttgagtattctaggaccaactgggaagcccatggaagccagagtggaggtcggggagggagcaggaggacacagagccaaagcctttctgaaccaagagggacaggaattgggtgaccgttaataacttgtaattttctgcctccaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggaggctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaagaaagaaagaaaagaaagagagagagagagagagaaagaaagaaacaaagaaagaaagaaagagaggaaagaaaaacaaaagaaagaaagaaagaaaaagaaagggcctgaaagatagaaggaaaatcaagagaatatggtgctaagaaagggaagggaagagagaatgtttccaaaaaaagtgagtagttaccaatgccaaatttgcagtgatctgtccagatgagaagtgagcagaaagtacagaaaggagaccactgctgagaagtttgggtatgaaagggtggtgtctttgtcgcttttgtgttgctataaaggaatgcctgaggctgggtaacttatgaagaaaaagaggtttatttggattgtgattgtgatggctggaaagttcaagattgggcatctgcatctggcgagggcctcaggcaacttctgctcatagtggaaagtgaaggagtgtaggcctgtacagaaagcacatggtgagacaggaagctgggagggggagaggaggtgccaggtttttttaaaacaagcagctcttgtaggaatgatctcactcacccctgaggaagagctttaatgtcactagggattcacccttatgacacaaacacctcctgcaagtggacccaacattgggatcaaatttcaatattagatttggagggaacagacatctaaaccatagcagaaggaaagaggcaagaaagtagctgcaaaagcatatgggctcgaagaaggagttgaaaacaaacatgtttaagattgtgagaaggtgctagctgacagagaaaagtcgcatatgcaaaaaacacaaagcactaatggaaagttcctgagaaggttgtgacaagggaggaattttgtgacttgaagcccagttaggagaatgatgagagatggtgtgaggacagctcctgccttttcacctgacagcccaagatggtgtcttcatctgctagtgcaagatctagggagggtcttatttttatatctttcttcctacttggaagggaggc

SEQ ID NO: 12925 - DNA, 69834 bp, Human; identical to SEQ ID NO: 11959
  misc_feature (1)...(69834): n = A,T,C or G

SEQ ID NO: 12926 - DNA, 26967 bp, Human
gcatcaccgctagaccaaggagccctctggtggccctgtccgggcatgacagaaggctcacattcttgtcttctggtcacttctcactatgtcccctcagctcctatctctgtatggcctggtttttcctaggttatgattgtagagcaaggattattataatattggaataaagagtaattgctacaaactgatgattaatgatattcatatataatcatatctatgatctagatctagcataactcttgttgttttatatattttgttacactggaacagctcgtgccctcggtctcttgcctcggcacctgggtggcttgccgcccacactcgatgttttgttgagctcatccttgtctccctgaagctgtcagcagagtggttgtttaccttttttgggtcatagagcctttgagaatttgttgaagggtcatctcctcagaaaataaaaagttattttgcccataactttcaagggctcatctgttactgattactcatggataccggcttaagaacccttgtgtagatgaaatgtttgtgaagcatgtaaagtttgcttatatttgttttgtaatctatagccagttgccttgcctgtgttttttgttttgttttgttttttgttgagacagggtctccctctgtcgcccaggctggagtggctcaagcgatcctcccacctcagcctcccgagtagctaagactacaggcatatgctaccatgcccagttaatttttgtattttttgtagagacagagtctcactgtgttgcccaggctgtcttgactcctggcctcgagtgactcacctgactcagcctcccaaaatgctgggattccaggcgagagccactgcacacagccatgtgtttgtcttaatggccttgtatcggaactcttggtgacagaggctaatgagcagccactggtgggagagtaggggcggcgctcaccctgccccctgacccaggggtgggctcaccctacaccctgaccccacgcagtgttctgctgcccacttgggtgtctgtgacgccttcgatctcatatgtgttatatgtctcctggtgagcccctggggcagctggagctgcagtggaacttcacctagctcaaacgtgtagggaacgtgtagaagtcctaccagaagcgtctctgtcggtagccacgcttgggcaagaaaaggagatgtcacgggtaccagagtgaaaaagtaacgcagagccggccaagtgaatggagctgcggctgagcaccgcgggctctgagaaccagtgtgggcctctccggtagaagctgggatgttactgtgtgtgccggtagctggcacagtgtcaatggcttgggcctgcacagagctccctgtgtagaccccacaggcctcacgtctgggaccagaaagctctgtccccaagccgaggcgagcagcagagcattccctgctggcccagacccatgtgtggagggaggtgcaggggaaagggaacctgggtctcaggccccattcatgctgcccacggggctggctcccggagctgcggaggccgcctggaagctggaggcaggtgaatcccaggcccacccagaggaccctctgagaggctgctggggtgtcggggaggggccctaatcccaggcccatgcagaggaccctctgagaggctgctggagttcagggaggggccctaatcccagtcccgtccagaggaccctctgagaggctgctggggtgttgggcaggggccctaatcccaggcccatgcagaggaccctctgagaggctgctggggtgttgggcaggggccctaatcccaggcccatgcagaggaccctctgagaggctgctgggctgttgggggaggggccctaggccaggcaggccaggtgataacttggtttgtcaaagcctgacattggccagtcttgagtgtttaaaaaaatgttttttatttctacagtttgaattttatgaatagctgtcttcttacctataggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggtgagcactgttcctgggtcagggtggtgcagggtgagcccacccctgggtcagggtgcagggtgagcgccgttcctgggtcagggtggtacagggtgagcaccattcctgggtgagggtgcagggtgagcccacccctgggtcagggtgcaggatgaacactgttcctggatcaggatggtgcagggtgaacccacccctcagtccatgtgcaggatgagcgtcgtccctgggtcagggtgcatgatgagcaccgcccctgggtcagggtgcagggtgagcgccacctctggtgcagggggcagggtgagcgccacctctggtgcagggtgcagggtgagcgccacctctggtgcagggtgcagggtgagcgccacctctggtgcagggctgtgcggggtgcagggtgagcgccaccccggggtcaggatggtgcagggtgagcactgcccctggtgcagggctgtgtaccgtgcaagatgcagggtgagtgcccgttcctgggtggcctcaatggtaccggcaacgatggcagacagcacttggtctgtgtgtgtgttcagctctgattctcctgactccccccagcagctcctgtgattcaccccactgtgcagatgagtaaatggaggcctatggagaaagctgggcctagaaccctccctcttccccactctgtcccctgcagccatgaggtgggagagtcctgacatgtgcattcctgtggataaaaagggagggactgggccaggcgcggtggctcacacctgtaatcccagcactttgggaggctgaggcaggtggatcacaaggtcaggagatcaagaccaccctggctaacacggtgaaaccccgtctctactaaaaatacaaaaaattagctgggtgtggtggcgggcacctgtaatcccagctactcggggggctgaggcaggagagtggcgtgaacccgggaggtggagcttgcagtgagccgagatatcgtgccactgcattccagcctgggcgtcagagtgagactctgtctcaaaaaaaaaaaaaaaaaaaaaaaaaaaaaagggagggactggtattaaccatgttgaaatgcctttaaggtattatttctttattcagataatatgtaattcagaagtatagattttcagtaaaaatgattttgaatttgaagtctattttaaaaaatacattatgaagcttcagttatttaaacaggttaacaatggcacaaggataattaggcaaattagccgagtggaatagagacttggggacacccatgtttagttcattctgaaggaagcattgtaaatcactgagtaaaacataacccctgctgggcacggtcgctcacacctgtaatcccagccctttgggaggccgaggcgggtggatcacctaaggttgggagttcgagaccagcctggccaacatggagaaaccccatcgctactaaaaatacaaaaattagggcgtggtggtgcgtgccagtaatgcagctactcaggaggctgaggcaggagaattacttgaaccagggaggtggaggttgcggtgagcctagatcacgccattgcactccagcctgggcaacaagagcgaaactccgtccaaaagaaaaagcataacccctagggttgcacataataacaaattccagagggaacatagtgaggtgtatacaatgaacgcataaactactgcggggaatacagtgagatgcagacaatgaacgcataaactactggggggaaaaggtaagtcgctactctccagtacaaacctgaagaagcataaaagggaacacagtgagatgcatacaatgaacgcataaactactggggggaaatgcaagttgctactctccagtacaaacctgaagcagcataaaagggaatacagtgaaatgtatacaatgaacgcataaactactggggggaagtgtaagtcgctactctccagtacaaacctgaagaagcataaaagggcgggcgcaggggctcacacctgtaacgccagcactttgggacgaggcaggtggatggcttgagcctgggagtttgagagcagtctgggcaacatggtgaaatcctgtctctagaaaaaattaaaataatacgaagaagcacaaaaggaaaggaaccataatgggaaatacggataaggtttgttttgttttgttttgagacagagtcttactctgtcacccaggctggaatgcatgtggcacgatcttgtcttactgcagtctcaacctcccaggctgatgtgatcctcccatctcagcttcccaagtagtgaccacaggcaagtgccaccacgcctcgctaatttttgaatctttttgtagaaatggggttttgttattttggccaggctggtcttgaactcctggactcaagcagtctaccagcctcggcctcccaaagtgctgggattacagtcatgagccactgcctagctcaaaacatggataagtttaacacaatatggagatgagttttgttagtttatttcagagggataattatttaacctacccaatttaattccattggcttattgtgttcaattttcgtaaaggtttttttttacagtgctttattaattaccgtcattaaatcactcatgtttgtgcttttgaggttaaaattgcagagttttctcgtactccagaagactttctaaagaaatatgatgaactgaaatctaaaaatacaaggaaccttgacccgctggtgtacctgttgtcaaagctcacggaagacaaagaggtaggtgcccatgccacgtgccacactgcgcccgtacggcccatgttgggagtggggtcgcgtctcctgctcactccacgccatcttcctgtcagctcttcctcgctcacaccagtaacgcttctaggccatgtaggaaatttttggtgaatcagaatgaaagataacccatgttgggtgtaaacatgagaagcagcctctggggcactttgagcttcccgcatgtgtcacgctcagttcctgcctgtcgcacgcgtcgctttgctattaatgggtgcctgtcagggttggggagccgtcctggtggtgtcgtccctactctccccctatggccaaagaggtgctggcccagtgtgaacacacagttttacatgttttcagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcaggtactgcgtccatggctgtccacaggctccatgctgcagcaggtcctgtgtccgtggcgtccacaggcacccacactcagtgctgtgccgggcccctgctggaaggacatgtctctctgtcatttattgaaaatgaatcccttagagaggccaaggcttaatgcttgatcatgacctagctctatatgtttagttttttttttaaccaagaattctggaccacaagaatcaatagcagcaaggttctgacccacgtgggagttgtgctgccaggtggccacgtgactctgagcctacccaatcctgactccccatttccctcctccaatttttgacaattttgagggaatgctttcagatcattatattttcaagattctcgaaaatacagtaatttttattattccttctgtatttgctacttgctcttggttttgattttatgccctaccctggtcttttgacgtaagtcatctcccagtctctctcattagagctgccacgttcctgcctttgtgacctttaaactccctttggagctgtgtccctgaggcgtcctagcctcctgggtgcgtgttgagtgcagcggctcccaaggacccagccggttcttgctgggcacgttctgtgctggacatggtgctaggcctctgtccacgtctccctcagccgtggcagaagactgggtcttactgccacgtgcagagacagtttgcatctgcccgtgtccctgaccagccctgagtgggagtcagtgcttccgaaagctgggccagcccaggccgaccccatcagcctctggcggccactggcgcaggagggcaggctctctgaccacatgtcaggagccatcctgtcacgctggggcccttctccggcagggtaaggatgcatgtctgttgctgaagcctgtcttcacccatcaagtggtgttcagacctagtcactgccagaaagaagcaattcagcttgttcacagggcgccctcctttgaaacagcggctctgtgcctaggtgcaccctctcccgtggttcccactgctggtgctcatgttttcccaggggggcccttgcaggacctgcactcctgagaagaggggctagggctccccatctgccctgttgtccccagcccctcacgttgtggcaggcagggatgtcgaggcgcatttcatttctatgtggttgaccctttgtgggtgttgaattgagtaatcatctttgccgtagatgctagcttctatgcatgtctttagttgagtgtttgcgctaaagtgtatctttctggttttgttttttaaaatgtccttgctagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggtacgtgatgcgttgatttccgggctctgccgataggtacgtgatgcgttgatttccgggctctgccgataggtatgtcatgtgtttatttctggcctctgggcaggacactttgcaggcccagccctcccccgggcctgcctttcctcaggttgtgaggctcaatgctgactggctgccgcctccatattcccatcccaggatggcagcagagaacggctcacccgggtccttgagggttcttctcctgtcccttctgccagagctgtggggcagcctgcagcaggcccctccccagccggcatcctggtgccctggtgcagacctgcaggcatcagaattgtgtgcagcacttatttctgaacagcgattcatgactcccatagattctgttacagcagtattctcagaggcctcttaagtagtgttcgtgtaaacaagatgcgggtgagaccacacagtcatttcaagacgttgttattggggacctgggatgtgttcatctgtcacaattcatgggtacatttttatttttatttatttttagttcttttgagatggaatctcgctctgtcgcccaggctgaagtgcagtggcgtgatctcggcacactgcaacctccacctcccaggttgaagcgattctcctgcctcagcctcccaagtagctgggactgcaggcgccaccacgcctggctaatttttatatttttagtagagacggggttttgccgtgttggccagactggtctcgaactcctgacctctggtgatctgcccaccttggcctcacaaagtgctgggattacaggcatgagccaccacgcctagtcaagtacatttttagattgaaaaatgagatttcacaaactaaggacagagcatacctgcttatcttgccccatccccgttagtccaaactcaagaggcagcatggagcgtggtctgcttccccactactcacggctctgcaatgtgggcaccaaggggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagtctctacaaaaaatgtgaaaattagccgagtgtggtagcgtgcacctgtagtcccagctactcaggaggctgaggtgggaggatcacttgagcctgagaggtcgaggctgcagtgagctgtgatcgtgccactgcactccagcctgggcaacagagcgagaccctgtttcaaaaaaaaaaaaacaaagcagtctgctttgtgcagtgttttcagtaataatccaactgtgaaaacccaactgtgaagacttagggagagagagctgctcccttagcgggtactcagcaggcagccggggagtggtgggcacctgagagctcctgatggtacccaggcagacttcggagaaggaagcgcggggccctgctgcctgggatcccagcagtggagccggctttttggagcaggaggcactgagggggtgttcaggctttccccccatgtttccccattcagggaaggggttgtacaaaagaggaacgcactgtccagtaacgctgcggcgccgtgggcagctctgagcgtggcggtgattggcagcaagtgtgtgagacttggctgtgaaccctgcagccagctctcaggtcagggtgcaggtgccctcagcacactcagcatcccaggaaaggggcggcctcgccccacctccctcccacggccacataccacaggtcccaggggtgcctccggtattgaggctgccttgcctccctttgtccgcactgtccctgtccccttgtgccacctgtgcagacttgagaatggagctcactgtggtgttcatgccggggcctgtctagctcctcaccccacgatttgaccagtgccacaccacgggaccttgtgtgacctcgggcctgcgtcctctggaaaacagctgtggagtggtgtgatgaggacaggtgccttggaaagcatcaggaccttgtgagcacgaggcagctgccagcactccacgttcccgccatgctctcctcaccgtgtgggcatccacctggccagcgccgcctccgcagtgcccctccctctggtcgctcccgcgcagcatgcgaaggtgttatctgcccgcgtcctgccttttccccacaccggcacggaggagccacgtgttcggtggtcgttcggacgtggtgatttgcaggtgacatcgcaggtgttgagatgacactgaggatgttgaatattggggaggtgaagcaactgactctttttttgcttgagacagggtctcacttcgttgcctaggctggagtgcagtggcacaatctcagctcactgcagcctcgacctcccaagctcaggtgattctcccacctcagcctcccgagtagctgggactgcaggtgtgcaccatcacacgcagctaatttctgtattttcagtagagacggggattcgccgtgttgcccaggctggtcttgaactcctggagtcaagcgatctgtccaccttggcctcctaaagtgatgggattacaggtgtgagccaccatacccggcctaaagcaacccttgaggtccctccacagccaggcggctggatccacactaacccccaccccacggcacccccaccccaccgtgaggcttctccccacaagggcattggccgaggcttcgtggctgtggatgaatgaggccaacatggtggaaagtaagtgatgcagagtcagaggcagttcctggaagatgcactcgctgttcccaaaacgccaagccacacccactcctttagggatggtagacattggggtctcggttttattggtcatcctgagaaggccactggagtaatagaaagaaatggaatttgaagttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcaccactgccctccagactgggtgacagagtgagatttgtctcaaaaataaaaaaaggaaaaaaaaaaaacaaggacagtgtggatctgcatcaggattgaggctttcgctgaagggcttgcgttggtgacggattgtagtcttgaggcctgcagtcacaggacacttcccagcagatgtgtgaggctgacagagtgattttgtaaaccgaaagcctgttgtacggagccttcctgagctgccagggcctggtttgggtatggtctggctggcacggggccctgtcaggccctcgtggggacagtttcaacatcctgctttcgtctggtgctcctcccggccccccaggcatggcccgcctgaggctgtggactgagaacttggtcctgggacctgaggggtttggtgggtggcggcccgtggccgtcctcgtgaggaagcttagctgtgtgtcctgcagccgtctcatcctctctggatagaaattatcaagagtttcttaacgtttaagtgatagctttttaaagacaaggttttttgtcccagagtaactcagacttaccaagttgtacttaccaatgttgaaagtgcagcttctgctggagtcgccttttcaactcctaacttcaccttttcaaatgtcagccatgtatctgagcattgcggagccgagtgtggtgagatcttgacaccagccaccacgcctcccaggccggccccgtcctgcggcggttggaactcagcctgtggctccccagtggggtcagtcaaagccaagtgcagtggctgaccttttatacccataaacaaagatgagcaagagtgagactgacccgcagatgagggcacgtggctgtgggggcatgggagtgggggctgcagagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggtgggcaccgggcgcggtccctgggagcctgcgctgttgtgggggaggggttaggtcccatcctgatgaccatggggacgtctgcatcgcttctaaagagagcgcccgccttggtgacaactccgtgcccaactcagttttggagggtctgtgagtcaccatccagggtcctgactcatctcctcctggggcaaaagttcccctctgggatgtggggttcaagtgagtcatttgcttcctgtttgggatgagactcagaatatcggacattgtatgtgcctgcagcttgcctttttgaggaagtctgacagcttttcttccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcggtgcgtgcccgcccggggggcatggggcagtggtgggtggcaggtgttgaacatggcacccagtgtgaggagagactctgcaggggccgtggagcagctgcccagggcaggggcgtgtggccaaagctcatgttgctccatgtgctattaacttgcaagaggaaagccctggaagctcttactggtcagctgaaatcagcaactacaaccttacagttaatacgtatcccaaagaagcagcaccgtcccaggaagaaggttggagaagcatgaggggccccagcagtgttgttggcagaggctgggcgtgcgcttccttctcagcagtgagccctcctttctccccacagccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacaggtagggctccctgggacacgggggacacggagggacatgggggacacggagggcgcgtgctgccctctcccgtacaggtagggctccccgggacacggggacacagagggacacggagggacatgggggacacggacggtgcgtgctgccctctcccgtacaggtagggctccccgggacacggggacacagagggacacggagggacatgggggacacggacggtgcgtgctgccctctcccgtacaggtagggctccccgggacacagggacacggagggacatgggggacacggacggtgcgtgctgccctctcccgtacaggtagggctccccgggacacagggacacggagggacatgggggacacggagtgtgcatgctgccctctcccatacaggtagggctccccgggacacggggacacagagggacacggagggacatgggggacacggacggtgcgtgctgccctctcccgtacaggtagggctccccgggacacagggacacggagggacatgggggacacggagtgtgcatgctgccctctcccatacaggtagggctccctgggacacagggacacggagggacatgggggacacggagggacatgggggacacggagggacatgggggacacggagtgtgcatgctgccctctcccatacaggtagggctccccgggacacagggacacggagggacacggagggacatgggggacacggagggcgcgtgctgccctctcccgtacaggtagggctccctgggacacagggacacggagggacatgggggacacggagggacatgggggacacggagtgtgcatgctgccctctcccatacaggtagggctccccgggacacagggacacggagggacatgggggacacggagggacatgggggacacggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcaatatatttaaatgcataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgagcatcattttgttgcctgggctcatcatggaaggaaatgctaaattccaaaaagaggtgggtgcagataaagacaaatcagtttcccacctatctctgcggaccgtacattctccctgagcccaggttaaatactccgttccagagcgaggtttgtaggtttgttggttttcttttttttttttttctttttttttttgaggcagagtctcgctccattgccaggctggagtgcagtggcatgatctcggctcgctgcaacccccacctcccaggttcaagcgattcccctgccttaacctcccaagtagctgggactacaggtgcacaccaccacgcccagctgattttttgtattttagtagagacggggtttcactgtgttggccaggatggtcttgatctcttgacttcgtgatctgcccacctcagcctcccaaagtgctggggttacaggcgtgagccactgtgcccggcccctaggttcgttttagccgagaagtgttggggttacaggcgtgagccaccgtgcccggcccctaggttcgttttagcccacagttgagaagtaactggtagattaggctcggcccttgtggaacgttacttggaagtgtgctggcctctgttaatgtccctgcgcgctgccggcctggagaagtgtcgcctgcctcaggcgcccttgctttgcctgtgaccgaagcgctccctgtggttttagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggtgcggcgcagcgggcagggacttggcgtccgcggcgcagcgggcggggacttggggtgcgcagcacagctctgcctggagagtctcctgcagcccaggccctcccaccgggagcctgtgcctcaccctgtggttgccctgagccctggtgtccgtgaatgcggggctgaggtcaggactggcccgtgggctgggctgcggcgctgagttaggccttgagatggtctctgttgccaggttccctcaggtttccatctccgggactctgtccctgaccctgcgaggctctctcacaggtgccttctctatttctgtttctgatttctaaaactccgctagcatgtcaggaaaaaccagcaaagacacacgcctggcggccggcagtgtttcctatctctgaccacacaggttagggcctgacctggacccagggcagtggcgcggggacttggactcggcacatcggggccgtcacgaaagggttgggaagcgattagccatccggttctcataatgcctgttcgaaattatttctgtgcccttggttagaaaattccagatgtgcagagccacggcaaagccctgccaccaccagctcagtctgtagccgctgacagtgatttaccgggaaggagcaagggtgtggagccgcctcatgcagcccagtttccattccactgccttctgtgtagacaaagacagctggggcctcagactgaccgtgtggagagcccattcaatgtccattccactgcctcctgtgtagacaaagacagctggggcctgagatcgaccatgtggagaataaaattttgaatttctgtgttttcaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtgattccgtgccctgtccctgtgcgggcactcacctccctctgaaaccggaacctgtgggacgtggggctgagatcgctgggtttcttctggcagctccgccttgtctttttgaaagtgggcactgctggatggtctctagctcaaggacctggcactcacagtgggtggtgtaggcccccggtcaccttgtccaggggccccagctcccctccttgcccagggcccaccagccccttctcagctcctcctgccacagcttgcgtggtggttgcacagcccctgcctgagagccaagcgcttagcctgttgtagtgtgttttagggtgatggctatggcgagcatctgtgggtgggcacgtgctcacgcctgctccctggccatggcgggcacctgcgggtgggcacgtgctcacgcctgctccctggctgtggcgggcacctgcgggtgggcacgtgctcacgcctgctccctggctgtggcgggcacctgcgggtgggcacctgctcacgcctgctccctggcgcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaaggtgggtgggggtgccgggggctgtcccctgtggcagaggcctcggaggggctgggaggagagcacagcagaggccagccctgtcccccactccccgtcccggtgaggcgaccgcagggtctgtttccttcacttggctaccggggccggcttgccgggatcgggggtctttgtgcctgtgctctggaggggcgcgggtctcgggttttcctgcagtgccctcgtccgggcctggctttcaggtcatgctggcctcgtggaattgttttcacgtgtccctccatctgtcttttgaaagggtttcaggtcttttgaaagggtttcaggagtggtgttaattctttttgtttttgcctttttgttgtcgttgttttttgtttttttttttgagacggagttttgctcttgtcacccaggctggagtgcagtggcatgatctcggctcactgcagcctccacctcctgggttcaagtgatgctcctacctcagcctcccgagtagctgggattacaggtgcgcgccaccacgcccagctaatttttgtatttttagtagagatggggtttcaccatgtttcccaggctggtcttgaactcttgacctcaggtgatccacccaccttggcctcccaaagtgctgggattacaggcatgagccaccgtgcccagccgttttttaaaatatatatatgttttatctgttttttactatttttaatagagacgggggtctgtgttgcccaggctggttgaacccctgggctcaagcgatccttcacctgcgcctccccaggagggtgttgattctttggctgtttggcagggtttgcctgggagctcttgggccctgggtttgtctttgttggagacttttgagggggacttggccccttgctggccacaggtctgctcagtccctttcctcttggtcggctgtctgtctcgcatcttgtctggtgcacagttcatgggtttctagtatctgctttttatttctgtaagattagtagttatatcccttctttttctgattttagtaatttgaatcttctttcgtcttagctgatgtagctagaaatttgtcgatttcattatcttttcaaagaaccaactcttgggtttgttgactgtatttttctgttttctctcttctgtcatctttgttactcctgtctgctgcttaggggttcagtgtggtcttcttttttctagtttcttaatttgaaaagttagtttacagctgtaaacatccctccgagtgcagccttcgctgatcccctagcgtcatcatttctgtttgtctggaggtgtttctgattccctctgatttcttgttggagccgtgggtggtttatgtttaacttccacatgtttgtgaagtttctggttttccttctgttgcttgtttctaactttatctccttgttagagaacagactttttgtgatttcagttttgtgaaatgtattgatttgtgtagtggccccacatccatcctggagagtgttccgtgcgcgcgggaggaggatgtgccctcggttccgtgcgcgcgggaggaggacgcgccctcggtgctgttggggtggtgttctgcaggtgggttgaggccgtgtctttcctcactgatcgtctgtctggcggttctctccgtggttagaagtagggcaccgagtctccctgtcactgaagaactgcttttctccttgtcattctgtctattcttgattcagatattttggggtctcttgttaggagcaggaatattttcgtaggaaaaattcctggtagtgaaattgttgggtcacaatacatggcccttgtatgactaggctgaccttgctggagttgatggagtccagtctcaggacgctgctgtctgcacacctgcgaaagctcccaccttggctatttgatggacaagtgatgtcaggggctcatttctgcgtttgtgatggtcacgatttcgtctgtccgctgcttgtttcttcttgctttatcccctgcccttcatttcctgtcctgtcgttgtgcgatggttttgtaggaactctgttgcgggtggttggaacttagcaaatacttgagtgattaacgtgaggacggtattacttgcttataataactattatgtccctcgtcaaatatgcttcatttttcaacctgggcctggtgcttatcatggtacaaaggttttcgtcctaaggaatcacgtttctttcaccgtccttagcggtttttcccttataccacccacagcagcagtgggtatttacaaagtaattcatctgaatttttgttgttttgttctgatgggaagtggttcagttttgaatttgatttatcagtagatgtttgggtttttgaaaagcctctgatatttagaatcggaatgtagggaaccttacgtcagcgctgggtctgtgagcgaggatggcgatcgggatgcgacttcgggtcttttccttaaaactggatgctttgtttcatttccttccctccaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggtgcgggtcggctgctcgggcacctgccagatcttcactcaggtttggcagaagcgagaactgtgccacgcggtggccacctcgtcccacagaggacccaaggcggctctccccagccttcagtgtccgggagattcacgggctgtccgggggccacggtgcggactgtggagtacagacgccgtgtccacgacgccgccggtcacggaggcccacctgaggtgccgccacgtctcttgcaggaaagccctcactcgctaccagatgctcttcaggcacatgttctattgcaagcacgtggagcggcagctctgcagcgtctggatcagcaacaaaaccgccaagcagcactcgctgcactccgcccagtggtgcgttcttcctctgcccccgcatgccctcctgaagcagcgctcgctgcactctgcccagtggtgcagcgccccccttgtgccctcctggtagacagctttctaggcttctggaagtgtcatctggaagcgcacgttggtggctttagatccataatgcttcattgcttcattttcctgtcttggggctgcacggcgctgccgtccaccccacaggggatgctggctctgtccctcagccctttctggagccttgtggtgactgcacgggcatggagactgcccaggtcggtgtgcaggacactagctcctcccgagagcggacagccacatcttgctgggaccagaggtgctttgcagccggtctgtgcctctagggtgttgaaaaaaggggtcgatggcagagcttcataagaatttgtccagtcgggtgcagtggctcatgcctgtaatctcagcactttgggaagctgaggagggaggattgtttgagcccacaagttcgagacccgcctggacaatgtaacaagagctcatctcttaaaaaaaaagaaaattattttaattagccgggaatgcctgtagttccagcaactcaggaggctgaggtgggagggttgcttgagtccaggaggtcaaggctgcagtgagccaagatcgtgccactgcactgcagtctgagcgacagcaagaccctgtctctcgaagaaaaaaagaaattagaagaaaaagaactcatcttgatgatgaagcacaaatatgcatctgttgtgtggcactttcctggcgtgggctccgaggggtccgtccaccaaggagcccgcgtcccagtctccaccgtccagctggctgggggtgtccctgcagggcacaggttggtagacggtgacagcttgtgctgggcagacgcaggagcagcggccgtgagtgtctggtgtgctgggaggggcgcttgctctgcagaggaaatagccacgtccagagaacgtcctccatggctgtcctccgtcctccgtgtcacttggtgggcgctgtcggggccgcgtcctccatggctgtcctccgtcctccgtgtcactcaggtttgctggggctttcactctgcggcagcgaatgctcaacttcgtccagaatattcaatactacatgatgttcgaagtgatggaaccgacctggcacatcctggagaaaaacctgaaatccgtgagttttagctccacagataataacgtttgaaagccactttcctttcacagggagacaggaagtgcaggagaggcagggcgaggggagaggcagggagtgcaggagaggcagggaatgcagggagacgcagggagtgcaggagaggcagggcgaggggcgaggcagggcgtgcgggagaggcagggagtgcagggagacacggagtgcaggagaggcagggcaaggggagaggaagggatcccccagggcggggctgcacccacattgctggccacacacgggaccccttgctgcctgccgtcctagggggactctgagccgtctttgccccgaggttgtctctcccacattgcgcatctgaggctgaggggcctgaaggcagaatctgttggtaccaaattccagaagctgccgcagcctcccttcctgtcttctgccttaagaaatgaaaccccttcggggtgtgcccatcatttttttagtggtgtttggaagttttcccctaaaagcccaaggcccatttaagaggtagaagtgcgtaaacaggaatgcacaaagccagaactgagcacgtgcgcacgcagggcccgtctgtcagccacgtctttctgagaaggggcttggcctgttccccgcaggcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcaggtgcgtgggtgtgggtagcaccatcgggtgggcaggcgcgggtgggcagaccatgtcccgaccgtggccgcacgcagcctgctcacgttttcctgcccttgtgttcgtggaggagccgctgggatctgagtgtttccagaactcctggtcttcctggccgggtgattccctcctggagcccctgccctggcagcgtgggcagggctgtgttcctcccgaaccatccctcagcctctgtggtgctggtctctgtccggggcctttgcttatggcccttgcatgctcttttcctcagcacttgagctatttgattccgttaaggacctgcaggcactagtcacaagcagctgccgactggcgatggtgcagaacctgcgtgtctagtggcagaagcaggggtctgagaatgaggctctccaggcagtgccatggggagggtccggaggagggcgagtggggaggtggaggagggcatggccacttcagggtcccaaatagggaaacaccaaaataactgttctcaggaaaatcagctggtcaccgtggaaggtagacctgggaattctgtcggcacagataagtcatttcccctgcagcctcagagatgcttgtgtacccccagccgcaggctacaacagaggtgcggagggtgacgtgcctgcaggacttgttttttctgcaaagcattgtggttgtaactaacagaagcatttccttgcgactctccccccctagaaatttacacagagcatgaaattagatggcgagctgggcgggcagacgctggagcacagcaccgtcctggggctgcccgcaggggccgaggagcgggcccggaaggagctcgccaggaaggtgcgtggcctccaggtttggccagagagagacgcttcctcccggctgggcggcagcctgggcatcctgacgcagggagaacaaacctccccccttttacttccatctcccctcagattgaagaaaagacttaaaattagcttccaagcacaagcacaagagcctctcacaatcttctcagctctctggtccccacttcagccagtcgggctcgagggaacccccacagatcttcagagcgagcgctgtgcagggcgcctgggcgagggcaggggccacacccgctgtccctgctgagctcggtcctgagttagaaccatcaggctctcagcaggcacggacaggctgcatgtcctcggaggcatggccctgcggcgccggctccggggtggcatggtggggtgggcagtcccgtgttcacacgctggagctggagctggcagagaggagttgggtttggaagcgtgggggccggaggtgagggacactgagaggcgccccgacctccttgctgagaaagctgctgggaaagctcgttcatctcaccccaaaggagagtgaccacctcatcccacgaggcctggagtgtttctctgagtgctgggttctcaggaatgttttttgatgtcttttttaccttgaatctcctgaaaacatcatggaacccatgttttctatttaagaaaaggggaagggaaaggacaccggcctgctgggaacagtgtggagccaagaaggcccacggtgggggtgggcatggctcacgcaccccggctttctttccagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggtgggtgggcgccaccccggctcagcccttcctcagctcagtccagcgcctgcccctgcccagcaccgccctggctcagcccttcctcagctcagtccagcacctgcccctgcccaacaccgccctggcccagtgctgtcccggctcagccttcccccagctcagcccagcgcctgcccctgcccagcactgccctggcccagtgctgccccggctcagccttcccccagctcagcccagcacctgcccctgcccagcaccgccctggctcagcccttcctcagctcagtccagcacctgcccctgcccagcaccgccctggcccagtgctgtcccggctcagccttcccccagctcagcccagcgcctgcccctgcccagcaccgccctggcccagtgctgccccggctcagccttcccccagctcagcccagcgcctgccccggctcagcccttcctcagctcagcccagcatctgccccagcccagcgccaccccagctcagcacctgtccctgcatccaggccccatctcccctgcaccctcccctggtccacctggtgtagcctccttcagaaggtggggcaggtctgtgtcctggtgctagtgctggtcatatgccactccctgaagtcaggctagcccagctctccctggggtgtgacattctgtgcaactgggctgccccattggcaccctgcggctgtgtgtgtcctgtggggctgatcaggcctgggtcagcttccctcatgctgcactaacacctagcctgggggaaagggccaggtggccaagctgccagcctggaaggggtggtgcccttgggggtgctgtccttgggaaggtgcctatttgtgcttttggaccaccctgtgccctgtgccccccacaaatgttctgattttctgagcagggatttctgaggccaccctgcattgagaaccactgcttggttctccaagcccctgacacctcaggccccattgctaggccctgttggggtgatgggagccccaactttctggggccaggagagaagaaacctgtgtttgtgcctttgagcaggactgaacaggactgaaaaccttcctgtggaaacattaattaggagcgtgcctcaccctcacccctgcagggcctcttatggtctctgtagctgaacacttccccatggtaggagcagggctgctcaggacggacccgcagaaggagtgtgtgccccagctccactgtccttcctcacccctgctgcccagcacgcacccgcagaaggggtgtgcaccctagctgcaccgtccttccacacccctgctgcccagcatgcacccgcagaaggggtgtgcaccccagctccactgtccttcctcacaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaagttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggtgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaagctgtcagtctcagtgttgtgcaaatgccggaccggtgagcagaggagcctgctagctttcctgcctggccccgaggcccagaaacccctgatcttgtgtcctggggtctgggaagccctgggccttgagaagtggggtttgcaggtggtgacaggaggaggggagggaagcctccagggctgtggggttcaggctcccagaccccccggcacctgctgaagaggagagctgtgttctgtgggattgggtggaacttcctcagcgcgggaggagcctgttctggcccaagctggtcctgtctttttaggaataaatccctggtagctcagcgtcggcaggggccttgctgtgcctctgatgtggccagcgtgccgcctttgcactttgctgttgagtaacttgcaccatgaggtcaaggaagggaagtgtgattgccagctggccattgttctataataacagggtcacctgcatgagctcaggcacaggccagtatccccagccctacctgggagcctctcggcagcctgggggacctcgtcctgtgccacacaggcaagcggacacacccccaggcagcagaagtcacctgcggcccagtgccagcccttgctttcttgcttttcatgccattcacattagggtaagaatggctttgagacaaaatgtgacagcatcactcacgccagcttagatcctccgggttccctgtcctcccaggataacgtccgaggccgcggcctcttcttgccactgccccttgacctctgtcctctgcccctaggcccgtgcagttccctgactcgccctgccctggtgccctctctccaggcaggactccctccagccccttgctggccctgccctgcctctccccagggaggccctgagggcccccccccccatgtgatctgtcagcagcgccctgtgtggtcatc

SEQ ID NO: 12927 - DNA, 10445 bp, Human; identical to SEQ ID NO: 12311

SEQ ID NO: 12928 - DNA, 194537 bp, Human
  misc_feature (1)...(194537): n = A,T,C or G
tagaagtttcgggccgggcgtggtggctcacgcctgtaatcttggcactttgggaggccgaggcagatggatcacccgaggccaggagttcgagaccagcctggccaacatggtgaaaccccgtctctacaaaaaatacaaaaattagccaggcatggtggtgtgtacctgtatccccagctactggggagtactgaggcaggagaatcacttgagtcctggtaggtggaggttgcagtgagctgannnnnnnnnnnnnnnnnnnntaggtggaaggttgcagtgagctgagattgagctgttgcactccagtctgggtgacagggcaagactccgtctcaaaaaaaaagaaaaaaaaaaaggttagaactttcaaaaaggtaccccaatatcttactctgcttgcttcttggaatcagccaccagtgttatcagcctctaatattgaagaaatacatagagatctgtagataagcatttgtaactttagcaacgtatactaataaagacaaagtggagtttttcaaagttggtgaatgcttaataatgttaatttttttttttttgagacggagtcttgctctgtcgcccaggctggagtgcagtggcgcgatcttggctcactgcaagctccgcctcccgggttcacgccattctcctgcctcagcctcccgagtagctgggactacaggcgcctgccaccacgcccggctaatattttgtatttttagtagaggcggggtttcactgtgttagccaggatggtctcgatctcctgacctcatgatccgcccgcctctgcctcccaaagtgctgggattacaggcgtgagccactgcgcctggcctttttttttttttttttctgagatgaagtcttgctctgtcacctggactggagtgcagtggcatgatcttggctcactgcaaccttggcctcctgggttcaagcatttatttcttctgcctcagcctcccgagtagctgggattacaggcatgtgttactatgcccagctaatttttgtatttttagtagagacagggtttcaccatgttggccaggctggtcttgaactcctgacctcaggtgatccccccacctcggcctcccggagtgctgagttacaagcgtgagccactacacccgaccagtaatgataaattctagaaagcaagggacactaagtcactgagatgctttagtggttattcacactttactttttaaatgaactgttttcagttaaaaaaaaagatgattggttgtgtttgtattttaagttatagctagtgtatttttttaatgagatactccattcctattgaaagcgggtgtattttaacaccatgtgactaatgctacacttgtgaataatctcattttttgaattgaaaatataaatgtttaagttttataatttgccactttgaagttctaatgttactcatttgctcatgttgaacagggattttattttatttttttgcctatccaaatattaattaatacctaaagcaccatgggaatattgaattatagagttggacaggatagtcttatttattgttgcatagcacattgcaccagaatttaaggacttaagacaacaaacattatcttacagtttctgtgggttagaaatctgggtgcagcttagctgggtgcctgtggctcataaaagaggtggtagtcaagctgtcagttggggttgcagtcacatctggaagctctactggtggaagatctgtttctgaactcattcatgtggctcttgcagggttcagtttcctggggctcttggactgaagaaatcaattgttgctggctgttggccagaggcttttctcagttctttgccatatgggcctctccaaagggcaccacagtttggcatctgcctccctctgagcaaatgagtgagagaaggtgacacctaagaatttttataacctaatcttggaagtggtatctcattatttctgctatattctatttgttagaggctgcctaccacaaggactttagcttactttttaaagattgaagaaaaaaaagaagacagaaaaagaagaactcaaagatacacaaagtaatttgaaccaaggctcagaaggtaatctgaagaactttgactaaaactcaaattcaccaatatccaggccgtgtgctctttatacagcatcccgttctcataggaaatgtgacagtaattagaaaataaataaaaattgatgcagatgctgaggacactattgtaagaaaaatattaaagttttcaaagtcattttgaatggactctagtttgtcatcttgaaaaaatggtagccaaatatgggtgtgtgtttgtgtatgtatgtgtgtacttacaaaacgtttgcttccaggggaaagttcaatattaaaatttagcagcataacagtttctatacaggtgattagatataggccttttgctgtgtatcacaattgtgttgttgctttagataatttttaggggagaggtctgtatataatttatattttatataaactttttttcattacaagatcccatgatttatttatttgtaatttggactttcctgcccttcattggcatctgttttcaaattaaaattttttttttttttttttttgagatggagtctcgctctgtcgcctaggctggagtgcaatggcgcaatctcggctcactgcaacctctgcctcctgggttcaagcaattctcctgcctcagcctcctgagtagctgagattacaggcacgcgccaccatgcctggctaatttttgtatttttggtagaggcagggttttcaccatgttggccaggctggtcccgaactcctgaactcaaatgatccacccaccttggcctcccaaaatgctgggattaccacgcccagcctgaaattttaatatacatactatttttatactgatgataacagacaaaatgacagagaaaaagaaactattcagcaagataattgtactatatgctcttttccataccatctaagagaatacttgtggtgttgcatcttctttaggattaatttatcgtatagaagatgggaacaaagctgtttaaaacaggactgcaaaaagggaagtatacattaaatattaacctgaaactctcagatttatttttaacagcttcacttttgttgggattgtcttagaagtctagaagcagaaggagctttgttcagatctgtactgtccagtatggtggctactagtgacgtagttattcaagtgaacatgaaagaaaattaaatattattttcttgattgctctagccacatttcaagtgctcagtagccacatgtggctaatgacttccagattggacagtgcaagtacagaacatttttatcatcatagaaagttctatggagatctggataaattacattttatatttgattttgatcaagggcatgtgtttaaaataccagtcattgaggttatcagctaagttgaactttatttcttcattttcgttttccagtttttggagccgtgagggatacagcagtttggtcaatattgtcttaacatgcttcaaataaatcaggtgagtttgtgttaaggcatttttcatgcttacatggtgctttggctgtaaattgtggaacattttaactcagcttttcttttctataactgtaacctgactcatcactttttaaagcagttacctactgtatagtcatcattggaggctgtgtagggcaggttgtttaaggattagaatgatcttctgaaagttgataacttctggttgtgcaaggcagaaggtttgtctgttcttcttgatgtcacatccctttaggacttgttaatgtgttcagaatgcttatgatcatgatacagcttcagtaggtggcagttctgcagactcaaagcatttttagtgacaaatcttgtgaagtagttgtatctgttttttttttttttttaaagttcactttccagggcactgaaaaacactagaaggaagtgccctgataaactacagcatttaatactttagactcactgaaagaagtgcttttcttagttcttgacgtttctccaagaactttatacatttaattttacctttcccgatcaaatagaacattgtatcataactatagtgttagaaaatacttttggccaggctgggtggctcaaacctgtagtcccagcactttctgaggtgaggtgggaggatctcttgagcccaggagtttgagccagactgggtaacgtagtaagaccctgtctcttaaaaacaaaaaaaaaaaaaaggaaagaaacaaaatacttttatttcttttgattgcaaatcaacagagaagtaattaaactttttttcttttcccctgtgattaagaaagtaatcgactgggcacggtggctcacacctgtaatcccagcactttgggaggccaaggcgggcagatcacctgaggtcgggagtccgagaccagcctggccaacatggggaaaccccgtctctactaaaaaatacaaaattagccaggcatggtggtgcgtgcctgtaatcccagctactcgggaggctgaggcaggagaatcacttgaacccgggaggcggaggttgcggtgagccaagatcgtgccattgcactccaccctgggcaaaaagagtgagactgtctcaaaaaaaaaacaaaagtaatcttggccaggcgtggtcgctcacgcctgtaatcccagcactttgggagacgaaggcaggtagatcacctgagatcaggagatcaagaccagcatggccaacatggtgaaaccccatctttactaaaaatacaaaaaaatcagccagtcatggtggtgcacacctgtagtcccagctacttgggaggctgaggcagaagagttgcttgaacccagcagacggaggttgcagtgagctgagatcacaccactgcactccagcctgggctacagagcgagatgcgttccaaaaaaagaaagtaatcttgaccccctgccttccgacatatagtcctgctcaccttgccaaagaaatttccagttcctgtgcatcccatgccatctctaagctaatgacttctaagtttatacctggtctagaccttttttttctgagctccaaactcatgtagcatttaccaccttgatctcttggatgtctttatacatcttagacttaatgtgtgccctagaaataatctcagtgcttcagttttactggaccgtttcagttcctagattgggtaaggttgttctggctacagggatttgcacagatttcctctgctggacctctcttccccacccctgggtttggcttgcttgactgcagtcctgctatatgctgttatagcaccttgctctttagtttaataacatgacatttgtagttatagtcaaatatgtaattatttgttgtaacatctgtctcccttgttagacagtttgtttcatgaagacagtgacttttcttgtttactcttatatttccaggtcctagaataaacaatgtaaatagttttcatacatttatttgttgggtgtatgaatatatgaatggtgctagagttgtcactaaagcaaggagatatttatttttcaacaataaccacgtaattatgttgtcagttttggtgttatatgctgcttgtgttacacaaatgcaactaactctccctcatgtaaagttattatttagttttctcctgtactagaaacttccctagtgcaacaaaaattactttaatcaaaaacattactaataatttaaagaaatcgtagtgctgtcctgtgcttagtgcttcctgtttcctcacagctgctctcaaatcccagtggaagcattatgagaccttatttgcaaactgttatagctgtgaagttgccactaaataactttctatggatacctgccattaattatttggttacaattaaaataatttttcatcttctgccacagacatttggaaatgaccattttatgctagccaacttcattgaaaattatagtttatggattagtcctaatgaggatttactgactggctatgttgcaggtcatgttgaatcaggcattgcaaacagttcctaggcaattctctacatggccacaagcaattccctggatgttggctagaaatcgtacacagtgcctggagatatacatacttaaattgtacaggttgagtattccttatccaaaatgcttggcactggaagtgttttggatttcagatttttttagattttggaattttgcctacaggttgagcatccctaatccaaaaatcgaaaatccaaaatgctccaatgagcatttcctttgagcattatgttggtacaaaagaagtttgaaatcttggagattttggatttcagatttttggatttaggatgctcaatcttaacagaagtgtattcctagaacaatttaagagacccccccttcttgttactgactataactgtcatcccccaaactgttcaagtctgagatgaagactctcttcagctaaacatagagttgaattcttaaattcatgagtgatttttgaatcttactttctgggcaaccactttctcataacagtgagggttctcaaggtaaatgtgtaaaggggcccagtgtggtggcccatgcctgtaatcccagcactttgggaggctgaagcaggaggattgcttgagcccaggattttgagaccagcttgggcaacatagtaggaccctgtctctacaaaaaataaaaaaagttagatatggtgacacatgcctgtagtctcagctacttgggaggctggggtggaggatctcttgagcctgggaggttgaggctgcagtgaactgtgatcataccactgcactccagcctgggtaacagaatgagaccctaggcatgcaaaggggatttaagttgattctcagcttgaaagagttgagatttttactacgtgattttcaacgttgtctctaggattagtactacatttttatttgggaaggcttttgttttcttaaaatacctgaattagatgcttttttattttttattttttgagatggagtctcactctgttgcccatgctggagtgcagtggcatgatcttggctcactgcatcctccgccttccgaattcaagcaattcttctgtttcagcctcctgagtagctgggatcacaagcgcatgccaccacgcccggctaatttttgtattcttagtagagatggagtttcaccatgttggtcaggctggtctcgaacttctgacctcgtggtctgcctgccttggcctttcaaagtgctgggattacaggcgtgagccaccgtgcccggcctacatggttttttattcataacagattcttccatatgtgttactaaaactaattaaaaactaggctattgaatatcaggttatttgatattaactttgcctaactttattattatcatagaacatggatgttccatgttctgttaagataatagcacttttctgcctttaaattgtgatcatagttgttgtttttgccttttaagaatgtgtgttattatccatgtgcaacttatgcttactgtagaaaattaggtgtgataagcaaaaaaaaaaaaaaaacaaaccctgaaaaacaaacaaaaaaaatcacaaaaaattccacttctattacagagataatcactggtaacattttggggtgtatacttctagattttttttctatgcaggtatgtttttatgtgaatatatgttactttttaaaaactgggattatacaatatgtaatgttttgaagtgatttaataataattcttagtttggatgtactaaaatttaaccaagcccttattgttggacagatttttatattgtagttagtgccatagtaaattttttaaatgtatatctctttgtccaattattttcttagaattaattattagaaatggaaatactagtcaaagatgtatgtggattttaaagatatttggtgtatagctcccaaaaagacaaaattatatctgccagaagtgtatctacctgtttccttacttccttgacaaaatttcagtctttgcttatctgtctgacaaaaggtggtattttattttgtgtttctataatatttaaatattttttgttctttcgtgttttgccttttgtggattgcttatatgtgtctactgtcatctatttctttttatttgtaaataacattctttggattatgccctctgataattttctgagttagtatttataatcattactttatacttttcagtcattattcaacagataaccaacgggagtatactggtttctggggtaccataatatttaccagtatggtatattttggccctttctccctgatcattaattataggtcccccgggaaaaggaactcattttagcagtaagctacagcaaatataaattacgaagatacatgctgtgaataatatttttaaatgagtagctgaagtagggccaagttttggagattagctggtgaggtaggcttgacaggtcagtgtgtcctaaggaattggaaaagtctatattaggcggttgtagtattgggagagcctagcaactgggaatttacagggatcaaaataatctggtgattctttttagtgaggtttgatagtagatattgggaacatggtagctaagaggaagctttaaggcctaactgaagtggaagagatgacaggcaggacaagacagaatttttccgtgtcgaaggagtagcagaaccgtgtagggcaagagggagccaggtgttattaaaaaaaaaaaaaaagtttttattacactggatagtgtaagaccagagtatgactaccaagaaacaaagtctagagtgtaaggaataatgacagctatctcagaggtttgttgtgaggagtaattgagataacaaaggcaaaatgcttagcattggtgctggtactactgctattaattttactattaatattgctgttggctattgctgcctgactggaaattggtgggaaaggagggcagacggcagacatttaggtagatcattgagtgaagtatttgggggaatgaaccactttctcaagcccagattggcttcaaggtcctcctgcttcttgccacaagcaccaggaactctattcttttctcttaaaagttgctgctacttagtagtagttacttttctttccaagactgggtgtggagctctgtaatctgctcatgtctcttgtagccatagaatatagcctacagttaggggataagaaaaatagtaaacataaggaggttaaaaatgtgtaagaaagacttctactttcccctatgctggtataatgggaactggatttattttatatgtagccagcttccaagatggcccccaatgatcccggcatcccgatatttacaccatggtgtaatccccatacacactgtattgaggtttatctgtggaaccaatagaatgtaacagaagtgatggatcatttcttaggataggttatttataatacaaatgtggctccgcctccttcccctcactacccccaaccttggattactcactctgagaatagttagctgccatgttgtgaatggcccgatggggaggcccatgctgtgggaaactgaggcctcctgccaacagccaacaaggaactgaggcctctctagccaacagcatgtgaacgagccttcttggaagcagatgtctcagctttagtcaagcttccagtcctaaacatctgtcctgctgacatcttgactgcaacctcatgagagatcctgagccagaactacccatctaagctgttccctgattgccaaccctcagaaactgtgtgaaaaaaagaaatgcttgttttgtttgtttttaaattttttttagctttttttgagttgaagtcttggtctgtcacccaggctagagtgcagtggtacgatctcagctcactgcaacctctgtctcccaggttcaggtgattctcctgcctcagcctcctgagtagctgggactacagacgtgcaccaccgcacctggctaattttttgtatttttagtagagatggggtttcatcatgttgggcaggctggtctcaaattcctgacctcaggtgatcctcctgccttggcctcccaaagtgctggaattacaggcgtgagtcaccgtgcctggccaatgcttgatttttaaagccacaaaattggaggtaatttgttatgtagcaaaaatctactcttcctctttaaataacttgagaatttataaaatatataaacaatagcttttagacattgatgacaggcagcaccagactgtgatccctgagagaataggaacaagtgaaggtaaagcccttcaattgtaacagcttactgcagagcctagaggcagtttattggctgcagtgcaaggtgtggaggaaccaaaacagagcccagcagtcctactgagataaaaagacaaagataaaaatttgggaagatcaaggcgattagaattacagggcagagtaccagagaaaaaagagctaagggggttgggattggcgttggggaggcataaactaaaaagcaagagagcatgaacaagtgagcatgcattttggagatctccagagggttctcctggagtcttttgctgagttctgatttcgtagatgcttgacaggccctacctgaggccagagaagaaaacacttggaaagcactaagaaaaacaatttccagagttcacaataaggcttcaaatagtcgtgttcctactatgcagagtaaagtatgttgtagaatacatggggcactgggaagagtcctcagaaggctccaaatgattccaagtaacttaactgcaccagaacactatttagaggaatacaacaaaattcagaacccaacaatgtaaaatttagtttttgtcattcagtcaaaaaatgcttgctttgacgttagcaatggatagaacatctagacagaatatcagtaagggactagaggacctcaacaacagtattaatcaactagacctaacagacatatacagaacattcagcaacagcaaaatatgtattcttttttttttgtcttttttttttttttttttttgaaagacgtagtcttgctctgttacccagcccagagtgcaatgtctccatcttggctcaccgcaacctctgcctccggggttcaagtgattctcctgcctcagcctcctgagtagctaggattacaggtgtccaccaccacacccagctaatttttgtatttttagtagagacggggttttgccatgttggccagactggtctcagactcctgacctcaggtgatccaccctcctcggcctcccaaagtgcagggattataggcgtgagccactgcaccctgccaaaatatatattcttttaaagtatacatgaaacattctccaggctgtattaggccacaaaacaagtttcagtaaatttaaaaagattgaaatcatgctatgtatcttctccagtcacagtggaatgaagttagtaatcattaacagaaggaatactggaaaatttacaaatatatggaaatttacaaatatgtgggaattagagaatacttagaaataaattaaaatggaaacaatatatgtgacttaaatgatgcagtgaaaacagtcctgagagggaaattattagcaataaacatctacattaaagaataagaaaggcctcaaataaataatcttactttacattttaaagaaactagaaaatgcaaagctaccagaaaaaaggaagtaaataaagattagagtggagataaatgaaatagagaataggaaaataatatagagaattagtgaaaccaaaagtttgattctttgaaaagatcaatgaaattgacaaaccttttgctagactgacaaagaaaaaacacagataggtataactaaaactagacgtgagtgtggggacattactactgaccttaaacaaaaaggattaaagagaatactgtgagcaattttatgcacagattagataacctacatgaaatggacacagttttagaaatacgcattactaaaactgactcagaagaaacagaaaatataacagacttacaagtgaacagattgaattagttaaaaaacctcccaaactaagattacttgagcctgggaggttgagactgcagtgatccatgattatgccattgcactccaacctgggtgatagagtgagaccctatctcaaaacaaaacaaaaactcccaatcagaagtccagtaccatattgcttctctggtggattctaccaaatatttaaagaagaataccaaatatttaaatatttaaagagtatgagaatcgctctcaaactcttccaaaaaattggagaggagagagtaagaatacttcctaactcactctttgaggccagtattattaccctgataccaaagccaaacaaagacgtaatgcgaaaattacagaccaatattccttattaataaagatgcaaaaatcttcaacaaaatactagcaaactgaatctagcagcatatttaaaggaatatgcaccatggccaagtgggacttattcccaggattgcaagggtggtgtagtacaacacattaatagaatgaagcggggaaaacccccacgtgattgtttcaattgatacagtaggcagttgacaaaattcaacagctgttcttgatagaaaggctcaaaatcaggaatagtagggaactttttttttaaacatttcctcaacattcagcgtttatgaaaaaacccacagctaacatccaactcaatagtaaaagactgaaatccttgcccttatgatcaggaacaaggcacggatacccattctcaccagttattcaagttgtagtggaagttatagccagagcagtgtgacaagaaaaagaaacaaagacatacagatttggaaggaagaaataaaactgtctctgtttgcagatgacatggtcctatatatagaaaatcccaaagaatccagaaaaacctccactaaagctaataaataacttgagcaaagttgtaggtacaaggtaacacacaaaaagcatttgtgtttctgtgtactcggaatgaacaatacaaaaagaaattttaaaagattgcatttataatagcatccaaaagcctaaaggagttgacttgcttatgaaagacttgtgcactgtaaactataaaacatgttgaaataaagaagacctaaataagtggaaagacattttgtgttcatgaattggaagactttacattgccgttaggatggcaatactgtccaaagcaatctccagattcaatgcaatctctatcaaaattccattggcctttttttttttttttttgcaaaagttggaaagctgatcctcatattcatatggaattgcaacagatccaaatagccaaaaccatcttgaaaaaggaagaataaagccagaggactcatatttcccaattaagaaacttactgcaaagctacaatgatcaaaatagtgtggtactggcataaggatagatgtatagactaatagaattgagagtccagaattaatatatatgtaggcaattgatttttaacaaacatgccaggatgattcagtggggaaagaataatctcttcaaatggtttggggacccctggagatgcacatgcaaaacaataaagttggacccctacttcatgccatgtataaaaattaactcataatggaccaatggccaaaatacaagaacgaaaacttacaactcaacagcaaaaaaaagctcaactaaaaaatgggcaaaggacttggaatagacagttactctgagaagataaacacatcattaatactcaacatcattagtgatcagggagatgcaaatgaaaaccacagtaagataccacttctcacctactaggatggccagaatcaaaagacgggcagtaactggttttgaggacgatgtggagaaactggaaccctcgtatgttgctggtgggaatgttaaatggttcagcctctgtggaaaaaagagtttgacaattcctcaaaggaacacatagacttgtcatatgacccagcaattccactcctaggtatataccctgaagaattgaaagcaggtactcaaacaaatatatgaccacacatgttcatagcagcactatttgcaatagctaaatggtggaaacaacccaaatgtccatcagtggatgaatgagtaaacaaattgcagtagtctgtattccataaattgtctagcagtaaagaaatgaagtacagatacatgctacgatgcagatgaacctagaaaacatattaagtgaaagaagacacacacaaatggtcacatattgtatgattccatttatgtgaaatatccacaataggtaatctatgagacagaatgtagattgttgcttgccagggcctgggattaagggtgaatgagaagcaactgcctaatgggtgttgaattcccttttggggtcataacagtgttttggaactaggtataggtggtagttgtacaacactgtgagtggactaaataccactggaatattcagtttattttttatttatttatttttttgagatgtagtctccctctgtcgctcagtctggagtgcagtggtgtgatctcagctcactgcaacctctgcctcccgggttcaagggattctcctgcctcagcctcctcagtagctgggattacaggcacctgccgccacgcccagctaaattttgtatttttagtagagacggggtttcaccatgttggccaggctggtcttgaactcctgacctcaagtgatccacctgcctcggcctcccaaagtgctgggattacaggagtgagccaccgtgcccagccgaacgttcactttgaatggattaattagatattatgtcaattctacctcaataaaatattaaaatgcttacaaagaagaatgaaaatatgacccatagccaggatttaaacattttctgaaaagaaagagacccagaaatgataaagatggtttagcagacaaagatatagaaacagttcttactaatatgctctaaatgttcaagacacgaggggaaaacagaaagatgatgtggaaatacatagaaaatataaaaatagagatgaagaatgcagtatctgaaataaaatatatattggatgggattaatagcagataagacacacatcagtgggcttgaatagataacaatagtgactatccaaaatgaagcacagggtggaaggactaaagaaaaaaacagcatcagtgagctgtgggaaatatcgagtggcctaagacgtgtaattagaatcctaggagaagggaggggcaacagaaaatattataagaaataatgacttttatttattttttatttcaacagtttttgggaaacaggtggtgtttggttacatgaataagttctttagtggtgatttctgagactttggtgcacccatcacccaagcagtgtacactgtactcaatgtgtagtcttttatacctcataccactttcaccctttccccaagtccccaaagtccattgtatcattcttacacctttacatcctcacaaatttagctcccacttatgagtgagaatatatgacgtttggttttccattccagagttatttcagttagaataagtctccagttccatccaggttgctgcgaatgacattaagaaataatgactttaaacctctgttctctgtttagtagaaactataaacctgtagatgatggtaagaagtcaacctaaagtagaagaaatattaaaaaaaaaaaaaacctaaccacgcacatcataatcaaatagctgaaaattggtggtattgaaataaaaattttgttgttgttgttgttgagacaggtcttgagacaggtttcccaggctggagtgcagtggcacgatgatggctcactgcagcctcgacctcccaggctgaagcagtcctcccacctcagcctctcaagtagctgggattacaggcatgcaccactatatccggctaatttttatatattttgttgagaaggtgttttgccatgttgctcaggttggtctcccaactcctggactcaagtgattcacctgcctcggcctcccaaagggctgggattacaggcatgagccactatgctcagttaatttttttatttttagtagagatggggttttgccatgttggccaggctggtcttgaactcctgacctccagtgatccgcccaccttggcctcccaaagtgttgggattacaggtgtgagccaccatgcctggcccatttttaacttttaaaaagataattgactaaaacaaaaatactaacagtgccttgagggcttatacatagaaattaattgatgtcagtagcataaagaaagggataagggaaagggaagtatagaatttttaggtgctgatatcaaacatgaagtggaatgatatttgaaggtaggctgtgtatgttttagaacaattcctatacgacaaaataaaaatagtaagcctatgtaggatataaaatgggtactaaaaataatcagtctaaaagaagataaagttgaagaaaggaacaaataaaaggacaaaaacataacaaaacagtagatataaatctagtaatattgacaactatactaaatgtaaatgacttaaatgctcaatttaaatggcaaagattgtcagattgtatagaagagcaagactcaagtacagatgctccttgacttatgatggtgttaggtcctgataaacccattgtaagatgaaaatattgaaagtcaaaaatgtatttcatacacataattaactgggcatggtggctcatgcctgtatcccagcactttgggaggccaaggctggcagataatttgaacctaggagttcaagaccagcctggacaacatggtgaaaacccatctctacaaaaaatacaaaaattagctggatgtggtggtgtgcacctgtagtcctagctacttgggaggctgaagtgtgagggttgcttgagcccaggaggtcaaggctgcagtgagttatagtcttcattgcattctagtctgggtgacagagtgggaccttgactcagaaaaaaaaaaaatatatatatatatatatacacacacacacacacacacacacaacctactgaacatcatagcttagcctagcctaccttaaatgtgctcagaacacttaagttagactacagttgggcaaaatcatctaaatacaccctattttataataaagtgttaaatatctcattataatttattgaatgtgatactgaaagtgaaaaatagaatgcttatataggtacttcagtatggtttctactgagtgcatatcactttgtcactatggtaaagttgaatcataaggtgaaccatcgtaagtcagggacggtatatttatgatgtttacaagaaactcaaatagatacagatagattaaataagaaggacggatgcggacttttgcctctggtccatgtggtgtaacaaggatcgtgtttactgtcctcttgaaacaatcctacccctcttctccaaaaaaacaaaatatgtagaaacaacaatgattaagacattcaggtcttaatctcaagaatcaagtgattcttgagagagaagaaacaaacaaggtgagtcctacaattgccccaggcctactgcactgagagattttccaggatgtgacatagagagtagaaactgagatgtggagtctggcagactctgagttgagaagatgttgctgctctggagcgaactagtaaattataaaaacaagacttgaaaggaacaaactatttccaaattactcaactgtatgcctggacaaagtccaaaaagatttataggagtcatatagcaaggtaaaattaacaaggtatgtcattcagttaaagattaccatgtatgcaaagaagcatgaaatatgacccataattatgagaatcttccgtcaaaattgacacagaactgacacagatgatagaattagcagagggcattaaaacattataactgtattccatgtattcaaaaagttagagatacagaagagacaaaaagacccatatcagacttacagtgatgaaaactacaactgagatgaaaaatatacggtatgagattaatggtaaattagacattgcagaaaaaattatgaatgaacttgaaggcagagcaatagaaaccatccagaatgaagcatagagaaagaagaaaaaaaagtcagtgagctgtgggacacactcaagcagccaaatagatgaataattgtagttctcaagggacataatatacagaagaatatattttaagaaataatggccaaaaatgttttagacttaagccataaatctacagataaagaagttgaatgagttttaagtataagaaacataaaactacaccaaggtatagcaggtcctcaaataatgtttctttcaacatcattttgtcataatgttgatgagagaaaaagaattgattcctggctggggccagtattggtgtgatgttttcatgttcttcccatgtctgcatgggttttctttgggacttcagtttcctcccacattagggagatgtgagcattaggttaattggcttctctagattgttccagtatgagttagtctgttgtgtgtgtgtgtgtatgtgtgtgtgtgtgtgtgggtgtgtgggcacgcacgcactctagtgtggaatagcattctgtctaaggctggtttctgccttgtgccctgagcggctaggatacgctctgaccacctgtgaccctgaactagaaaaattgggtgaataattatcttacttgtttttattaatctttcttaagtgtatgtgtagctcacattcatttcattgtttaatattagaagtgttttggtattagaagttcggtgatgtttttgtaactagaaatacactgtaggaacttaacacttgtttatgtcgattggaccatggtaaattgggttctgttctactttgtttcacttgaagttgcagcttccaaggacctattgatgatgttaagtgaggacttactgtacattataatcaaattgttgaaagcaaatgataaagagaaaatctgaaaagcagtcagagaaagagatatggtcattttgtgtgtagaggaagaaagataaagatgattatcttaatagatttatcagaaacgatataagcaagcaaactggggaagcatctttaaagtactgaaagatgaaaaatgtcaatctataattctgtatctgacaaaaatatgtttctaaaataaagatgagataaagatgtttacaacacagaagcagaaagaatttattgctaacatttcccctctggaagaaaatttaaaagcaattcttcagacagcaggaaaatgataccagatgcaaatatggagttacatgaaagaaagaacactagaaatggtaactacttgggtaaatacatgagattttttttcttatcagttaaatctccttaaaagataagtgactgcttaaagcaaaaatattaacaagctgttgtggggtttataacttatctaaaagtaaaatgcatgataacaatagctaaaaggcagggagggagaaatggaggtatactgttataagattcttttgctctgtgtgaggtgataatatcactggaagatagactgtggtaagttaaaaatgtatactgtaaactctagcccctaaaatagcaaaatagagagttacaactaataagccaataaaaaggagataaaatggagtcacacaaaataattcaacagaagtccaaaaagaagaaaaaaggaacaaacaccaaatgggaaaaatataaaataaatagcaagatgatagaatcaaacctaaccatatgaatagtcacactaaatgtaaattgtctaaacactccagtttaaaggctgaatttgtcagattggatataaaagcaagatccaactatatgcttgcctacaagaaatagtttgtaaacaaacaggttaaaagtgaaagaatgggaaaagatataatatggtaacctagtcaaaagcaacttggagtggctatattaatattaaagtatatttgagagcaaggaatatttccagggataaagaaggtcatttcatttataatggtaaagaggtcagttaagaggacataatgatgttacatgtttatgcacctaataacagagcttcaaaacacatgaaacaaaacctgatagaaatgcaaggagaaattgagaaatccagtcataattggagattttagtaacccctgtcaataattgatagaagtggacagaaaatcatcaaagatatagtagacttgagtaactgttaagcaacttgacctaattgcatttatagaacactctacctaaaaagagtagaatacgtatttgttcacaagtttatccaaaacatttgcaacgataaactgtattttgggccataaagtacttttttttttttttttttttttttttttggaggtggggttttgctttgttcacgctgtagtgaagtggtaccaccatggctgactgcagccttgacctcctgggctcaaacaatcctcccatttctgctccccgagtatctaggactataaatgtgtgccgccacacccagctaatattctttttttttttttttttttgtagtgttgggatcttactgtgttgcccaggttggtctagaactcctgggttcaggtgatcctcctgcctctgcctcccaaactcctaggattgcatgcgtgagccatggtgcctggccatgaaacaagtcttaaatgaattcaaaaggattcaagtcattaaaaaattgtatctgattacagtggaattaggaatcattaacagaaagattcttgggaaatctctaaatatttggaaattaaaaaatataagtaatctatggtttaaaaagaaggaaaggtaaattagaaagtattttaaactaggccgggcgcggtggctcacgcctgtaatcccagcactttgggaggccgaggcgggtggatcatgaggtcaggagatcgagaccatcctggttaacaaggtgaaaccctgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcttgggcgacaaaacaaaactccgtttcaaaaaaaaaaaaaaaaaaaaaaaagaaagtattttaaactaaatgacaacagcaatacaacattaggagatattgctaaaacagtatttagggagaaatttatagctccaaatgtatatattttgaaagaagaatgaactcaaatagctcaaatatttgacttcagcttccatcttaaaagactagaaaaagaagaacaaattaatcccaaaggaagaagaagaaaatggataacctgaatagctttttttttgagacagggtctcactctgtcgcccaggctggagagcagtggtccgatgatagctcactgtggccttgacctcaagtgatcttcccacttcagcctcctagctgggacttcaggcacatgctaccatgcctggctaatttttttatttttaatgtttgtagagataaggtttcaccatgttgtactgactggtctccaactcctgggctcaagtgatcctcttgctttggcctgaagtggtagggttacagacatgagctatcatgcctagccctgagtagctttttatatgctaaagaaataaaaattgtagtaaaagtctacttaaaaagaaaactctaggtccggatagtttcactggtgaattatacaagttaaggaaaaaataatatcaattttatatgcttttaaaaatattgaagtggaaggaattttttacaaggctcatgatgccagcattactgggataccagaatcagacaaatacattttaaggaaattacagaccagtatgtctcataaatataattgcaaaaatctaaacaaagtttcagcaaatctaattcaacagtttattaaaaggataatatgtcataaccatgtggggtttatcccaggaatgtggggttggtttagtgttccaaaaaatcagtagtgtaatttaacatattaatgaactaaaaagcaaaaatcacatgatcatctcaatagatgcagaaaaatcatttgataaaatctaatattcagtatcataaagactctcagcaaactagaagtggaagtgaactttcccagcctgctaatgtgcttctatgaaaaaccttattagctgaccttgtacttattggtgaaaaactggacacctttttttttgagacagtctcgctctgttgcccaggctgaagtggcacgatctcggctcactgaaagctcccccttgtgagttcgtgccattctcctgcctcagcctctgtagtagctgggactacagacacccgccactatgtctggctaatttttttgtattttttagtagagacggggtttcaccaggttggccaagatggtctcgatctcctgaccttgtgatccacctgcctcggcctcccaaagtgctgggattacaggcgtgagccaccacacctggccaaaactggacacttattttaaaaaaagaagacgggatgtccactttaaccagttccgtttgacgttgccgtggaggttctagcccatgccatcatgcaagagaaggaaatgcatggtgttcagattggaaagaaatgaataaaactgtccttattcacagatgacctgattgtctatgtagaaaatctgatggaatcctactagaactaataaattactatagcagagttgcaggatagaagagcagtatgcaaaaaccaattgtgtttctatacattagcagagaacaatcataaatgaaaataaaagagtagcattttcaaaagcatcaaaaatatgaactacttagagataagtctaacaaaatatgttaaagaaaatgagaactacaaaatactgctgcaagaaattaaaggatacctgaataagatacagttgattctcattattcatggattctttacctaggaattggcttactcactaatttttatttgtaaccccaaaaccaatacttgcagtgcttttgtggtcattctcagacacttgcaggggcaaaacattttgaatcacccagtgcacatgtatatacccagctgggatcaaacaagacaatgctctgctttcttattttgggtttcatactgtaagcaagtagccctttcttggtttatttagtgctgcattttttgcatgtttgtgctttttgttggttattttgatgtttacaaagatggttattttgatgtttaaaatgtttaaagtgtaatgtttaagtgccatatagtgtttctaagtaccaggaggctctgatatgccttacggagaatatatgtgcattagataagctttattcaggcaggagttaaacagtactattggacatgagttcaatgttaatgaatcagtaacatatattagtaatacatactaaacaagaagtctctaaacagaaacacataaaacatgacatatgatcagttcacaaaaatgtcagcagaagcttgcaagaacctaatacgttagttcccctgggagcaatggctctataattgctgattcacataacagtcattgacatattattatctcaataatgagaagtgactgtgtatccttttcatgggttggaatactcaactttgttaaaatgttgattttcaccaaattatagatttaagagacttatatttcaatctttgcaggcttttttatagaactgcacagggtgattctaaaattcatgtggaaatttaaagaactttaaacaactgtgaaaaagaacagtgtgggagccaacactacctgatttcaagaattaaaagctgtaaaatagtttggcgtaaaaataggtaaataggcggcagaatcgcttgaacccaggaggtggaggttgcagtgagctgagatcgcgccactgcactccagcctgggcgacagagcgagactccgtctcaaaacaacaacaacaacaacaacaacaacaacaacaacaacaaaagacaaatagatcagtggaaacagaattggtagtccagaaataaactccttatatgtagataactaataattttgacaaagacataaaggcaatgtagtgggagaaatgtagccttttccacagttggaaacaattggatattgatatacaaaaaatggattcataccttgcgctgtataggaaaactaactcaaaatggcttctggacttaaatgtaaaacctaaaactataatgttcgtggaagaaaacaggagaaaaaaatttttagacctcagttaggtaataatttcttagatatacattaaaagtacaaactataaaaattgataaattagactattaaaatctgctctttaaaagacactggtaagagaataaagagaaaagccacagtttgggaaaaaaaattttatttttttcgtagtgattcctctttattattttctaagatgactgtccatttgctccaactttgttagcaattcatctttttcctactactttatttattttttttggagacagagtcttgctctgttccccaggctggagtgcagtggtaccttcttggctcactgcagcccctcacctcttgggctcaagtgattcttgtgcctcagcctcctgagtaggtgggatcacaggcgcacactaccgtgcccagctactttttgtatttttaatagaggcggggtaccatgttgcccagactggttttgaactcctgacctaaaacgatccacctgccttggcctcccaaagtactgggattacaggcgtgagccaccgcgcctggcctagaagaaaatctttaccaagcatatgtctaatcagtaacttgtatgtaggatgtgtaaagaactcttcaaattcagcaataagaaaaaaaaatcaaaagtaaaatattcagacacttcaccacaggagatacagatgacatataagcaaatgaaaaaagttaattaacagtattcattagggagatgcaaattaaaatcacgaggtatcattatacacatatttagaatgactgaagttaagaagactgaccaaactaaatactggtaaggacacactgtgtttttgtcctgtttaaatctctagatagcttcactggaaaagttggagatggaggcacaacatggcctgctttaaatcagatccttgagcattatttttctgtttttcaggaccatggtggcactgtcaagactagaaagaacttactctggccgggcgcagtggctcacgcctgtaatcccagcactttgggaggccgaggcgggtggatcacctggggtcaggagttcgagactggcctgtccaacatggagaaaacccgtctctactaaaaatacaaaaaattagctgggcggtggtggcgggccgcctgtagtccccagctcccttgggagggctgagcaggagaatggcgtgaacccggggagccggagcttgcagtgagccaagatcacaccactgcactcaagcctgggtgacagagcgagactcttgtctcaaaaaaaaaaaaaagaaaaaaaaattagctgggcatggtggcgcatgcctgtaatcccagctactcaggaggctgaggcagaagaatcgcttgagcttgggaggcggagcttgcagtgagccgagattgcgccactgcactgtagcctgggtgacagagtgagactccgtctcaaaaaaaaaagaagataaatatacgatcacacagtaagctgctgtaacttttgtcattcaccagtttgcaaagttttcccatgttgattcataagctctgtacctctttctcttttcaaagctgcatgattcatgtagtttaaccaatttttggtaaataataatatttatctcatttatagtttttgctattatagtcttgttttccagattatcattgcaaatgtcttcctgtagtatgaatcctcagattaataattgctgttttaaagataggtacaattgaaactttaatcaatgttgcccatcagaaattttgtactaatttgtatttgcaccaacagaattctcacccattttccccacatacttgttaatacttaaatgattattaaaaaaaatctttatcagtctaataggggaaaattatatatcactggaatttgaatttttctttctttctttcttttttttttttttttgacagtctcactctgttgcccaggctagagtgtagtggtgccatctcggttcactgcaacttccacctcccaggttcaagcgattctggtgcctcagcctcccgaatagctcggactacaggcatgtgccaccatgcctggctgatttttgtatttttaatagagacagggtttcaccatgttggccaggctttcaccatgttggccaggctctttaacattcttttgaacaggtatatttactcaagaaattatgtgaattgtgtgtaactttgcccttttttcctattggctttaaaaaaattgatttatagtatctttttattttatgaatgttaacagtttgtcttcacttttttttttttttttgagacggagtctcgctctgttgcttagggtggagtgcagtggtgcgatcttggttccacttgcaaccaccacctcccgggttcaagtgattctctcgcctcagcctcctgagtagctgggattacaggcacccgccatcatgcctggctaatttgtatatttttgtagagacggggtttcaccatgttggccaggctggtctggaactcctgacctcaggtgatctgcccgccttgacctcccaaagtgctgggattccagacgtgagccaccacgcctggcctttcttcacatattgcaagtatttcttctgtatacaaaaagtaactcaaaatggcttagactttagtgtcatatgtggtatgttttgctttagagaagttttattatttttatgttgttaactatcagtttttgcctttatggcttctaggttccttttcatatctaggaaggccttctgtgttacaggagtatgacagatatttagctaatttccgttagtttttgtgaaatttttgtattttgcattttaatatttctgaaatttatctttgtgtttatgtgagagaggaacttaaattttttcctaatggacagactgttaaaaatggagcagtttgatgcctgggtagtttgtcgataattttgcttggacagccttatgttagggtctaatttgaaaatagagggtttgttttagttaatagctggggacatatctgtcagattgctcctagaaggcaagagcccatgaaagggtcctttgctcttttgacttttttctttcttattttacttgggaattaggatgagttccctccaatagcagagaatagagaaaggggaaccagtaaagagacatagaaactgtgtttaaggccgggcgtggtggctcacgcctgtaatcccaccacttcgggaggctgaggtgggcggatcacctgaggtcgggagttcgagaccagcgtgaccaatatggagaaaccccgtctctactaaaaaaacaaaattagctgggcgtggtggtgcatgcctgtaattccagctactcgggaggctgaggcaggagaatcacctgaatccaggaggtggaggttgcagtgagccgagatcgcgcccttgcactacagcctgggcaacaagagtgaaactctgtctcaaaaaaaaaaggaaagaaaccgtgtttaagtcatttctgggaccaaggatggaaaggattctttggaatgatttgccttgcgaagcgaggtagtctgtgaccttagtagcaacagttctggctggaatatagctactttaaaaaatgctactttaagttctggtttaggaaacttttggtgttctagtgaattctggtcacatagttttattctgctgttttttctcatgcgttctgtattctgccagttttctgcttgcatttgccagaaagttatgttgttttatgtgctttctcctgtgtctatactccttgaaaagcttggactgtctctcacgttcccttgttacctaagtgaatttttgctttccttatctaatcaccacctcttaaaacttgcctttccatacaccctttgtctaaggagtttttgtaacagccttattatagtacttatattgtgatttattgtgtttgtctattgtctgtgtctgtttcttctatcagactgtgaactcctttggggacagatcattttgcctgtgagctacattattttgtagcttgttcagtgacttgaacacagttgctgtgtttcttcactggttcctacacatacaaatgaacaggcaaaatgaagattcaaattccagagtccaggacattttgtgaagacataaaaatagagtgaatctaaaaatagagtatatttatgtttttgttggatatgcaaatactgttattataaatatgtattttaccagtgtttcttatcaaagttgtaagttatatctaaccaagtttcgtatcagtgaaggtagaatatttcctagcacatgtaaacctttaatataatttatatcatatttgagaatttttcagtggaaacgaacttatgggtttataagtcagtggaaaaaataataacaaatacatgcttttcacagactactacagaaatatacttgttttttgttttgttttgttttgagagaggatctcactctgtcacccaggctggattgcagtctggaactcctgggctcaagcaatccttctatctcagccttctgagtgtcaaggagtacaggcatgtgccatgacatatggctaatatttttatttttttgtagagatgaggtctcgctatgttgtccaggctgttctcaaacccctggccttaagcgatcctcccgcctctgcctcccaatgtactgggattacagatgtgagccactatgcccagccaagaagtatatttgtatgagtaaaatcaatttatcgtaacagaatattttggctaagaatatttttacttagttttataaacttttttcatgactttttatgtcactgttttaatatttgatgatagtgtaattgttttaacaaatgtttaaatcagaataataatgaatttttaatcattgttaacagtgtttggtattatctcattcaatccatgcaattatctagtgagataagaacaactattatctctattttactttgtgggaaagtgagatttaagtactttctcaaggtcacacagatattagtaagtgacagagatatccaaaacaggctcttaaccatcatgtggcagttgttctttcaaagtggcagagtctgagattgtgaatccatttttattaattttatttacttctaagtaggtctctactattccagccaccaaatggacttgaagactatttcaaactatcttcagtgataacatctataggtctttgaaaatgcatacctgtgtaacattatgtgcatttctcacttttttgcactattgacttctctaaaaaagatttatataacttttttatgtgtctcagattttatagaccagtttgtttttatagatgctctatctaaattttggtgtaatttaaaagttattgctgtattactgagctctctgtcaagtaagaatcctattaagatttctcattaaataaaggaacaactatttgttttaatccctttttaaaataaaacaactatgactaattatttcctaagttatcaactttaaacattttgattttaattttgaagctttatcaaagtgggatcttggacccttctcacactaaaacttcagtcacccattaaaatgtgttattggattcatgttaacttttatgaagcaggaagtcagaattaatggaatataagttttataccatgttatttgttaacattttcctttagaggatttagattaggttttcataccaaacgggttcattataaatgaaccatttaaatcgctgtttaatatgtgtagaacctatgctattagcaattttcatagtataaaattttcacactatgtttgtatgcttctaatatgttttgcattgtaacagatgaatatgcagcattactgaattatgaaaattacacagtggtggtataaatgctatttgtgttatgcaaaattggctgatttttatcagactttaatattttctcattttaaccaattattctgcttttgctttttgatattaaattggctgtgctgtctgttgcacttgaattcatgcaatggtatgcaaaggccaaaactgattatcgtctcaggttaccttgtattttcttataacgactgactttccaaattgaacaggatgttttataaaatttgtgtgacatgcaatggaataggtaaaatgcaggttttctcaaaactgtcttgacttttgtcttttttgtacttttcccaaaagtaataattactagttttttttttttttttttttttttttgcaagccacttacaatggcttaattgtagaatctactgtcagctgtcttggccctacaattggttgcttagattccttctttttacttaggtcttaccaggtgcttacgtagttttcttataaaatagtttcttaatcataattatcacaatcaagccattgtacaaattattgggcctgttaagagtattagaaatgtaaaagaatattatttttaatattaaactttggcctaggaagtttgtagatgaagttcctaaagccagccattttcattcattttaagtattcttgtggctacaattgaactgtatttattgtgactatagtttaaatgagcaggaagtaatccacttgcatgttttatgcttagattttaaaatatattttggcattttttatgggaagtgaaagaaaaaagtaattaaatgtgtctataaatgagagaaaggaaaaatataggttaaaataatgtggtattagaaaaatattctgaagctataatagtaccttgtatttgcgatatagtttagaaaaccatatcatacatttacaactcttaatctcacaacaactttgggacttaagcgggatagatttatttctctcattttatagaaagaatagaaggcttagtgagtttaagtaaaatcattgagatcttgacagttagagaggacttcctaaacaagacgtaaaaagcacagaccataaaaggaaaagttggtaactataatacaaaaaaaaaaaaaaaaggatagaagcctgtaattcagctacttgggaggctgagtagggaaaatagcttgaacccagggttagagtccagcctgggcaacatagtgagactgtctctgaacaagaaaaaacccaaacaaacataaaatagtagtggagaaaaatatgcaaagaacaataatgggatactgtttgtcaaatatcaaattatcagaaattaaaatatttgattatattccatgtttttgagcttgaggagaaacggtaggggaaggtaatttggtacagtcattttgagagctatttgacagcatgctctctttaagagtgaagaattggaaacaacccagtgtctcagtagaggagtggataaaaaaactggtgcaatattgtaaaagaaattctatggtagttaaaattaatgtgctagatttatataagtaaaagtcttgagaacacaatgaagagtgaagaaagtaaactgtgagaatgtttattataatgctataataccatttatgtgagtctagaaccacatacatcaatactctgtaaaagataataaggaacttaacaggaatggaataccacttattttttttttaataagagttaaacatggaacatggttaataagcactgggtgttaggtacatgggcacttgttaaattattctttttacaactttgaaaatttatttaaaaaaacagaaaggggagttaatttgtttagagttaccgaaaaattgtagttggaagagctagtacttaaacttaggacctgattcccaagactagagctttttctaacacactgcctcataatgagaaggaaaaaaattgagatgaaacgatcaagaaggtagacaaaatttagtttcatagtaataagaaccaggaaacgtatgtgtttctagtaaattttttgaggggaaaggaaagtttttaagataaaaaattattataattttactttaaaatctttaagcatgctgttatatacatagaacaacttaggtacttaggaaaaattttaccttaatttattgtttaaaatgtgatacatatttctgttgcatgtaatggaagacattaggtaatttgaatttttaaaatacaaaattcatgaaaataatttaaatatacaatctaccttcaaagtcaaaactagtttttcttccattttgtaaagtcattcttcacaaaaactttatagcctttttatttacagcttctctccaagataaaatggcaaacccaaaagagaaaactgcaatgtgtctggtaaatgagttagcccgtttcaatagagtccaaccccagtataaacttctgaatgaaagagggcctgctcattcaaaggtaaggttatgaagagaggtggtgagacatacttatcagactaacagatttatcatctcagattttaatcgtgctttattttggggagtgggggttcagcagatggcttgaaggcttttagttctacattaataatatttcaaagtatgtaactaaactattttgtagctcactgtggtttacaaagctcttttagatatagtacttcatataaatcttaataaaaccacatgatatatggatttttgatttccattttgtaatttaaactcaggcacaggaaagttaagtgacttgcttaatagttcataagtgccagtgccagtacttgaatatattttctttggctcccaaatatggtgtgctttccattaaatcacagctgctaaagtagaaatggagacagagtaaatataccaacagttacctagtgagacatcttttccaatgtgatatttaattctaacattaatcatttataaaagttgtatataccactgttcttattatctctgcattcacttatattgtttttttaaatggaaagcaatttttatttatatatagctgtatacatttatgtttgcatatatacatgttacaaatctacaactaatgcatttatgtttgagctctattcagttgcttacaatatcttagttgtgcataattttctatggcacatttatatcttggctattggagattatcataatgatcataaaatttgtatataatgtggcagcatttgttctctaagggttgattaatcttcttaaagcaactggctattaggttatttgcatcctggcatctcctacaaactaaggaaaataagaggaaactacaatttgtcaattttgttttctattaatggtttttatgaaggatttaggggcaacaatttaatttgttcatatcttttgttcttgctttaacagaaaaaatagttgtagccttggtctacctttccagctatatgtcctgactctctttctgactcattctgcccttaatcatgttgaactgtttgcatttctcagaacgctttatgttcttttcacatctctctgcctttgcctaagttgtagtgtctttctgccttgaaggtgcttttgcccttactcattgttgagcactcagctccatgttacatcttccacacgtttgtgaaacctctgattcctctactgggcctccagtgggacctatagttctctgtggtagccgttactgtgttatagtacagtaatatatgttggtcattagttttgtgctagactgagcttgtttttgggtgtgtattttactcgtttacatttcttggtccctgtagtatatactctttgctcctcattgccaattccaggtattcttccttgagacaatcccccagttttgagtttcatattagcagacacacttcccacattccctcatgattgtcatttacatctgggtgatttcatcacatttcttatggctcactttcactctctttagcattccccattttaatttttggtgatttcaacacttaaatagatgattgttccagcatgttgaccttttagtttctttaacatctccggtgatcttgttctctactgtccttcagccactcatgcctataatcacattcttgaccttatcattaccaataactgcataatgttaatttcagtctttcatctttctgtgacacttgcctcttaactttctagttcattccgtctagtaatttgacttccacagtcctttcatactgcagatccattgattctgccaccattttactattcctttctttccccaatcctcacatagctctttaacctgcttaaatgttgtgtgccttttatgtaggtaccctcagctgacttgcccagctcctccattgtgtcctggatcccaacctgtttcacctcttcaaggccatttctccagttttgcttcttctgccttcttctcccaagagtgaagagctagactgcctttaacagttagtgacatcatccctatcctctatatatggtaaaggaaggtcagcctacctgggaagtttctggaggactcttaggaggatttggttttcattaagattctttaggaatccattgtaatttttggaagggtttatgaactgaccttttatctatctccttgtctcactgctggggttttaaaggctaaacaggttggttgtgatgaaagtagatgacagtgggtctcttcttatttctcaatagtcccaggattcccttggttttaaggagatttggagatcccttttgccaacctgtgccagttgctgtaggtgctttggtgatacaccaccccccttagcctgtagcttgcttatttttaaaaagagtactagaataattggcatgttgttgagtgaaacatgatattgataagttcacataataatatagttaatattaatcctaattggctaagtctggatcctttttgtgaaaagcaaaatcattttcattcatgtatgtctatcagtggcctttaggtgagacataaaatgtattttaatgaaattaatgataatctctggtaagaaaaatttaaacctagtttcaactcattaattttcttggggctgggcatggtgactcatgcctgtaatcccagaacttcaggaggccgaggcgggaggatcacttgaggtcaggagtttgagaacagcctggccaacatggtgaaacccttctctactaaaaatacaaaaattagccggggtgtggtggtgcgtgactataatcccacctactcgggaggctgaggcaggagaattgcttgaacctgggaggtagaggttgcagtgagccaagattgcaccactgcactccagtttgggctacagagtgagactcggtctcaaaaaaaaaattttttttcttggtacattaattatatggcaattcacacacatactacacatatgctgacataggtgagaagtggttctcaactttggctgttaattggaatcatttcaggagctttaaaaaatacttatgcctgagtctcatcccgttaatttaatcggtcttgggtgaagcacacacatcaggaattttttaaagctctgaaatgactcaaaagtacagccagagtttggaaacacaggacagaggttaatgtcttcagtatggtatggaattgtcttctcttatatcatgctgacaggtagtgacctatcttacgtttacatgatttcctccttcccccatgagtatcacaaattctgaacaacttgtaatatgtgactattaaaataataattattttagtctttgccttgtcttcttttatttttctgctcagtttttaattgaactctgaaacaagttagtataccttataataatgggagttattgtaatattagtttatttcctaggtacctgtatacagttattttttctacagattattgttttggtttgctcaaatctcgaaagaaggctgttttaattagaatatgaggaagagagccatgaataacataaaatggtattttcttcttttccattattttcctattctgataatttgttggtaagcctggctaagtttcaagtaaattgtactagtgctgatactttgagatggtttactttggaatgggtatcactgagggaggcaatgtcatccactggcccttaagccaagtagtctttaaaaaaaaatcttcgctagagttgcccagcttgatctttgcccttcattgccgagcttatgtgaccttgaacaactaatttaaagtctcagttttcttatctgtaaatggagtaatataatacctcataaagtggtataatggagtgacgatttataagttcttaagcattgtgttgatgatggaggtacccaaataattatatcattgcttattagtcatatataggactaaaacaaccccttagtaaaaggtctgttgagtatttactatgtggcaggcactgttcctgcactgaaaataaataaggtgcatatcatgctgttaggagttttgtctcataacattcattatgaaacccacaacatcttaagatcttacttttgcctgtaatcccagcactttgggaggccaaggtgggcagattatgagatcaggagattgagatcatcctggtcaaaatggcgaaaccctgtctctactaaaactacaaaaattagccaggcgtggtggcacgagcctttagtcccagctgctcgggaggctgaggcaggagaattgcttgaacctgggaggcggaggttgccgtgagctgagatcgcgccactgcactccagcctggcgacagagggagactccatctcaaaaaacaaacaaaaatcttacttttaatttattatgaaaaatttgaaatagataccaacgttgaatattttgccaagataaatttatttaccatcccctacccacttttttgaactaaagtttttaaaagaactatgtctgttcattcataagtgctttggtatgcatctgtaactgataaggacctttaaaaaaatagcgcactacaccgtcattatgactagattaagaagcccaaatattatgtaatacatggtctgtatccatcttttttttaattagacttagagatgtctttttacatttggtttgttcaaatagggtccaaacaaggatcatgtattacatttggtggctatgtctctttggtctcttttatttattaatactaacactccttttatccccatcccctcttttcctatgacattgatttgttggagaaatagagtaatttgtcctataaaatgttctacatcttgaatttggctgattgtatgtagtgattgttatatgaggggatttcatcagttgatgagtattgggctagagcagagattttgagctgtaggatgtgcctcttgaatacataattttcaggcatgatgaaatcatcattttctttctatgtacatttgcagtggaagtataggataagagagtgaggatagtggaagggaaatgtagtaaagagtcatgagagagaaaatactaaaaagatgggagaacattttttgaagcaatgcaaactgacttctttcataatttaacccatgccaaaagtattgtttctgctttatatctgtgtgggaaaaaaagaacaaacatttccagtgtcctacaacattttttcgttccttgtcgtaatcatctctctttgtacctgggaccccacacagctactaatctgctttctgtgactatagatgagtttgcagtttctaaaactatataaatgtaatcatatagtggtatgtactcctaccagactattttcacttagcatagttattttgagtttgctcatgttttgtgtgtgtcagtatttcttcctttttattattgaggagtagtccattatgtgtatatagcacactttgttttttggacattcatctgttgatggatattttggttgtttttagctttttgctattataataaagctaatttgaacatctatatacaagtcttcatatagacattgtattagtccattcttgtattgctataaatagttgagactggctaatttataagaaaagaggtttagttagctcatggttctgcaggctctacaggaagcatagcagcatctgcttttgggggggcctcaggatgcttccaatcatggtggaagtaaaaggcatgtcatatggtaaaagcaggagcaatgtggggattgggggggtcccacacacttttatatgaccagatctcatgataactcactattgtgaggacagtaccaagggatggcgctaaaccattcatgagaaatccacccccatgatccagtccccagaccccacctccaacattggggattacaatccaacatgaaatttgggtggggacacggatccaaaccatatcagacatatattaccttttctctttctctattttattttctctatttctttggtaataagagtgtcaggaatgtatagcaggtgcatgtttaactttttaagacattgccaaatttttttgcaaaatatagttgtaccattttacattcccctcagcggtgtatgagagttctagtttttctgcccccttgcctacaggttatatagtcagcctttctaattttagccattctaataggtatgtggtggaatctcattgtggtttcagtttgcacttccgtagtgactgataatgctggctatctttttgtgtgtttgtcatcagtgtatacctttagtgaagtgtctgttcagatctttgcccattattttttattgggtttgttttattgttcagttttgagaagttctttattctgttgtttggtgcatatgtttataattgttttatcttcttgatgaattaacccttttatcaataataatattctttgtctcttttttaattaaaaaattatttttaatttttgtgggtacatagtaggtatatatatttatgaggtatatatatttatgaagtacatgagatattttggtatacccaatgcatacaacgtatttggtatgttgcatgtaccaaaatatctatgtgaagaaaaagaacaaacatttccattgtcccacaaaattttctcattccttgttgtaatcatctctctttgtacctgagaccccaggcagctactaatctttttttcacatagattagacacgcaatgcataataatcacataatggaaattgggtatccaaagcctcaagcatttatcctttgtgttacgaacaatctacttatactcttttagttattttaaagtgtaaaattaaattattattgactgtagtccccctatgtgctgtcaaatactaggtcttatccattctttctaactaatttttttttggtacccattaaccatcttcccatcccctcaaccttcctgctacctttcccaatctctagtaaccatccttctattctctatctctgtgaattcaattgttttgatttttagacctcacaaataagtgacaacatgtgatgtttgtctctctgtacctggcttatttcacttaacatagtgacgtccagttctatccatgttattgcaaatgacaggatctcattcttttttatggctgaatagtactccattgtgtataaataccactctttatccattcatctattgatggacacttaggttgattcgaaatcttagctattgtaagcactcctaaaaaacatgggagtgtagatatcttttcaacatactgatttcttttcttttgggaatatacccagcagcgggattgctggattgcatggtagttctatttttagttttttgaggaacctccaaactgttctccatagtggttgtactaatttacattcttgctaacaacgtatgagggtacccttttctccacaaccttgccagcatttattattgcctgacttttggataaaagccattttaacttgagcaagatgatatctcagtgtagttttgatttgcatttctctgatgatcagtgatgttgagcaccttttcatatacctgtttgttgtttaaattggattattagatttttttcctatagagttatttgagcttcttatatattttgattattaataccttgtcagatggatagtttgcacatatttctctcccattctgtgggttgtttcttcactttgttgactgtttcctttgctgtgcagaaggtttttaacttgatgtgatcccatttgtccattgttgctttggttgcctctgcctgtggggtattactcaagaaatgtttgcccactccagcatcctgaaaattttccttaatgtcgtcttgtaatagtttcatagtttgaggtcttagatttaagcctttaatccattttgatttgattttttttgtgtatggcaagagataggggtctagtttcatttttctgcatatggatatctagctttcccagtaccatttattgaagagactgtcttttccccagtgtatgttcttgacactattgtcaaaaatgagttcatcgtaggtgtgtggatttgtttctggattctctcttctgttccattggtctgtgtgtttatttttatgtagtaccctgttgttttggtttctatagctctgtagtataatttgaagtcagataatgtggtccctccagttatgttctttttgctcaggatagctttggctattctggttcttttgtgattccatataaattttagaattgtttttcctatttctctgaagaatgtcattgatattttgatagggaatgcgttgagtctgtaggttgctttgattcttccaatttattttttcatgtcctcttcagtttctttcatcagtgttttatagttttcattgtagagatcgttcacttccttggttgagttaattcctaggtattaaattttatttaaggctattataaatgggattacttttttgatttctttttcagattgtttactgttggcatatagaaatgctactgatttagtatatttattttgtatcctgcaactttactaaatttgtttatctgttctaatagttttttgttggagtctttaggtttttttaaatataagatcatatcatctgcaaacaatgataatttgacttcttcttttccaatttggatgccctttctttctttctcttgcctgattgctctagctagtactttcagtattatgttgaataacagtggtgaaagtgggcatctttgttgtgttacagacctaagaggaaaggctttcagtttttccccattcattatgatactagttgtggatctgtcatatatggcttttattatgttcaggcatgttccttttatgcccagttatttgagggtttttatcacaaagtgatgttgaactttatcagatgcttttttggcaccaattgaaatgtatggtttttgtccttcattttgttgatgtgatgtatcacattgattggtttgtgtgtgttgagccatccttgcatcactgtgataaatcccacttggtcatgatgaatgatcttttaaatgtattgttggattaggtttgctagtattttgttgagggtttttgcatcaatattcatcagaggtattggtctgtaggtttttttttttttttttttgatgtgtgtttggtttttggtatcagggtaatactggcctcacagaatgagtttggaagcattccgtcctcctctatttttcagaatagtttgagtaggattggtattagttccactttaaatatttggtagaattcagcagtaaagctgttgggtcctggccttttctttactgggaagcttttcattactgctttgatctcctcacttgttattggtctgctcaggttttggatttcttccgggttcaatctttgtagggtgtatgtgtctaggaatttgtctgtttcttcaagatttttcaattttttggcatatagttgctcacggtagtcactaacgatcctttgaatttctgttgtatccattgtaatgtctcctttttcatctctggttttatttacttgggccttctttctttttttcttagtctggctaaatcgtttgtcaattttgtttatcttctcaaacaccaactttttgttctagtgatctcgtataattttttcatttcaaattcatttatttctgctctgatctttattatttcttttcttctactaattttgagtttagtttgctcttatttttctagttctttaaggtgcattgttagattgtttgtttgaaatttttccacttttttgatgtaggtgtgtgtagctataagcctccctctgagtactgcttttgctgtatcccataggctttggtttaccattcgtttcaaggaatttttcaattcccttcttaatttcttcattgaaatggtcattcaggagcatattgtttaattctcatgtgtttgtgtagtttccaaaattcctcttgttattgatttgtagttttattccattgtggtcagtgaagatgcttgatattattttaggttttctttcttttttctttttctctctctctctcttttttttttttttaatgttttaagactcgttttgtgacctaacatggtttatccttgagaatgatccatgtgtcgaggagaaaaatgtgtattctgcagccattggatgaaatgtgtaaatatctactagatccattttgtctatagtgcagaataactctgatgtttctttgttgattttctttctgggagatctgtgcaatgctgaaagcggggtgttgaagtctccagctgttattgtattggggtctgtctttctctttaggtctaataatatttgctttatgtatctgagtgctccagtgttggttgcatatatatttacaattattatatcctcttgctgaattgacccctttatcattatataatgaccttttttgtctctccttacagtttttgtcttgaaatctatactactttttctgatatgagtatagctgtgtctgctcttttttggtttccgttgccatggaatatgtttctccatccctctcttttctgtctgtgtgtgtcttcataggtggggtgtgtttagatcattggatcttgtttgtttctccattcagccactctatgtcttttgactggggaatttagttcatttacattcagtgttattattgctaaataggaactttctcctgccattttgttatttgttttctggtggttttcagtcttttcttccttctttcctttcttcctgtcttccttttagtgaaagtgattttctgtggtggtatgctttaatttcttgcattttatttttttgtgtatctgttgtatgttttttgatttgaggttactatgaggcttgcaaatactatcttttttaaattaattttcttttttttgagacagagtattgctctgtctctcaggctggagtacagtggcgtgatcttggctcactgcaatctctgcctcccaggttcaagcgattctcatgcctcagcctcccaagtagctgggattacatgtgtgcaccaccacacctggctaatttttgtatttttagtagagatggggtttcaccgtgatggcaaggctggtctcaaacttctgacctcaagcagtctacctgccttggcctcccaaagtactgggattacaagtgtgagccactgcgccggtgcaaatactaatacttataacgcattattttaaactgatgacagcttaacacaattgcagaaacaaacttgcaaaaagaaagttaattaaaactctacactttaactttgtccccgctgccagctttttaactttttgttgtttctctttatgtcttattacactatttcttgaaaagttgttgtagctattatttttgattggttcattatttagtctttctacttcagttaagagtagtttatacaccacaggtacagtgttatactcttctgtatttttctgtatgcttaccgttaccagtgcattttgtaccttcagatgatttcttctttcattaatatccttttctttcagattgaagaactcccttcaggatttcttgtagaacaagtctggtgttgatgaaatccttcggcttttgtttgtctgggaaagactttatctctccttcataattaaaggatattttcaccagatatactattctaggtgaaagtttttttccttcagcacttaaaatatgtcttgccacactctcctcacctttaaagtttccactgaaaagtctgctgccaattagctgggtatggtggtgcacgcctgtaatctcagctactcaggaggctgaggcaggataattgcctgaacctgggaggtggaggttgcagtgaggcaagatcgcatcactgcattccagcctgggtgacagagtgagactctgtttcaaaacaaaacaaaacaaaacaaaacaacaaaagtctgctgccagttgtattggagctctattgtatgttatttatttctttttttctggctgtttttaggatcctttctttatatttgaccttagggaattagattcttaaatgctttgaggtagtcatcattgggttaaatctgcttggtgttctataaccttcttgtatttgaatgttatctttctcgtttgggaaattctctgttattatccctttgaataaactttctactgttatctctttttctaccttttctttaaggccagtaagtcttacatttgcccctttgaggctattttctagatgtttttggtgtgcctcattgctttttaatttttttcttttgtcttttctaactgtgtaatttcaaatagcctgtcttcaagctcactaattcttcttaatcatttctgttgttaagagactttgatgtagtcctcatcatgtcagttgcatttttaaactctggaatatcagcttgattctttttaattttgatctcttggttaaatttatctgataagaattccaaattccctttctgtgttgtcttgaatttctttgagtttcctcaaaacagctattttgaattctctgcctgaaaggtcatgtatctctgtttttccaggattgatcccttgtgctttatattagttcatttggttaggtcatgttttcctgaatggtgtcgatggttgtagatacttgttggtgtctgggctttaaacagttaggtatttattgtagtcttcagagtctgagtttgtttatgcctgtccttgggaaggctttcccaggaatttgaagggacttgggccccaagcccaacaatgctgtggcttttggagacttgttagaggtacagccttggcagccttggataagatccggaagaattctcaggattaccaggcagagattgttgttctttttctttactttctcccaaacaaatggagtgctaagccacttggaattgggggtgtggtgatgcaggcacctctgtggtcatcatccctgggattgctctgggtcagacctgaagccagcacagcactggccttgcccaaggcccttcccttcagggtggcgggtttttccctgggttccaggtgtgtccagaggtgctgtctgagagccagggattggagtcaaaaaccttagcaatttacctgatgttttcttctattgtggctaagctggcactcaatccataatacaaaatccctcccactcttccctcccctttccacaggcagaggaacctctccttgtgtggccaccaacaccaccactggtccatgggctcattcttcagggcagtgggctccctgaagtagatccggaaatgctgtccagcgtaggtgtggactcagggaccccaagagcctgctttttgctcttcctgctgtggctgagctggtacctagggcacaagacaatgttccctttacttttctgtctgcttttcttaaacaggagtctttcacaatagccaccacagctgggaatgtgctgggtcacccctgaagccagtacatgtcagagcccagggcccactgcatactccttgggtatcagtggtgattattcaggacccattggttctttggtcagcaggtaatgaatcctgccaggattgagtccttaccttcaaggcagtgggttcctttctggcccagggtgtgtctacaaatgttatcttggagctagggcctggaatgggggcctcacggctctgcctggtgccttatcctatggtggcttagctgatatccaaaatgcaagacaaagttctcttttttcttcactctcctctccttaagcagaaggaagtagatactttcgttgctacaagttgcacttcctggggttaggggagggatggcataagcactcccttagccattccagctggtgtctccctaggttgcgtgccatcctagttcactggctctaagcccagcctcacactaggagttgcctaggaagcacagtctcgtgtcctagactgcctttcagatttatctaggaccccggagcacttcagcctgtggtggcaagtcttgccaagaaattcaagttccaactgctatgatgggcaattcccctccagctagtgctggtccaaatcctccctccctgtgcaggtgctggctgagtccagcacattttcattgtctgctgtgacagggcagcactgagtttaatgtactgttttccaatagccgtgctctcctccctcaaagtgtacagattttctctccacgccacatggctgctgctgggagtgtgggagagggttgatgttggtgattcaagactctcctaccctcctcaatgcctcttttggcaatatgaagttaaagccagacactgtgattgttcacctgatttttgtttcttgtaacggtgcttttttgtgtccatagttgttaaaatttggtgttccactgggggtgatgaatgatatataggcttttgttccaccatcttgctctaccctcctctgtaattttactctaccctcttctgtaactttacccaatgaacatactttgtgtgtggtctgaattctttgtatttattgagacttattttatggcccagaatatggtctgtcttggtaaatgtcctgtgaacaattgagagcaagtgtatattctgcttttcttggttggagtattctaacagtgttgataagattgtgttggctgatagtgttgttcaactgtactatattcttggtgattttttttgcttgttatatcagtttttgataaggagtattgaatctgactttaattgtcaattttatagtttaagttttgtcagtttttgcttcatttatttaagctgtgttattaggtgcctaaatgtttaggatatcaatgtcttcttaattgctttctttattcatatgaaatgaccttcgttaccactggtaatagtctttactctggaatccacttagtctgatattaatatagccattctaatttctccttgatttatgtcagtatatgtttttctcattactttaaaactatatgtgcttttatatttgaagtacagtttttgtaggtagcatgtagtttgattttgcatttttatctagtttgacaatctctgactttcaagtgggggtgtttacaccattttgttctaattttcacaactaaccatgtgttcttattagcctcatttcactaaagaggtaagaagctgagagttagaaagaataattaacttcccagtgttgtacatagtaaatggcgaagccaaggcttaaattcataaacagtgtgtctccagcattccgtcttaaaactactacactttttactgtagtaggaatcttaagagagattgtagaaaagcataggattgccttggaaatacttatattttacagaatgttcatgttgatggttttacagaatgttcatgtcgatggtggtaagaatggtagtttgaatgggaaggtcatattaagggaactgctttaagatagtaaaaagaaatttttttctatacttccaacacttttttttttttttttttgagacggagtctcactctttcgcccaggctggactgcagtggcgctgtcttggctcactgcaagctccacctcccgggttcacgccattctcctgcctcagcctcccgagtagctgggactacaggcacccgctaccacgcccggctaattttttttgtatttttagtagagatggggtttcaccgtgttagccaagatggtctcgatctcctgacctcgtgatccgcccgcctcggcctcccaaagtgctgggattacaggcgtgagccaccgcacccagcccacttttttttaaattaaaaaatttgtttccgagatagggtcttgctgtgttgcctaggctggagtgcagttgtgcagtcatagctcactgcagcgttcatctcctgggctcaagggatccccctgcttcagcttcctcagtagctgggactataggtgcgcaccaccatgcctggataattttttacatttgtggtagtgctgaggtctccctgtgttgcccaggctggtctcgaacttctgagctcaagtgatcctcccaccttggcctcccaaagtgctgggattccaggcataagccaccacacctggctgtaacacttcatttctgacactaaatatgtggggtttttttccacgccagcagaattctgcaattgtccccatacattgactggatgtcctacatatttaactaaattctgacactaactgcccacggttagtgcagaccctgcaggttaagggctcagtcccacaacactgctctcacctcacatgacagtcacaaatctgggtcttctaaacttgtgaccaactggctataaaccgggggctctcagcacctgttcaggagggnnnnnnnnnnnnnnnnnnnngctataaaccgggggctctcagcaccctcttctcaggttccataatttgttaaaacagctcacaagactcaggggaacacatactttatatttactagtttattataaaggatattctaaagtatataggtgaacagccagataaagagtacataggagggccggcgtggtggctcacgcctgtaatcccagcactttgggaggctgaggtgggtggatcacgaggtcaagagttcgagaccagcctggccaacatagtgaaaccccgtctctactaaaaatacaaaaattagcccggcatggtggcttgtgcctgtgatgccagctacttggggggctgaggtaggagaatcacttgaacttgggaggcggaggttgcaatgagacgagattgtgccatgcactccaaccttggcgacagagcaagactccatctccggggaaaaaaaaaaaaaagaagtacgtaggatgaagtgtgtgagaagggaaatggagcttccaagccctgtctgggtgtgccaccctgcagcacctcagtgtgttcaccagcctgcaagctttttgtaccctatcttttagggatatttatggaggctctgtcacataggcatgatcgattattaactcagtctccagcccctctttcctccgtggtggataggaatgggatggggctaaaaatgaagtttctaaccatggcttagtttttctggtgactggccctcagactagctctctatccaggggcctgccaagagttggctcattagaataaaaatttcctatcacccaggaaattccaaggaatttaagagctctgtgttagaaattgggatcaaagaccaaatattagaacaaaaatgctcctagttctcctgtccttccggaaattacaaggttttgggagctctgtgttaggaaccagggccggagaccaaatacatatttcttatataccacaggtggtgttgtggtagtttaggggagagatactgatattgtccgcatatcattggtgcatgtatatatcttagtataaagacattggtgcatgtatatatcttagtataaagagaggaggccaggtctgaaaaacatttaagttgagtcagtagttgttaattgcaagcaggagagaagggaagacctctcaaaggtgtctggctcatgagattgggaaaatggtgacatctggatgattaggaggcaggaaagattagagataggagctaaatgaagtatactgagtctgagtttatagaaaccttagaccaaggaggtgacaatataaattacaacgaagagttatgagatgttaaataagccttaggaaggcaaggataaacgaaactaatgaggtttgaacctgaactgttgggagataatggattaaacattttggggtatgaactgatttggagggggtagagtggaggaggcagtgttttgtttgaccttttacctcttgagtttgtggaaataccaagtagacagttagatttatgtgattgttgtttaggagaggtcaggtctggagacatgcagagtaaatttaatatgctttcctgatgcaatcaggaatctcaaggtcatttatgtgggtatttctgttttcaagcatatgagctatatgcaagattatgtatattatatatatcatgtgaaacctttgaactttcttactttgtggcaaagttctttgttaaataccaaaatttgaagaaaaagagctagtcattgaaaaatcattctgaaaccagagagagtattaaagatacattttaggtatatattttaaactgaattagaataaaagaaaatttaatcactttaaacaggtatgtttatgttgtgaatttcaaatgacaaatcccaattctctattttgattaattaaaaatctacagaaaaaatggaaagagtggtgtaatagacactcatgtatggtttagattcaccgatcgttaatttatttgccacattactttatttcttgctccctctatattgacatataatttttccttgaacaatttggaaagtaaatttcagctaccatgacacttcactcttaaatacttacatatctatcttgtaagactaaagacgttcttcataatcacaatactgttaatcacacaagaaatttaatcctggctaaacctattacttaatgtatagttcatagtcacatttccccagttgtcctctgaatgtcctttacagcttttttccccttcccattttagatataatgaaggatcatgcatggtatttatcatgtcttttcatgtctcttttcttttccttttttttttttttttttgagacagagtctcgctctgtcacccaggctggagtgcagtggcgcaatctcggctcactgcaagctccgcttcctgggttcatgccattctcctgcctcagcctcccgagtagctgggactacaggcacccgccaccacgtctggctaaattttttgtatttttagtagggatggggattcactgtgttagccaggatggtctcaatctcctgaccttgtgatccgcccatctcagcctcccaaagtgctgggattacaggcgtgagccactgtgcacggccttcatgtctctttagtgtcctccctgcattcttttttttttttttccttttatgacattgacatttttggagcctaggccatttgttttatagaatgtcccataatctagatctctctggttgtttccctgtgattagattcagattaaacatttttggccaagaattgtacatggttgttgatatatacttctcactggattgtatcagggggcacatgacgtcaatttgtatgattattggtgatgctaacttagtgaaggtattttctatctgatctcctttctacaataatatatatttttttgtaataagtaattttaagttaatacttagtattcctagaaagtaatatgcagtctggagtgaaaccaattatgcgcatatcatgtaacttgattctgaattttaaaggtgaagaataggtttgggggctcatatggaaatacagtgagaatggaattcagagcatgttagtggaaggatgtgtgtgagatgaggatgcacaggtagagcctttgtgccatgctaaaacaggaacagttgaagggttttaacctgatgttgattggggtgatgaagttggatttgtgttttagaaagatagttttagcagtgatcagctggaagaatattatgtccaagctaaagatgatgaaaggctggatccagttggcagagagaggaagaagatttgagaaatatttatgatgttaaaatggacagaatttagtgattggctcaatgtttgttgtggagattcagagttttttggtagtataatatttaatagaattgcctgactcattgcctagattgtgctaaatgtaacattcaaggaattagattttatgaaagtattatagacacatggtcttttggcttctcttacagtttctcttattatttctacttattctgcttttgtgaggaccatttgaatgacattaacattgtgattccatttagaggaaagattgcttcttgatttattctacccagaatgtacacctagatctgctactaagcttttggataggatagaacagaatttggtactctcttaaaatttcttcactaggtagagtaagattttgttgcagatgatctgtaggtaaggtcacctctagctctaaaattctgattctatgatgtttatttttctctcagacagccaattttatttcttggaaaagtcttaatgttttctttgtctatttatgtttttctaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggtatggcagtgactccttctgttatgttgtctgctatgtgtgttctgcttgttgtatgtttcatttatagtaggctagtaacagagtgagcaagtattaatagtacacatatgcccatacctacacacacacacacacacacacacacacacacacacacacggcagcataaaaataactgaaggaggcttggtgcgttggctcacgcctgtaatcccagcactttgggaggccgaggcgggtggatcatgttaggtaattagttcgagaccatcctggccaacatggtgaaaccctgtctctactaaaaatataaaaaattagccaggtgcctataatcccagctacccaggaggctgaggcgggagaattgcttgaatctgggagatggaggttgcagtgagccaagatcgcgccattgcactccagcctgggcaacaagagcgaaactccatctcaaaaaaaaaaaaaaaatgaaggtgagaggatgaagaaagtaattgtaattgtttttaaaatttgctttagtggatactataaaagtgcattgtttacttttttaatgttggcaaaaacatatttgaatacaaagcacagaaaatttgactgagttttttttttttaaagtaaagatagtaggccgggagcggtggctcacgcctgtcatcccagcactttgggaggccgaggcaggtggatcacgaggtcaggagattgagaccatcctggctaacacagtgaaaccctgtctctactaaaaaaatacaaaaaaattagctggacatggtggcgggtgcctgtagtcccagctactcaggaggccgaggcaggagaatggcgtgaacccgggaggcagaggttgcagtgagccaagatcgtgccactgcactccagcctgggcgacagagcgagactctgtctcaaaaaacaaacaaacaaaaatgatagtggcttggtgcagtggctcccacctgtaatcctagcactttgggaggcctgggtaagaggattgcttgaacccaagaatttgagagcagcctgggcaatatagcaagaccttgtttctacccctgcaaaaaaaaaattacaaaaaatgattaatttctctttttaaatatatagtttaaatatatagttatatatataaaaaactatattttatactattatataattatatatattttattttatatattatatatttatatattataaatatatatttatatttaaattaatttaaatataaatatattatttttataaatataaattataaatataaattatatttatattatataaattataaatataatttatatttataaatataaatataaattatatttataaatataaatataaattatatttataaatataaatataaatataaatttttataaatgtaaattaatagaaatataaattaatttatatttaaattaatttatatttaagtttatatttaaattaaaaaatttataatatattgtatatattatataattatacataattatataaatataatttatataaatttatataatatataaaactatatatttatatatagcctggccagcatggtgaaaccccgtctctactaaaaatacaaaaattggctgggcatggtggcgcgtgcctgtagtccccactacttaggaggttgaggcaggagaattgcttgaacctggcaggcggaggtttcagtgagccgagatcacgccactacactccagcctgggcgacagagcaagactctgtctcaaaagaaaaaaaaaaaagaaagaaaccccatcacaaattccgcaaaccacctgcatgtaaaatactgctaagtaaattactgttctaattttaagctcctaagaataattttaaagagttgttctaattgcatacaatacgaacaacattatatgtcattatctttttttttttatttcaatagtttttggggaacaggtggtattcggttacattgataaattcttccgtgatgatttctgagattttgttgcacccatcacccatgcagtgtatgctgtacccaatgtgtagtctttacccctcattcccctcccaaccttctcccagatccccaaaatccattgtttttttttttttttgaggtggagtctcgctctgtcaccaggctggagtgcagtggtgcaatctcggctcactgtaacctctgcctcccgggttcaagcaattcttctccctcagcctcccaagtagctgggactacaggcatgtgccaccacgcctgactaattttttgtatttttagtagagacggggtttcactgtgttagccaggatggtctcgatctcctgacctcatgatctgcccaccccggcctcccaaagtgctgggattacaggtgtgagccactgtgcctggcctaatttttttgtatttttagtagagacagggtttcaccatgttagccaggatggtctccatctcctgacttcgggatccatctgctttggcctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaatacaaaaataattagccgggcagtggcgggcccctgtagtcccagctacttgggaggctgaggcaggagaatggtgtgaacccgggaggcggaggttgcagtgagctgagatcgcaccactgcactccagcctggtgacagagcgaggctccatctcaaaaaaaaaaaaaagaaaaaaaaagtgtttcttttcaccacatccacgccaacatcctttatttttttatttttaaattatggccattcttgcaggagtaaggtggtgtgttagtctgttctcacactgctataaagaacttcctgattctgggtaatttatgaaggaaaggaggaagtttaattgactcacagttctatatggcttgagaggcctcaggaaacttacagtcatggttaaaggtgaatgggaggcaggcatcttcttcataaggtggcaagagagaaaaagactgaaggaggaacttgccaaacccttacaaaactatcagatcttgtgagaactcagtcactatcatgggaacagcaagggggaaaccgcccccatgattcaaattacctccactttgtctctcccttgacacatggagattatggggattacaattcaagatgagatttgggtggggacacagccaaaccatatcagttggtattgcattgtggttttgatttgcattactctgataattcatgatgttgaacattttttcatgtttgttggccatttgtatattttcttttgagaattatctattcgtgtccttagctgactttttgatggcattatttttttcttgctgatttgagttccttgtagattctggatattagtcctttgtcagatacatagtttgtgaagattttctcctactctatgggttgtgtgtttactttgctgattatttatttaactgtgcagaagctttttagtttaattaagtcccatctgtttatctttgtttttgttgcatttgcttttgggttcttggtcatgaagcctttgcctaagccaatgtctagaagagtttttccaatgttatcttctagaatttttatggtttcaggccttgatttaagtctttgatccatcttgagttaatttttatatcaagtgagagatgaggatccagtttcattcttctccatgtgacttgccaattatcccagcaccatttgttgaataggatgtcctttccccactttatattttttgtgtgctgtgatgaaaatcagtttgctctaagtattgggctttatttctgggttctctattctgtgccattggtctatgtgcctatttttatagcagtatcgtgctgttttggagactatagccttataatgtagtatgaagtcaggtaatgtgatgcctccagatttgctcattatgcttagtcttgctttagttatgtgggctcttttttggttccatatgaattttagcattgttttttctagtagtgtgaaaaatgatgatggtattttgatgcgaattgcatagaatttgtagattgcttttggcagtatgctatttccacaatattgattctgcccatccaagagtttgggatgtgcttccatttgtttgtatcctctatgatttctttcagcagtgttttgtagtttttgtcgtagagttctttccaccttcttcattaggtacattcctaagtatttcatttttttgcagctattgtgaaagggtttgagttcttgatttgattctcagcttggtcgctgttggtgtatagcagagctactgacttgtgtacgtttattttgtatcttgaaactttactgaattcatttatcagatctaggagctttttggttgagtctttagggttttctaggtatacgatcatatcatcagcaaacagcaacagtttgacttcctctttatcgatttggatgccctttatttctttctcttgtcgattgctccggctaggacttccagtactgtgttgaatagaagtggtgaaagtgggcatctttgtcttgttccagttctcagggggaatgctttcaacttgttccctgttcagtataacgttggctatgggtttgttatagatgcttttattaccttaaggtatgtcccttctatgccgattttgctgagggttttaatcatatagggatgctggattttgtaaaatgctttttctttgttgagatgtcatgtgatttttgtttttaattctgtttctgtggtgtatcacatttattgacttgtggacgttaaactatccctgcatccctggtatgaaacccacttgttcatggtgaattaccttttcgatacgctgttggattcagttagcttatattttgttgaggattttttgcatctatgttcatcagggatattggtctgtggctttctttttttgttatgtacttccctgtttttggtattagggtgataatggcttcattgaatgatttagggaggattccctctttctctgtcttttggaatagtgccaataggattaataccagttctttttttgaaagtctgttagaattcagctgtgaatccgtctggtcctgggctttttttattgttgttgtcagttttaaaattaccatttcagtcttgctgtggtcagttcagagtttctgtttcttcctggtttaacctagaagggttgtatatttccaggaatttatccagctcctctaggttttctagtttgtgtgtgtaaaggtgttcatagtagccttgaatgatattttgtatttctctggtatcagttgttatatctcctgtttgtttctaattgagcttatttggatcttctgtcttctttttttggttaatcttgctaatgttctatcaattttgtttatcttttcaaagaaccaactttttgttttatttatcttttgtatttcttttgtttcaatttcatttagttctgctctcatctttgttatttcttttcttctgctgggtttggtttgttcttgtttctctagttcttgaggtgtgaccctagattgtcttatttgtgctctttcagactttttcatgcaggcattcagtgctgtaaactttgctcttagcaccactttttctgtatcccagaggttttgataagttgtgtcactattatcattcagttcaaattcttaaatttccattttgatttcatcgttgacccaacaatcattcaggagcaggttatttaatttccatgtatttgcatgctttttgagtgttccttttgcagttgatgtccaattttatgccactgtggtctgagagagtagttgatataattttgattttcttaaatatactgtgacttgttttgtggcttatgtggtctgtcttggaatatgttccatgtgttgatgaatacaatgtgcattttgcagttgttgggtagaatgttctgtatatatctgttaaatccatttgttgtagggtatagtttaagtccattgtttttttgttgactttctgtcttaacgacctgtctagtgctgtcagtggaatattgaagtccctcactattattattttgccctctgtctcatttattaaggtctagtagtaattgttttataaattgggaactccagtgttaggtgcatttatatttaggattgtgatattttcctgttggactagtccgtttatcattatgtaatgtccctctttgtcatttttaactgttgttgctttaaagtctgttttatctgatgtaagaatagctactcctgctggcttttggtgtctgtttgcatgaaatatctctttctacccctttaccttcagtttatgtgagtccttatgtgttaggtgagtcccttgaaaacagcagatacttggttggtgaattcttatccattctgccattctgtatcttttaagtggagcatttaggccatttacattcaacattagtattaagatgtgaggtactattctatccattgtgctagttgttgccccaataccttttgtctgttttttctcattgtgttattgttttataggccctgtgagatttatgctttaaggaggttctgttttggtgtattctgaggctttgtttcaagatttaataattcattttattacttctttagtgctgacttgatagtggcaaattctctcagcatttgtttgcctgaaaaagacttttatctttccgtcattaatgaagcttagtttcactggacataaaattcttgactgataattattttatttaaggaggctaaagataggacctcaattccatctggcttgtagattttatgctgagaaatctgctatttatcggataggtttttctttataggttacctggtgcttttgcctcacagatcttaagattatttcctttgacttgactttagataacctgattgactgtgtgcctaggtgatgatctttttgcaatgaattccctgggtgttccttgaccttcttgtatttggatgtctagatctccagcaaggccaggaagttttccttgattattccctctaagttttccaaacttttagatttttcttcttcctcaggaacaccacttattcttaggtttggtcatttaacataatcccaaacttcttggaggctttgttcattttttaaaattctttttcctttgtctgtgtcagattgggttaatttgattaggccttgtctttgagctctgaagttctttcttctgcttgtttgattctattgttgaaactttgcagtatattttgcatgcctctaagtgtgtctttcattttcagaagttgtgactcttttttatttatgattctatttctctggaaattttttcatccatgtcttgtattattttaaaaatttctttaagttgcctttcacctttctctagtgcctccttgagctgcttaataaccgacctactgaattctttttctggtaattcagatatttcttcctggtttggatccatcgctggtgaactagtgtgatcttttgagggtgttatagaaccttgttttgtcatattaccagaattgtttttctggtttcttctcatttggatatactgtgtcagaggcaagatcttgaatctgctgttcagattcttttatcccacgggatgatcccttgatgtggttctctccccgtttccctatgaatggggcttcctgagagctgaactgcagcgatggttatttttcttctgggtctagctacccagtggagctactggactccaggctggtattggggagtgtctgcagaaaaagcatttgccctaggctagaagtcttcctgctaagaaagcaagcagggctttcaggccttgcccttccatgcctgcagtggcttctgttctcatatctgtactttccattggccccctattcccgccggccccctattcccacctcctcccccaccccccacccagattctgcccaggaaaatttgcattcagtcaaaattatgacagcgttcagctagaagtctttctcactgtggtacttccctagttccactgactgccttccccaaggaccactgtgagatgaaagtaaaaaaaaaaaaaaaaaaaaaaaaaaatggcttccctagggactgggagtgtctacaggggtctcttatcgctgctgcttctagtttttgtttttgtttttgttttgtttttttttttaggtggagtctcagtctgtcacccaggttggagtgcagtggcgttgatcttggcttactgcagcctccgcctcctgggctcaagcaattctcctgcctcagcctcccaagtagctgggattacaggtgtgcaccaccttgcccagctaattttttttttttttgtatttttagtagaaacagggtttcaccatattagccaggcttgtctcaaactgggctcaagcgatccactcaccttggcctcccaaagtgttgggattacaggcatgacccaccattcctggcctgcttcttctacttttatatttcgctcagctctctaaatttgtttcagtcctaggtaaggttaaattcttctgtgatctggattttcaggttccccagtgaggatgtgtgtttggaggcagactttccccctctcacactttgggcactcacggtgttttggctgtctcatggagtttgcagcggcaagctgcttctttcaaagggtctgtgaattctttcagttttcctggtatgttcttgtggtggttcttggagcagagtttacactgtgagtctccacatgctgttttgtcctgagtgggagcctcaagttagtcctgcctgatatccatcattttctccgggtgacctcagtgaatctatatgtcccgttatctattgggaaaggcaaacctgtattttggacatagtgtattaattgataacattaggttaatggaattactataactttagtaccagccatatatccatttactcattcatttgttaactgattaattcaagtggttaccttctagtcaatattaatttcgccttagatatttttgttatggaggttaagaaagattttgtgcctgtcaacaataactctaaaatgtatttaatcattctctacttggttatattcataatcaaatcacatagacacttgtttcattctcatgtggtctgtgctaggttgacattctctgctctttcaaggactactctgcagaatccatggctttctgattgcaagtctctgcttctgttcaactgattgcagtatttattaagcttaaataagccaaaatattattacaatagaaaaaaaacttattctcttcattttgaagttcctaaaagattgtccatttctttaatttttaaaagcctcttcagaatactggttgatcattagtagcataccaccaccatgatatatttaacacttgctttttacatatctaagagaaataaaacattgtccctttcagtgagtgtcttacagtcttatatatgaacacgtaatttgatggtaaagattaagtgccaagtagacaataacagccatcagtattacaggtaatgataaacatggactgaagtagttgaagtaagatacaggccttgaccgaaaagtaggcagttatagatgagaggaaagaatattttagccagagggaatactatgaggaaaggctttgaagtaggaatctggacaatggatttggtaaaaaaaaaattttatagatggtttttaattagagcaggtaaatgactagtaggaggtaagactggagatgtagttagtgagtgaattgggacgacttgaatgccagctttacgagattaagttttatacgtagctgggaggaattaatattcatgagcagtgcatgatgcatttaaaggagtattttaggaagctcagtttgacatgtaaagggaaggtgggagacactaaaaaaccattgtcatagtttatgggtgaagaaagaaagagactcacgtgcattgagtactgtatgcctcccgctctgcaggagtgttgagagtggcatttggaatggaacagaacaagctgtctaaggcatataatgtaaagcaaaggcatataatgtaaagcaagagcagttaattgtgtgctgagctctgggtcaagtccatatttagaggattatagcaggaagtaaaccagcaagagtcagaggaaggaaacaggagagtgtctgaaaggccccagtggagataagaatttccatggttgagtgttatagtaagctgagagaatgaatcgattatttggtgtaaacttttaaaataaagtctaatactgtatacagacaagggcacattacagttatagagcttgatgaatttttatgctgtgaacacttcaccacatgttttactagtgctatggaagcttccctcatgcccacttcagttggttaaacaactctaaaggaaaccaatattctgatttctaccagattagttgtgccttcttgttggaatcagacagtagactcttgtgatagctcatttttctcaatattgtgtgtgagagtcatctatgttgcatttaatggtatagtatttcattgctatgtagtattctattgcataagtatacataatttacatattattcattgtactattatacgtatttgaattgtttccagttttgagctattagaaataatactgctgtgaacagtattcttaaaatgcatacatttctcttgggaatatatctaggattggaactgttgggtcatagttatgaatgtatttggtattaatacataatgtcaaagaatgtcagtttaccttcccaccagcggtatgagagctgtccacatcctcatcaacatttgatatctccagctttcaaaattttagctattatgctgagaggtataatagtaattcattgtgtttttaatttgcatttctctaataacaaatgcaggtgagcatctttccatatgcctgttggcattaggctaggctctgttgtaaagtgctggttggaatgtttttcccacttaaaaatctgcattgtctgttttaaaattttttctactttttactggcttacagggttcttacatattctggattcatataatttatcagatatgtatattgcaaatatctttctatactcctaagggtacattttgatgaatagaaattcttttcaatgagaccaggtacggtagctcacacctgtaatcccagcactttgggaggccaaggtgggtggatcacttgaggtcaggagtttgagaccagcctggccaacatggtgaaaccccaactttactaaaaatacaaaaattagctgggcgtgatggtgtgcacctgtaatcccagctactcaggaggctgaagcaggagaatcgcttgaacctgggaggcggaggttgcaatgagctgagattgcaccactgcactctagcctgggtgagagcgagactccgtctcaaaaacaaaaaacaaaacaaaacaaaaacaaaattcttgtttagtggaagctaatttattagtcttttcctttatagttagcgcttttttggtgtgccatttaatacacctgtgtctcttacaagtttgtgaagataacctcatgttagttttagaagcagtattattagatctttacagtttagatctacagtctgtcaggaatcgagtttaatgtatgatgtgaggtagagttcaatatttttcttcatttaaaaaatatatggacattcatttaatccagcaccatttattgaaaagatagtccattcccctctgcagtgtagtggcacctttgttataaacctggtgactgtaactcagtattgagaagtaataggtctgtggaggaaagatccagtcttgactccacagtgtgtagatgggtcttaaaaagaagttatatcctaatgaggagttaagttcatttgcagcatggttgatctgttagtaattgggaatatattatagaactgttttgctttctcccttttatttttttttaaactatggaagtaatttcagatttatatacaatttgtggaaatagtacatagacttcccatgtatccttcacctttattccccattgatagcatttctgaaccatctgggaataagttgtagacatgatgtcccattaccccttaatatttcaatgtatatttcttaaggacacggacaccgttctatcgggaagttaactttgatccatattaccatttaatccacagactccatttcagatttcactaatcatcccaaacctttacagctccaggagctaatcaagaccatgtgttacatgtacttaacatttctcttcattccacttcaatctgtaacaaacagttcctcagtctttcttaccttttatgaccataatatttatgaagagtatgggaccacagagtttttagaatgcccctcaattgagtttgtctggtgtttcctcatgatttatgcattttagcatgaataccagaaaaatgacttggacttaccttagtgctttctatgaggagacgcctgagattgacttgtcccatcagtgacgacttttgtcatgcggtgaggagtatgccaggcttctttgctgtaaagttaattaatccgtatgttttgttgttgaatagtaagtaataagtattttctgaggagacattttgagcctgtgtgtgtgtgtgtgtgtgtgtgtgtgtgtgtgtatacatgtatgtcttatttgtgctctttcagactttttcatgcaggcattcagtgctgtaaactttgctcttagcaccactttttctgtatcccagaggttttgataagttgtgtcactattatcattcagttcaaattcttaaatttccattttgatttcatcgttgacccaacaatcattcaggagcaggttatttaatttccatgtatttgcatgctttttgagtgttccttttgcagttgatgtccaattttatgccactgtggtctgagagagtagttgatataattttgattttcttaaatatactgtgacttgttttgtggcttatgtggtctgtcttggaatatgttccatgtgttgatgaatacaatgtgcattttgcagttgttgggttatggcttttaggcctcttaagtggatacttaagctaggaaatacctagtacttttttttttccttaagagaaaatacatcatgaattcattgtgatattttcagttaggatttaagactatattttcagttaggatttcagttaggatttaaaactacagggttttaggtagtgtgtttgattttatatttgtgtctctttatgctaaaaacctttgtttctgacattaattctttagtctattttatgtatattttatatatatataaaataattttataatagcaattgcagtgagacagggacgccaatattactaacagcatgattactaaaaatagtttatgatttatttgcagggtttaaaaaaatctttagaatatgtggttatttgactatattttaaagttatttgaaataactgttcttcgtatgattagggccaccaatcaattaggttttaattgctttgttttctttatagagattactttgtctccatttttatttaattttgtttgacttaagtaaaagcatattacttgttactaacaatgtgattactgaaaacaatttaagatttttttttctctttaggatctcatggctattttacagttttttaagtcttttgaaataattctctttgtggttaagtcactgtagatagatttagttccagttttctttcgattttagagattgctcccccaccccttttggatgaaattttgatttctgtaattatgcaaaaaattcatgttttcaaaataaaatctatgaaacagtgtacattcagagacatacagcttccattcctaagtaagttttttttttttttttttagttttgggtttattctttaaaaaaagtaagcaaatatatatttatattttcattttcacctttcttagacaaaagataatataaagcacacactatttggtaccttgctttttttcgtttaacattataccctacactgctaaggtataacctccgaggtatattaagtaaaataaaagaagcaaggtgtgtagtagtcttcctccttttatagctgttcagtgttttatgctatggacatttatataactgatgctgcattgatggttgtttaggttgttttcagtcttttgtttttatcgataatgctacttgtacgtatctttaatatttgctaggaatatattcgatgacattttagtttcaggaaacattgcttatatttactctgttttgttggttatagaaaaaattcaaaaaacttttttcattagataagtccaagaaccactgatgactttcttgccaatgcttagttatttaattaccaaagtataaataaaaatattcacagatgatgtttttaatgattaaatacatgcaagctttctggggtaagtaatgatgaaatgcagtactttaaaaaataatattcacggttagcaatctaagaatcatctgtttactatgttttgatagtaatgattgcacactcagattttttgtcattaatgtacagaaaacattgcaaaatcccaagattttattaggaactattttcttggttttttactttgttttcgcagttccttagaaaatcatacaggtggtccatccattcttaccttcttccatggtatttaagcgttgtataaatatagcttgcatgtttaattgtgaagatatttcacttgtgtgcctttaatgttttttttttaaacaggcagtataactccaactgtggaactgaatgggcttgctatgaaaaggggagagcctgccatctacaggccattagatccaaagccattcccaaattatagagctaattacaactttcggggcatgtacaatcagaggtttgtatgtcttttttggttttgttcttaattattattttatccatgttataaaagtttctcacactcaaaagagtattttcattgtaaatctaattgaccttgggcattgtgcatggaatttagataaagcaggttcacaaggaatatttaaattaataacttaaagaaacccagttttcaggaactagtttttttttttttttcccctaccccacaaacgtaaaagatctgaaggaactagtttttattgtgtcatgagggccctgtatttgttgcagggaagaccaagtcttaaagtcatttcacagtttatagtgttgactttctcattcatttaccaagcagagctcagtttttttcttgatttgtctaaatacattagtgaacatgaatgtttgtaatttatagggaaaaaagaaaaaatgtaaataatgtaatcccagaatttgccaccttttatattttcatgtactttacattctttttttctttgcatttaaatatatttaaccaagttgaagttgtcctttatatgcagtttttgtagtactttatgaaggtatgatagacatacagtaaaatgtacaaatcttaagtatacctcttgatgactttattttatgtatgtatatatgtatttatactttatttgatgactttttacatacgtatagcctcacgtgatcaccactcagatcgagatacagaatgttcccatcacctctgagagtttcctcagacctctttgtctttgacacatccttctcccagaaataatcactattttattatcatagactagtttttgcctgttgttgaactttttatatctagactcatacagtatttatgtgcatctggcttcttttactttgtataatgattttcttgtttggggattcatccatgttgcttatatctgggttttgcccttttttattgctggttagtgtactttgtatggatatatcataatttgtgtatcttgtatatgcaaaacaagcactctcttttcacttaatatagtggccatttgtcatatatttaagaatttttttttcttttctttctttttttttgagacgcagtctcactctgtcacccaggctggagtacagtggtgtgatcttgtctcactgcacccacagcctcccgggttcaagtgattcttgtgtgtcagcctcctgagtagctgggattacaggcacctgccaccatgcctggctaatttttgtattttagtagagatggggtttcactatgttggccaggctgggggtcttgaacttctgaccttaagtgatctgtccgcctcggcctcccaaagtgctgggattacaggcgttagcccctgtgcctggcacaaaatgattttgatggctacataatgcttcatatggcttcataaggtatataaatgtatgtctatttttttatctaggttgtttatgcccccttttttgttaagattgctgcagtaaataatcactatgtaaatctttgttcacatcactgattatttccttccttatattactataaggggaatattctttaaaaagaataaagcattgcccaattgcactaaagtttgtactaatttcttacagtatatgagaatgcttattctattctgagaacactgagttaaaaaggtttttgtcttctttggtagttaaaaagtagtgttttttttgtttttttttgtttgtttgtttgttttttagatgaagtctcactctgtcacccaggttggagtgccatggtgtggtctcagctcactgcaccctccgcctcctgggttcaagcgatttccggctaatttttgtatttttagtagaaacagggttttaccatgttagcaaggctgatctcaaactcctgacctcaagttatccgcctctctcagcctctcaaagtgttaggattgcagacatgagccacctcacgtggccatcaagtagtagtttttaaaattcaattttattgattactagtgaggctgaacagttttttttttagatatttgttatcctttttgatttgtctattttaatttgctgatttttattccattgcttcaccagttttcaaatgtttatgtgttgaggatgttaaccttcagtctattttgtttgttgtaattttcctgctttaaaaaatttggcttttaattgtgtatttgtttttaatatcctgtagttttaaaattttatgtggtcttatctattgatttttctttatttctctcacttcttttatgcctgagaaattctttcctatatttgatcagatatttgctggtgcttttgttatggttttatgtatttactgataccataacttagatgtgtagggaagatatttatttagtccataaataatctgatactttttggtttcttgcttgctaggggaaaaattatctttaattgtatccatttaaaacttagttctattcaattgtaaatagttcctttaaatattattgtttaggttctctaagaagaatttgcacactgtattagacttctgcccttcccttttcctctcaggtatgcctgggggagctttctctatgctaggaagggagaggcatctatatacctcacctctgtagaggcatcttgtgttgtcctttagttcctcttttctttgtggtcgtgtgccttgtccacgaggtgtggaaacttgcagttggtggcatctagtccgtctttttctcccttaggtaatgcttccagagtgtatctactatcttccccttgctaatgggcctaaaccctcagcttttcttggcttccttggtatatttcattctctcctgtaacatctctgcttctaattgtgatgcatacaatggcaggcttcccagccctcagcttggtgtccacaccgcataggaggcacaagggacaacacatttctcttgtagttgttttattttctctttctctgtataatatacgcattgcctttatgtttaatctgacgttccccaatgtaaataaataaagctagttgcccacttcaacacagtagatatctttagtcacctgagtaaggaacacctagcctattatatactaattttattgctaatgtactctagtaaatagatttatgagagtattacatctttatatttgttttattttggtatctgtggtcctttattgaaattttgctacagttctgactagtgaatttattacttttaaatggaaataaactacttttattacttctaaatttattacttttaaaaagtctggtgctaaagcaatgaaaagtcagacactaatccctgtccttatggagctcatgttcttgtaggggaggtagtcagtcaataagaagtggttagtcactgagaaggttgcttttgataaagacctcaaaggaagagagagaaaaagcagtgtgaatgttgagagagagagagagagagagagagagagagagaattccaggctcaagaaatagcaagtactccccgcagtagaagtgtgcctggcattggcctcaagaggccaatgtggcttgatcagagtgaaccaagggagagaggagttagtatgtgaaattagacagggatcatgtgattttgattttctttttttcttttctaaattttctgttaagaatgtcggcattttttctttgttggcagtttctagttccaagatctaattcttatggttgttgtgaggggtacaataattttatttatgatttctccaaagtcataaataaaggatgtgccttaggccattccatgaatagataatatggacttttccttttttggagtgtctttattttatgatattctgcagatcacaaaaaggtaaaaagaatatcggaaagtactagtaagctaccaagccatgtttcaactgaaaagctctttctgctcacagaagcgcagacctaaccattactcagtaggctgttacaaccatgatttctcatatttattttaatttatagatggcaacacttgaatggattacagggactctggagccaaagatccaaggagatgtcttttccttgtcagaacccagattaatcattagcttcttaaggcagggaatgaaaggtgaagtccaagaaacaggtatcatttagagggatttttgaaaaggtccttttattttctacttaaagtaatattaagcaaaattaggtattacctatgctgttttaccaccctctactgatgatgtttctccacttgaacttattcaaaggcctaagaagaactgaatttttcttcttttttaatgatgagtggagaaaaaaacatttatccatgagcaaactctgtagatacaacttggattctgaagtacctgtctccttttattatgcccaagatgtttgacaataattacatccggttatgtatttttctttatcatttgaggcacttttcactaacagatatattatgaagcagaaagcatataaaaattcatttgacaaagtacaaggtaaagcttggagaacacttcgtgcttttgttctcccatctttcttataaaaattatgtacattagagaaatagaatggctgaatttagacagtttttcaattttgtatattcacagataaaaaaatattattgcttagcaaatggccaaaatggcagaccagcagaccaaatggccccttgatctgctggtgtagatttccatggggccaaaactcaaactaggttatgtgcaaatgggaatttttgagctatgtaactgggatatctcttggggagatgtacaggcatagttggatgtagggctttagtgttgttcttcctcattttctatttctctctttctagctcttgtttctttttttctctactttgttttcaaataagccaattcccatttgctatacttcatacactgtatagtctgtagacttgtagtgaagaaggtgaagttttttttttgatagtcattagaaaagtccccacaaacacttggagtaaactgtccatcctggaattaatcattcaaacttggttgggggtagggacatactttactttagccaagcctgggttatatgtccaacctggagaaacaggttagccccatccaaactactccgcagggtacaattattttatggagcggttcctcaaaagcaaagatttttagagaaaattatttccattacagtcagaacatttggttcagttcctagttctgatgcttttagttaagtgatcttgcacaaggctctggacctccattaatttcctcatttgcaaaacagagatagtaatagcaaatgaaggactttcgtgaggtcatcttcattcagcagacatttattgcatgcctactcattgccacatgttgtgtttgagtagagactttgaggaaagacaggcagtctaatagacttaagtttagtagaagaggaaaacgaaagaacagaatgatagatgtgccccgatggtgctatggaaacattaggaaggaactaagcaccccatccagattggggcaccaaagaagccttccaggagggatgaactgaatcttcaaggttaactaggatttagccaggtgaggagggcaaggaaaagtaatacagattttggcaacaaaggctaggaatcctgagaagtttagttcattcatggacttagaaacagttcggtaagtctggaatgagaagagtgaagtctaggcagggccccgatttgaatgtcctgaattgtccatgccacgaggtttggattttattctgaaggtgattgggagtcattgaaggattttaagctgagggataaaataattggatatatgttttaggaatattgctttggcaatattcctaaaacttgaagggataaagaattacgacaatgttgttgtaattcaggcataatgtgatgcaggcctggaatagtgcagatggagaggaggggacagtgtctatagatatttagaaggtagacttgattgcatttggggtattaaggataacttcagatatttggatggctagtaatactgttcaccacaagagtagttggagcaggtttttggaaagatgaagagtttaatttgcactatgttgcatttaaattgcctacgaagtatttaggagtcattttatcactctttatggccacaatgaagggtagcaaagattatctttgactttaaagacttgttggaagtagacgtggcaagaggtagtataacatctagagctttcagaataggtttgtgtaatatatcttaagaaaatggcagtttaggattcaacccaagtttgagtgacctatcagctctttgttcattgaaggtgtatcctttcttccccaaagggtttgtttatttgttaacactcagtttggaacaagtttatggcctacattctcattagatgtgtttagtatattttatgtcaaggttacctttagctaatgtatccagttcttggcccaatctcttatagctaggttggtcaagttattttcttttaatatatgttgagtcatagcaagttaaacaagaagaaaacaatttggactattttgcctgaatgttacttgtttctatggccagaattagacacttacttaaggcttcttggtttttcattgtacccctgtgaaataaatctgtgagacacggaaatcattttacagatagtgatggctatcagtggaaatttgatagggcgaaagaagttttttgaaacatccaaattgacttgattgcattatgttaattatcagtaaaattaataatagccaagattctgatttatgaaaacagcttgtttattacatttcagtttatgttatataggctgatgatttgttgctaagtattgtgatgttggtgtgctatttattctgaggttgttcaaactttgcatataagatttttcactcatttgtaacaccctcttaaaaagcatattggaaagtacaacagttgatgttgaatattcagttggcccctcgtatccctgggttctgtatccatgggctcagcattcatggatccagccaattgtggattgaaaatattcaggaaaaaaagggtggttgcatctgtattgaacatgtacagacatttttttcttgtcattatttcctaaacaacgcagtgtaactactattttcatagcatttacattgtattagatattataagtaatctagagatgacttaatgtatatgggaggatgtgcataggttatatgcaaatattaaaatattaatattttatatcagggacttgagcattttatatcaggggcttgagcagccatggattttggtatctgtagggggtaagggtgaaggtcctggaaacaattccccacagataacctagggatgactgtatttgtaccagcagtgatatgaacagttacaaacctacagttttggtttctgccaccagatggtgcttgtatactgatcaaacaacatacagactgggtgagctcactttggttactattccaaggccattaaattagaggttaaaccgtatgaaactgccaatatttgacgtttctttgacctacaaatatgtcagtttcatatgttcaacccaataggaaaaagtcatccaagtatacaacattaaattctcttggataaatgaagtaagcataaagtggtgaaaagcccaatttgtttcaatagatatagaactttgccttttgtatactacatcccttggtttggggaatatattcttttctcttttctcatatgctttacacatggaatgtgtgtcagaactcttaaactgattctacttcatgtagatatcactttatagaatagatgtagaactgaaagataggcagcaaggtaactttttaaatattttgttaaaaataatgttaaattattaacattaatgttaaattaggatttttttttatttgggagaaattaacctaaacccataacaaagacgcattagaaatgtctttttaaaactctcataaaccagagaagaaaatttgaacaagttaccaaagcaaggatgaggaagagtgaacttaagatcagtatcccccatggtcacagatataaaaattattattattattttttgagacagtcttgctctgttgcccaggctggagtatagtggcctgatcttggctcactgcaacttttgcttcccaggttcgagcgattctcatgcctcaatttcccgagtacctgggactacaggcgcatgccaccacacctggctaattttttgcatttttggtagagacagggtttcaacatgttgcccaggctggtcttgatctgcagacctcaagtgatctgcccacctcgtcctcccaaagtgctgggattacaggcatgagccaccatgcccagccagataaaaattcttaacaaaatatcagcaaattaaattcagccgaatttaaataacattatgattaaatgaagtttattctaggaaagcaagatgaatttagtattcagtaatcaaagtaattaacccaattaatagaataaaggagaacaaccatatcagtatctcattaggtgcagaaaaaacatttgacagaagtcagcgctcactaatgatatagactcagcaaactaggaatggaagagaactttcttaatctgataaagggcttcttcaaacaacctccagataacattatgctttatagtgaaagactgaatacttgtaagatcaggaacaaggcagtaatacacactgttatcacttctgttcaacattatacttaaggactggtacggtggctcatgcctgtaatcccagcactttgggaggtcgaggtgggcagattgcttgagcttaggagtttgaggccagcctgggaaacatgaccaaaccccatctctgttggcgtgtgcctctagtcccagctacttgggagactgaggtgggaggattgcctgggcctgggaagtcaaggcttcagtgagctgtgatcgccactgcattccagcctaggcaacgcagtgagaccccacctcaaaaaaacaacaaagaaccccacattatacttgagttctatcaagtgcaacaataagaagaaacaaatgggggaatattggaataggagatataaaactatcttcatagacaccatgattctgtatgtagaaaataataaatcaaaagtactgaaaagctactgaataagtgaatttagtaaggccacaagttgcaaggttagtatacaaaaatcagtggtatttctagtaaatagtaatgagcagttggggaattaaatagcgtgaaaacatattcagagataaatttaataaaataggtacacaacctgtataatgaaggctataaaatactgctcaaattaaagaagactctattatttaagatttcagttctctcaaagttgatgtgaagatgcaatgcagttgtaacaaaaatcatagtagagtttttttttttttggtaaaattaataaagtagtgctgacatttggagatgcaaaaaaacaatttggctactgcaaattgtttttgcagtagccaaagcaattttgaaaagaacaaaattggctggcccacactacctgacttcaagatttgctataaagctacaataatcaagacagcagaaaattaacatagggacagatatatggatcagtggaacagaataaaacagcagttggcaaactatagcccatgggtcacgtctggcttgcctgtttttgtatggcttgcaagctaagtaatgttttttacatttgcaagtggttggaaaaacatcaaaaataaaatgatattttacaacacatgacatttagatgaaattgaaattctagtgtgtgtcagtaaagtgtcattggaacacagccacagtcacttgcttatgtgttgtatatacttgcttatttatagtctgcttttgtgttacaacagcagagtcgaatagatgtgatagatcatatggcctgcaaagcccaaaatattttatattgggccctttacagaagtttgctgatctctggaatatggaggcaagaaatagatcaatccatatatgaacaatttaattctttcaaaattaattccagtgaaggtgctaatggggaaaggatactctttccaacaaataatagtaaaataattggcctttctgacagaaaaaaaaaagaacctgggctgggcgcggtggctcatgcctgtaatcccagcactttgggaggctgaggcaggtggattacctgaggtcaggagttcgagaccagcctgaccaacatggagaaaacctgtctctactaaaaatacaaaattagcctggcatggtggcgcatgcctgtaaccccagctactcaggaggctgaggcaggagaattgcttgaacccgggaggcagaggttgtggtgagctgagattgtgccattgcactccagcctggcaacaggagtgaaactctgtctcaaaaacaacaacaacaacaacaacaacaacaacaaaaacccctgaaccttgacttcacaccacagacaaaaataaatcagaaatgggtcatagacatatatgtaaaagttaaagtaaaatttccagaagaaaatactttgctactttggaaatagacaaagatttcttagaacacaaaaagcacggatcatgcaacaattgagaaattacatgtcatcaaaatttaaacatggatcatgaaaaaattgagaaattataagtcatcaaaatttaaacttctggtactagaaagacactttttacaaaatgaaaaagcaagacatatattagaaggaaacattcgtaatacatatatttgaaagaggacttcagaatatataaaggaatacctacaactcattaataaggcaaaaatggacaatatttttgaatagacaatagagataagaatggctaataaacacatgaaaagatgctcaaagtgattagtcatcagggaaatgcaaattaaaaccatagctaaagtttaaaaagactgacaacacctagtgtcatggtggggcaactggaagtctcatatattgctgctggggatataaaatggtacaggcaccttgtcagagtttatgatgttcttatgaagttaagcatgtagtacttatcttaccacccagcaattccatgtggtatttacctaagataaatgaaaatatatggccattcaaagacttatacatgaaagtttgtagcatttttctttataatagccccaaattggaaacaacccaaatatctaccactaggtaaatggttacactgtaatgtaaccatgacttggcatactattcaacagcaaaacttgtgattcatccaatgatatgcatgaatctcagaaacaatatgctgagcaaaagaagacaggacagatacatagtgtaggtactgtaagattctatttttgtggaattctagaataggcgaaactaatccgtagtgacagaaagaggttctttgattgtctagatttggggctgggaatttcctatacaaggaaagttttgggggtgatagaaatgttctgtattttcattttggtgattgttaatatgagtgtatgtcaaaattcatcaaactctgagcctaaaataggcacatttcattaaatgtaaattttacctcaataacattgatttaaaaaataacattttgtaatcctccattttctttgaggctaaaaatatttataagaaagcgccagatttttgcttctcaagcatttggccaaaaacattgtaaatgtttttctagaggttaaaataatatttaccttatagggtgtttgaggacagaatgataggctggttcagttgcttagcttctgcctttgtgcactgattgttattataattgttagcctttattgcattttagcttgtttagttacaagtacaaactctggagttggaatcatagttatgtggatttgagcaggttattcgacttctaattctcggttaattcacctgtaagttaggagaataaataacgcttccttacagtgttgttttcaggttttaataaagtaattcagtgaccatgcatgaccctttaccttactttactgtagtgttttgagttcctttaaaagaatctaaatatcagtgtatttgtactggacattgttactgtgggagatttaaaagaatttacatctgcttaattaaaaaaattaaatcaggctgtgattctgttattatttctgggtgtatgctttataggaggaatggctgattctctattgcatatggatatttttggcccgtgttaaaatttacttgaccctggaataatgttacccagagaatcatttctcccttagaaaactgcgcatatcaggagttattaagttaggatttaaacatgagctttggaaaatctgtggcctttgtgtaattatatgcagcattttatacacatacctcttctgccttgtctagcttgatagccattcaagctggtctttcagctttctcagcgttcattcccaaggaatatctggtctgttttcttgccacagagttagtattcaagtactaataacttggtaatacatttaccatgatagaacttcaggactccatgctcctttgttctgcttttagaggcagccaggcaggcccagggatcaccacttaatcttggtcctgagccggtgtctcgctctgtcacccaggctggagtgcaatgatgcgatctcagctcactgcagccttcgccttcgggttcaagtgattctcctgcctcagcctcctgagtagctgggattacaggcatgcaccaccatgcccagctaatttttgtgtttttagtagagacagggtttcaccatgttggtcaggctggtcttgaactcctgaccttgtgatccgcccacctcagcctcccaaagtgctgggattacaggatatgtcacacaagtttaacatttttcatatcccctttagacaaaaacaaaagcataagtaaacagagccaattcttaaattaaaaaatgtctataattttgggttgaccttagtctgattttcatttggtcacttttttttaatgctattgaaatcctttttgagttctttatgctaaaagtttaagcattattctctacaaaagtgaatataaacaaagtggcaacaaagaagataattaccgtaagtttttctcccctcaagtttgttgcgattatttaggaaagatatagccatgacttaaatctgattaatactgaattcgtaatgtttttacaacaaggggtctatctttctagtcctaaagttatttaaaaattttaacaacttttgtctagaaagggagaaataaatagcattctctattcttttatttgaggctagttttattaatctgttgctcaagctctgaaaaatacttggtttattttgtgtttgaagcaatgctctttcaccaatatctttatttttttgttcagttgagcaaaatcttgcttagcaatgtttatttacttgtgtttaaaaaaaaatctgggtacaatgacagtttaaattatgaagctcttctttttttgagacagagtttcgctcttgttgcccaggctggagtgcaatggcgcgatctcagctcactgcaacctccgcctcccgggttcaagcaattctcctgcctcagcctcctgagtagctgggacaacaggcatgtgccaccatgccaggctaattttgtgtttttagtagagacaggttttctccatgttggtcaggctggtctcgaactcccgacctcaggtgatctgcccgcctcagcctcccaaagtgctgggattacaggcatgagccaccaagctaggccatgaagctctttttaatatgtcatgtgacatataaatacgtgggctttcagtattcagaattctgaaaggtttatataggttgccagtcattgctctaaaaattccgaaaaacttttgaagcttttttttctgctttgttttggagggttcctttatgaatcaaaaaacgttatccaccagctgtttctccttaatgctcaatcactttttatgcattttcttcaaatactgattttcagtgaaggttttgtgaagttttagtgtccgttggatttagaaagcaatttaagtatggttggtttttttttttttgttgtttttgttgttgttgttgttgttttttgagacggagtttctctctgtcgcccaggctggagtacagtggcttgatcttggctcactgcaacctccgcctcccaggttcaagcgattcttctgcctcagcctccagagtagctgggactacaggcacgtgccaccatgcccagctaatttttgtatttgtagtgaagacggggtttcaccatgttggccaggctggtcttgaactcctgacctcgtgattcacccgcctcgggctcccaaagtgctgggattacaggcatgagccaccatgcccggcataagtatggtttttaaaacaaatttgctttgactattaatgagggtttatgttacatgtttatagaagtttctgcaataacataatttcttggaaatgtaatattgtgtctaataaattctgggtaagattttgggtgatcatcaaataggccttgttccaaactttgtttttatgttgattactggaaacttggaatgtattttctcatagaaacattgtgataaatggtggtgaacttcccaagataatttttttttttaaattgagatggagtgttgctctgttgcccaggctggaatgcaatagcacgatcttcgctcactgtaacttcccctacctgggttcaagagattctcatgcctcaccctcccaagtagctgggactacaggcgtgggccaccacgcccggctaattttttaatttttttttagtagagatggggtttcaccatgttggtcaggctggtcttgaactcctgacctcaggtgattcgcccacctcagcctctcagagtgctgggattacaggcgtgagccaccgtgcccagtcccccaagatagttcttaaaaccccgtgttactgagtgtgactattgtgccttttaaatattttttttttttaatggagtgttgctctgtcgccaagctggagtgcagtggtgcaatcttggttcactgcaacctccgcctcctgggttcaagcgatccttgtgcctcagcttccctagtagctgggattacaggtgtgcgccaccacacccagctaatttttgtatttttagtagagacaaggtttcactattttggcctggctggttttgaactcctgacctcaggtgatctgcctacctcggcctcccaaagtgctgggattacaggcatgaaccactgtacccggcctctgaattctttttagcaaataaagttgtcattgacacctaaacctggtaaagacagtacagaaaaggaagttgcagtctaataccaatataaatatagaagaaaaaaatgagcaaataaaatctaatatgaaattagtaataatatataccttctaaaaatttatgttgaatttaattcattcatttgaatacgtttattgctataactgttgaaggttatgaattctccttcgaccattgttttacatttgtactatagtttctgctatgtagtatttttattattctttcagtattgattttctagtttgtattttccctttcatgtacaaattacttaataaaaggtttatttttcaagtagaagggccctttgctttttaaaattttgttattaatttctagtttgttatattttgatttgagactgtaatatctccaccttgtggcacttccttatgctttctttgagatcaaatggaggatcatatgtacacacatatacagcataacatcttctgtaagagtttgttgctttggtcttttatatgtttttttgtccacttgatctgtgttgtactgagagtgatgtgttaaaatctcttagtatttgtgtgcttctgtttatatctccttgcatctcctgtagtttttggcttcaggtggctgctgcattatttggtgcataggtattcataactgttatatatcactgaagaattgcaggttttagcattaatacctagtgttcgccattaatacctttttgcttgaactctgctttgtctgatatcagcataacaatcactgctttccgttttcattaagctagtacaactttttagcttttctctgtttttggtgtctcttgtatgtagtgtatatttgggccttgttttatgagacaaatttaaaatcttttttgtttaagcctgaaatgtatttgagttgagaaataaaggcagattttgatttggcatttggttgacagcgggtgtttaccataaattaaatgagctgtttgcagctctaccatttgggtaaaatatatttgaagtgtatgataagatcaaaacattttataaaacaaatgttatttcagcaaaaggatattggaattaacaatattttgatgttttctacccttttggactatataaaattaaactgctaagggaaacaatagcaggtataattcataatcatttgataagtcatagtaatactgttttggaatatttcccagaaatggagaatctgaataattgtagcaaatgtgtaatgcatcctttgtaagtcaggtagtttctggttacttgctttcagcaaattgtgagaggacttaacatcaattgccacgtcattaaaaataatttctgatggtagatcacagtgtgtgttttggcatagaaaaaattgagtgaccttgttataacaaaactcagagtgatttagtttttaatgtgaattacatttcttagtgattatacctgaaataagtgaaataagagtagaattgagaacttatctcattttagcagtaagaaatattctttcttagatacatcaatataaagaaaaaaagctctgtaaatgtcagtgagtttcatgtccattaatattttactttttgtttaaaaattatgtggcctggcacggtgactcatgcctgtaatcccagcacttcgggagactgaggcgggcggatcacaaggtcaggagattgagaccatcctggctaacacggtgaaaccccatctctactaaaaatacaaaaaaattagcccagcgcagtggctcatgcctgtaatcccagcactttgggaggccgaggcgggcgaatcacgaggtcaggagattgagactatcctggctaacacggtgaaaccctgtctctactaaaaatacaaaaaattagccgggtgtggtggcaggcacctgtagtcccagctactcgggaggctgaggcaggagaatggcgtgaacccaggaggtggagcttgcagtgagccgagatcgcgccactgcactccagcctgggcgacagagcaagactctgtctccaaaaaaaaaaaaaaaaaaaaaaaaaagatgtattaaaattataatatttgtttcattatctgctaataatttcaataatggctcattgcacaaaatattttctaacttacatggaagtacaaactcctataattttaattaatatatctatttttgttgcatagaattatggtagaatgaggaataaaagacttttagttataaaatatgaaattaggatgaaatggagagagtgcagtaaaatgcaagttaaacaagatacagctggtgtaaaatttctgttgtatttaacagaatttatgtattttttgagtagataaaggtggatgtcagcttgctatgatagttcagtttttggatacacttaaaagagtgacataattttattttaaaatgtaaatatttacagtaaattagaaactacatcctttgcaagtacttaatgaaattttaaaaatgtgaattaaaactttagctgtaagaagaaatatgcaagaatatgtgtaactttctaaaatgtttttgtagggtacaagcattcaagtttgaacactactgccatagatttatttgaaaaagaagctaagttagagatggctattgcagaatgcagaagaggtgtacatttttatcctgatttacacatgcataggcaaatgtggtggtttaagaaatggtttgggccgggcgcggtggctcacgcctgtaatcccatcactttgggaggccgagacgggcagatcacgaggtcaggagatcgagaccatcctggctaacacggtgaaaccccgtctctactaaaaatacaaaaattagccgggcatggtggcgcgcgcctgtagtcccagctacacaggaggctgaggcaggagaatggcgtgaacccgggaggcggagcttgcagtgagtcgagatcgtgccactgcactccagcctgggcgacagagcgaaactccgtctcaaaaaaaaaaaaaaaaaaaaaaggtttgataattaaaaagagttcttttttttttttttttttttttttgagacaatcttgttctgtcatctaggctggagtacagtggcatgatccacggctcagtgcagccatgaccttctggtctcaagtgatccttccacctcagtctctctagtagttgggacaccatgatgtctggctaattttttattttttgtagagatggggtctcactatgttgctcaggctggtctcaaactcctgggctcaaacaatcctcccgccttggcctcccaaagtgttgggattacaggggtcagccagtgtgcctggacagttaaaagggtcttgagcttgaacatagcagtcatagttaagtttttgggctcagttataccaaaaattgaaatcttatttttcttttctggtatataatgtaatcctcccatttataaaataataaaattgtatttatcaccttactactatgtataggtaaaaatatttatcttgaaccattagagggcagcacggttttatctttgaaattagctttcacaacatgtaaatgcttttgagtcacaggcttaatataagcatgattaaaataaactatgaaattttaagttaaaattaaaatatttcatttggaatttttgtaatataaaaaatgtggtagcaagataaaagtaagtcatccttttattttttccctccccttccctcttcctaaccacattagaacttttacaaagtttgaaaagctatacaacttgattctaaacttaatatttaccttgattttcagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaactgatattatagtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttccaaaatgagaagatttgctagtaagtaatgcatacttctatgaaattatctgcctgagtttgataattttatttatataatttcttttttttcccccttccaatccttcatggttttcttttttacacacaaagcctacaacctttactttttccaactggaaaaccagtttttccaacactttttaaaaaacaaattacccttttatcatatgctgaaagccctccctataacaagcccacttctgcgtttgactctacactgacccttcatttacttcctaaaccaacccttttggtaacttttggtgaagaggtggctttaataaatatattctccagaaatctccagaacctttgcgtgggtcagggtgagaggtgcctccacaatgtaaacagaacagctgagttctctgggtaggtgccaggtgcaatctgcacagacctgtatgggaggcctggagtcagaggcatttcctcaaaatgcatcccttctccggcagagcacaccaggccccagggccccgtggacagggctggtcccagcgtatgcatgccacttcctgggctttggggggtggtacgccagaggctgcccacagcagcaggcccactcagaggccagggcctcttgttccacttgcagagaccccagaaggagccaggggacagcatcagagtctggggcccaggcaggggtgcccaagggcacagcaggtgcaggccattggcaaggccagaagacggtgagtggaaagccaggggtgcgtgcagtgactccgagaagaggctgttcagctgggagtcctgcatttgccgttcgtgtttcatgcggcgattttgaaaccaggtttttatctggacctccgacagctgcatttccctggccagcctcttccactccagagggcccaggtactggtggtgctggaagatgccctccaagccacggacctgctccgtggtgaaggctgtgtggacacagtggggcccgccaggcgtttggccctttcctcaacccagccatagccctctctggcggaggcagatttgaggacctagcctccttgatgctgacggcctgagggggctcctcggggcccgatgcctggtccgggccagggaggctccccagggagacctcggcaggcctgggggtgtgggtcggccctgagcagctgctttgggagagccagtccacggagccaaagctagagggctgctgcccgccacaaggtggggaggaggagggacgcatggccgggcagggctggccaggggcaggatccaatatttatatcatttcctcaaagatgttcctttatcgacttgacgtttttgcttggcattacttctattctcccatttagagtccttacatatatatttttctgttcttctattattgccctttattttcagagtctcttcttgggaactgaaaaggaaactttcttttggaacttttgatttctaggtgtaagaacttctgttcactaatttgatggaaaaaaagaaataggattgcacagtatttttctttagaaggaaaaaacccaccctttttgtgagttgtagatcaaaagtcaacagagaaatgttggttccacattaaaaatgtcctaatacgtattaccgtctgatgtataagtagcaaatattctacctttaatagtgtttagttagagatgggggttatcatttgtcaggaatattaaagagaactttctttggtttgatatagatgagtgacttttaaaacatttttgactctgacctttgctaaggaatttttaaaaataatgtgacccagtatataaatacatacctacatccacacacatatacatttttacatatatcactaaaacaaaaaatttatgatacgataacatctgtattatactctaatattttctattttgttttattaaaaaattacagttgtggtttattaaatttatttcatgacctgttaatgggtcataatttatacttaaaaaaaatttaaatgatttccaaggtttcatccaacataagattctatgttagcatgactctatgctctcatagagaatcaaagctcatcatagagcagctgggaccatgttaaattaggaatgataatagaaattctcccaagacatctggatattcagttatccccatcatatctggaagtccagtgtcaccagttactcaaaaagtacagaatctttgaataaaatctgcgatttacttaatactgttgtatcaatgttcagtttccagttttgaccagtgttactgtgtttttgtcagttgctaatgttagggaaagctagatgaagggtgtgtgggaactctgtgctatctttgcaccatatatatatatatatatatatatatatatatatatatataaaattatatagaagacatatatactaacttataaaaaattaaatatagaagagcatctttgagtagtgtgctctcaaagatatctaaaaccttctcaaagacatctaaagcgttgtgtttggaacttttgttgtgatatattgatgataatatcatacaaactgccctgtccatcatagtacattttaatatgacttttataagtaagagaaagaagcttagtgagcagtattaaagttgagtttgttaatcctatttgatagttacttgacagttccttttaggagtttagaactaggagaagaattagtagaataaattcttcagagaagataccaaattacagagtgggggctggtattatcttttttataatttctattgtgatggaacaaatataatgaggaataggtgagtttagagataatttctagaaaattgcaaagatcagggtcggcaacctggacctctgtgttgagaaaggggtaatggggagcagtgttagtcaatttaaatacaaatagaagtctttacttaaatggtaagcaagaataatgatctgtatgaagtgatgagacgttggaaaaatgccacttattggatatcaaaaaaatatttttaactggctgagttagaaacaagaatatgggatgtgcagaatgtttggaaatctcggtctttgttttgcatctctgaactattacaccattgaactactctttcttggcttgatgcctttagaaactacatattagcttcatcaaaaagctcttattggaggctggcctggtggcccagcactttgggagggcaaggtgggaggattgcttgaggccaggagtttgagaccagcctgggcaacatagcaagacttagtctctacaaaaaattaaaaaataagttgggcatgtggtgcaggcctgtagtcccagctactagggaggctgaggcaggaggatcgcctgagccaacaagtttgaggctgcagtgagctatgatggtaccactgtactccagcctgtgtaacagagagagactgtgtctctaaaaaacaaaaacaagaaaactcgcatttgaaaaacaagacacaactgaaagactccaaacctaacccttttcagaaaatcagaggataaccatttacagtaaagaaaaagggtaattttaatggcagaagttaaaagttcaaagaaaattgcatgttgggtattttttgtatacttatcaccatgctgacagcagtaaggtgattcaagggaaatacatgaaattgttcctgcccataggaatgtgtgttaccttcagggagataagatgataacagtaaaagttatgtagtctactgtgtgtagaacactgccagtttctttatacacagacgtggtggttctccaaggtatatatattttatccctgttttagttacgaagaaacagagactcaagtttaatttgctcagtatcatttatgaagtaagttatagaattggattataaatctatttctgcaagactcaaacccattttacaaaataattttgttattgggtattttggatactgtgaagtaaaacactcgaagcctcacttcagaacgtattttttctagaataaaaatcaccatgaaataaaatcattcaagaaaatactaggaatggtagtatatgtgggatgtaaattttcaagatacgtatttggaaacttgagaatgtagatactgctaattactattgatttagttattctgtcttccttttgaaaaatctttttatttagaaataattagagattcactgaaagttgtaaaaatggcacacagaagcccatgtactctgcactcagtctcccccattggttacattttacagacttgtaggacaatatttcaaaccagtatactgacattggtaaatgtatgtgttgtagttctgtttcattttgtcacatgtagattcatgcaagcactgcagcaatcaagatgcagaactcggccaggcatggtgactcatgcctataatcttagctcttttgaaaggcccaggtgggacagatagcttgagaccaggagtgtgagaccagcctgggcaacatagtgagatcctatctctacaaaaataaaaataaattagccagacatggtggtacatgtgtgttgtcctggctacttgggaggctgaggtgggagggttgcttgataccaggaatttgaggctactacgagccatgatcacaccactgcactccagcctgggcaacagagtgagactgtctccaaaaaaaaaaaaaaaagatgcagaattattctgtcaccacaaagctcttccttatgttgtcccttaactactcttctcttcacctctgctaccctactatctctagcccttggcaaccatgaatgtgttctccatctctatgcttttgtcatttcaagaatattacataaatggaatcatagtatgtgactttttgaatagtattctatgtttttgagtagtgttctgtgtaccacagtttgttgaacccttcacctattgagggatgttttgtttttcttcagtttttagctatacatataaagctgctgtgaatatctatgtatgggttttgtatggacataaatgtttatttctttgggataaatacacaggagtgtgatacctcagttgtgtagtaaatatatgtttagtgttctaggaaactgctacactattttccagagttgctgaactgtctggcatcacaatcaggaatgtatgagagattcagtttcttctcatcctccacagcatttgtggttgtcactatttttattttggtcattctgatgtgtagttatatatcattatggctttaatttgacatttccataatggttagggatgttgaacatcttttcgtgtgtgtgtgtgtgtgtgtgtgtgtgtgtgtgtgtgtctggctgtgtgtctttggtgaaatatctctgtcttatgcacattttctataaaattgttttttttttactgttgagttttgagagttttgtatatattttagatataaatcctttgttagatatgtggtttgcaaatcttttctccctgttcatagtttgtctttccatcctcttaacatagtttttcatagagcagaagttttttattttgatgaagtccagtttatcagttttttttgtgagtgtgctttgggtatcaagtctaaatctcctcaccaaatctagatccccaaaggtgttctcctaggttttcttttaaaggttttatggtttacatttaaatgtacattttgaattagcttctttttatcaggtgtcatgtttaggtcaaaggtttttgtttcggttttttgcctgtggttatccagttgttcagcaccatttgttggatagctctccttcctccattgaattgctttttcacctttgtgtaaagacagttggccacactagtgtgggtctgtttctgggttctctattacgttctgttgaactctgtgtctctgccaactcctcacagtgttattactgaagttacataataagtgttaaaataatatagagtggtttcttatgctttattctttttcaaaattgaatactctgctttctttgcctttccatgtaaattttagagtaaatcttttcttgtatttttactttcaccttccatgcatttattgctggtatgtagacctacatttcaatttttgtattttgatcttgtgtcctataaacttgctaattcacttattagttctaggtaattaaaaatatgtttctttctacacagacaattatttcatctttaaatagggacatttttatttctttgtttctgatctgcttgcctttcattttgataaggtttggatctgtgtccccacacaaatctcatattcaattgtaccaatgttggaggttgggtggggtgggaggtgattggatcatggggatggtttctcatgaatggtttagcaccatccccttggtgctgttctcgtgataatgagtgacttatcatgagatctggttgtttaaaattgtagcacctccctcctttctctcttcctcctgctttggccatgtaagatgtgcctgcttcccctttgccttccaccatgattgtacatttcctgaggcctcccagaagcagaagcctcaatgctccctgtacagcctgcagaaccataagccaattaaaactcttcttataatttacctggtctcaggtatttctttatagcaatgtgagaacggactaatacgtgtttcatttcttaccttattgcactggctagatcttcaagcactgtgttgtgtaagagtagtgggagtggacctccttgcctcattcttcatgtacaaaacagtctttcaccattaagtctgattttaggtgtagatttttagtaaatattttaaatccaactggacatgttcttcttcctagttttttgagaattttttttatcgtgaatgggtgttgaattttgttaaatgttttgctgcatcaattaactgatcatatgatttctcatttttgacctgttaatgtgatagattacattgattgaattttaaacattgaaccagccttgtatgcttgcaataaacgatacttggtcatggtctaagattctttatgtatgttgctaaattctacttgctaatattctattaaggttttttgtctctatagtcatggacgatatttgtctgtagttccccccaccataacccctttggcattctttttctgatttttatatcaggatactattgtactcataaaaagagttgggagacattctctcctcttctgttttctggaagagattttatagagtagacattacatctttaaaagtttggcagaattcttcctgaaaacacccacaactggagattttcttttttaggagttttaaatgtatgagttcaatttattgaatacttatagggcttttcaagtcatcttcatattgggtaagttgtgatagcttgtgctttttgaggatttggctcattttgtctaattgtcaaatttctgtgtgtagaattgatcttagtattcccttattcttttgatgtctacaggatctctagtgataatccctgattcttttctgatattgatgatttgtgtcttcttttttctttgtcagtgttgctggaagtttgtcagttttattatccttttcaaagaaccaagattttgtttaattgcttttatgtatagtttttttctgtttccagttttattgatttctcttcttagatttactaccttctgctttctttagatttactttccccttcttgttctttgttcttgaggtgtgggcttagattatttatttgaaacgtttcgtcttttctttcttttttttctcagaccattcttcataacatttttttttttttaagagacaggatcttactctgttgcctaggctggagtgcagtggcataatcatagttcactgcagccccaaactcctgggctcaagtgatccttctgcttcagcctcctgagtggctaggactacaggtgcacacctggctaattctgatctatgtatttagtgttatgaatttttctcacttctgcatctcacaaattttgatatattgtattttattttcgttcagtttaaaaatttcccttgttaattcattgacccctggattattttagaagtgtagtttccaagtgtttggagatttttcctgttatctttgttattgatgtttagtctgattccattgtggtcagtgaatacactatgtataatttcacttctcttaaatttgtcaggtaagtttgtaaaacttacttttcaaaatctatttctaatttttcattttgccttcttagttcctcactttcctgctttctaggacaagtccatacaaacctttggcttaccagaggtgcagctgtagcattttatatgagtgtatctatttatgcaaattatatactatgctttcacttcagaatgtgttatgagtttccatgtaactaagtgtacaactatttaataaatttacatagtattctgctgtagtaatacaccataatgtattgtcatttttgttgtagagtttgtttctagtcactatgaagtaacagacagtagcacagaaaacaaacatgggggcattttcaaacacggcagtagttcctagtctgtgttcccatctctttttagagtataaaagtacaggtatatggtatgttgatcttgcttgatgggctcactggacctcctgtttttaaattgatattgtcagaggccataaggacctcttcctccatgatggctacctcttagctcgaagctattatactatttgggctaaccctctgggtacaggtaccattttgtcttagatggacattgggcatttcagaggatatgcagattcactgtcccacttcacctagtctctgcccccataggaatgtgaactccttgattgggactcagatgcaagtgatttccttcttgtatgtgtgtaatatgtgactgggtggtaatacttaacggagtactgtatgtatgggattagggtctttaccatatttgctatattaattaaaggctatagctgcctagtgtggaggatgtttaattggaatttcatgtctattctaaatttagtgggagaaccttttaggattcttgcttttgccagtggatagaggttactgccatttactgagatgggaaagaatggagaagaaacagatttggagtgcagttaagacttcggggatagacatgtctgtaagacatccaagaggagttgtcaaatatgtgtttcatgtaggagactggactcaggagagatctagatgagagaggtaactatgggagttgattgcatatacatcaccctacaaagccctgctttttcagacctttattacttctctaacccacctgctgctccctgctgttccaacttcactccagccacactggctgcagtttccaaacaagtcaggtatactcccattttagaggtatttattttctgttctctctcatttgccaaggtctaatgtaaccttttcagtcttgcctttcatttcaccccaacccactccaccctgtcctaccctgacattccccaggcccctgccttgcttttttctctatgccgtctagtttcatctttattagctttgtatggctaaagcagataaaataaagaaaagcagtgataaaagaggtaaagcaggagagggtaggcagagactagatcctccagggctattttacgaaatttggtcttcattttcagaagagtggaagatgaaagttttttttttttatttttggacggagtcttgctctgtcgccacgctggagtgcagtggcgcgatcttggctcactgtgacctccgcctcccgggttcaagagattctcctacctcagcctcgtgagtagctgggattacaggcacatgccaccacgcccagctaatttttgtatttttagtagagatggggtttcaccatgttggccaggatggtcttgatctcctgacctcatgatccacccaccttggcctcataaagtgctgggattacaggcgtgagccaccgcacctggcaaagatgaaagtttttgagtgggggagacctgaccatgtttgcatagagaagcagtaggagaaaggcaagagtggttatgggtagatcaagtgggagattattgcaataaaatagaaacaaaaccaaaaccgaaacacatttagtgagtgatccaagcattctcctaagtgttgaagaaactaggatggttccatctcccacttaaggagtaagtctagaaagttagagaaatgatgtctacttaaagataagtgctctagtagaggaagttcatagtgttgtgggagtataaaagagtacatttgatccagaggttccaggtttgtaaacctgaacttaatagttgaacagctttcacaaaattaccacttagaattagtctcacagaattctaaaatttagaacccaaagggatgtttatctgatttcgactagagattagaaaattttctaaagtatgttttaagaaattttaggtttttttggatgttaataagtatgacacacaaaaagtggttaagtttggacaataccagattaaaccaacagttttctttactgcggaacttctcagaatttatgatctgcttaagtacattataaatcttctagagatgtatataatgtgtagcatttctcagactcaattggccatagatcctgttacattaatgaatgatctgtggatacagggcaaactttaggaaatgctggctgacatgatttgctgaagatcttaacaactagttaaagggtaagctataattaaaatacagttttcacaactttgtcctttgagttttctaagacatttcagtattaccatatgaaacagtgttaactatgaaactaccaggattctttttttttttgcaagggtaggaggacaggggtctcattctgttgcccaagctggagtgcagtggcaccatcttggctcactgcaaccaccactttctggggtcaagccatcctcccacctcagcctccctagtagctcgttaatatagaccaggtggtccaagggccactatgcctggctaatttttgtgtcttttgtagagacgaggtttcaccatgtcacccaggctccaggattcttttggccacattttaatactatattacatttggaattaatgaaattctaaatttggcataatataactaataactttgtatcactcagtgggcaagtattatatagagttagtttaagtctacgtgaaatttatgacctaggaatgtgtaatgaaacaacacttttctgttttttttattgcttcttttttgtggctttgaaatattaagaatacttcattttagctttcttagctttgattccgtcattattttggcagattatactgttttagaacttacatatggtaaaaataatggcatagtaaaaatgcaacattattgatattcagttattagaaagaatgtttggaaagtatttctagtaactacttttcatgtatttctagatgaggcaggggttggcagtctagagcccacagctttctttttatgtatgtcccatgatctaaggttgtatatttaaaaatcattgaaaaaattagtagaagattggtttgtgatgtgtagaaattatatgaaattcagatttcagtgtccataaaaacaaaattttattggagcaccaccaccctcatttgttgatgtattgtctatgactgctttctcaatacaacagcagtattgagaaggtgtgttagaaaccttatggcctgcaaagcctaaaatatttactatttggctcttttcagaacgtttgtggacctctagtctgtattaatgaataatagagtgtatgggattataagtttaggtatatccaatataggaagctatgttttatatataaccaattctttaagtcagtgtcttctaatcagttccacttatttgtccctgctggttctagtctctttttttttctggtagaagttgtatattttattctaattttgtttcatttttttcttttttcctattgatcagtaaacagtatatgatgtgtattattataggaagcacttgggtttgagaagtatctttgtaaaataaatcttgaataattttatattgtttctatacagttgattgatggggaacactttttatatttgaagttgactttgataggctaagttctttttaaaaataattatttcatatgatcatattagcaacagaatgttattcttactggatttagttggcccgaggaagtcataatttagtttgttcctaacacaactggagtaaatattcttagaatacttcacctctttgatttgaatgctgttaccagtgtataaaattttatgtatctatttgtattctatttgatagcttttattggttcttaagagggtttgttaaattttcgtttccaaatattgaataattttgcagttgaattttttcttttgcaaattttatggtttgggagagataaaaataatatcaaaccagaacaaggataatggaattattgatgtcttgttcaaacatctaaacatggaatttaaagaagnnnnnnnnnnnnnnnnnnnnacatctaaaacatggaaattttaaagaagtagctttaaatatgtaggagcctctacggtgctaaacacgtccttttcagtgtaatttttagtttcagttgtaatacagaagtttattttcaacctgagtgatctgagaaggttgtcgagcatgagggtaccaagtacggctcattagcaccttactattagtactatctttttttcttaggaagggttagctagactagaatatgttgctaggcttccatgtctttcgttttagcatctcattcatctcccagatgttttggtaataaattctccttgttagcacaaatgaaactaggatcatgtcctcccttcaaagagcatagaaacaattgtatacattctccatgattaaggaatttctgggtattcacaaattgtattctttttcctttgttagtgtaggtacaaagataaattgaataaaatatactattaaagaaaattttcaagtggatttagaaactcgaaccagtgaaattaatgtatcatagaaaaaattttcactattaaactgttaaattgttaaaaacaagatactacaatttaaataatatctgttgaactttaacaagaatttgtgggtttgtttttcttttttgtatcaaaataatggttatatttcatattaatctttagcaactaaaatatattgtggcatcttcttatggaatcatttgtatgttcaacaagcagttttttatgttttcagaaatagttgatatcatttcatattaatcaactatttctgttgcaacactgactggtattgcttacaccatattaaaaaacacatttttttaaatcaattttttactacttgtaccaactaaatctagtaagaatatgactcaggtcatgtgatcatttcatattaatctttagcaactaaaatatattgtggcatcttcttatggaatcatttgtatgttcaacaagcaattttttatgttttcagaaatagttgatatcattcagtttggacagtaataacagaggtacctaatgagtttttaaaaacaggtaagcatgggacagtgactgaatttaagaatgtcttggaaaatattaagtctagaactttagtgggtggaattttattagactgccagtgaaattgcaattatatttgaagttactctgatggactctttttaaaaaaaaaaaaaaaaaagaatatttcaaatgacctgggttatattcttactagatttagttggtacaactagtaaaaaattgatttaaaaaaataagtgttttttaatatggtgtaagcaatacacagtcactgttgggatagaaatagctattatttgaaaaagggagaggagtcagtttcctatagtcatataggtttgtaaaatgctggatcaaggaaaatttaaacgttttcttattgtagaagttctcagagcctttacttttttatttttgtgggtatttaattttttgtatttattttatacagtataaaatataaaaaattcaaatattaatgtaaatactatgccacccctgcattccagttacccaattttgcccctgcccctgccagtttcatgtattatcctttcaggatattctctggatatgtatatgtatatgtatttactttaagaaagtatcattctgtaatagtattccgaatctgtttttttttcctttgaaaaataccttaaacagcattccatgtcagtatgtaagaagctgcattattttttctaaactgattatgaaaattttagaaaccctgcaaccatataggtctatttaactcccaccccatatatagatgtcatttgtattacatttatatagatcataacttccacaatgttatgattttttgctttagtctatatcttaaagaaattaagagaaaaaggtcttgaatttatttgcccacatatctatcatttccctttttttgttttgtttttgtgtttgtgtttgtttttgtttttgttttctctgaagatccagatttctgtctggctttacttctcttcagtttgaacaccctttagtatttcctgtagtgcaggtcttctggcaatgatttctctgaatttttgtttactgaaaacatctttattttgccttcagttttgaagatattttcattgaatatagaattcggagttgacagtttttcttttttttcctttccttttttttttttttttttttttttttactttcagcactttataaagactttaaagatgttgttccacttgtctcctggcctcagattttttctcttgagaagtcatccatcatttgaattgttgctccccataaataatatgtctttttagcttttagcagttaaactataacatatcttgtgtggttttctttatattaatctagttcactgagcttcttgaatatgtaaatatgccttttaccaaaggaaatttttgggtcttaggtcttttaatatttttctgttccccccttttcctcctctccttctgttagaccttttttttaattttaattatttttaattttgtctaacaggtccctaagcttcagttcatttttttaacttctttttttctaatagttaggtagtataatttctgttgattaatcttaattccttggtcatctccttttggctattatgtctatccagtgaattttaaatttgaatatcatattctagaatttgtttggctactttttataattactgttctctgctgaaattctccatacatttattcattaaaagcatattttctttgatctctttgaacatagtataactttgctgttagttcctttttttttttttttgaatacagagtctcctctgtcacccaggctggagtgcggtggtgtgatcttggctcactgtaacctctgcctcccaggttcaagcgattctcatgcctcagcctcctgagtagctgggattacagctgtgtgccaccacactcggctaattcttatatttttagtagagacaggattttgccatgttggtgaggctggtctcgaactcatagcctcaagtgacccacccaccccagcctaccaaagtgctgggattacaggcatgagccaccacacccggccctttgctgctaattctaacatctcggtcatttcagggtagttttctgcttacagttttttttctcttgagaatggatcattttttcctgtttcatatgttgaataattttggattgtattctggacattgtaaaattatatgttgtagaacctagattctattatgttcctgtgaagtgtgtgtatgtgtgtgtgtgtatgttttagacaggccctcactctgtcacccaggctggagtgcagtggtgcaatcttggctcactgcaacctccacctcccaggctcaggtgatccccccacctccgcctcctgagtagctaggactataggcacatgctgccatgcccagctaattttttgtagatatggggttttgttgtcttatctttatagatatggggttttgctatgttgcccagcctggtctctaactcctgggttcaagcaatcttcccgccttggcctcccaaaggtgttaggattataggcgtgagccactatgcctggccaaaaaaattttttaggcaggcagttagttggctggggtctcaacaaaacttttctgcattgggtggcaggcacctcaaattctaatctcgtagctaaatttctttgaattggttccaggtgtgtgtgtgtgtgtgtgtgtgtgtgtgtgtgtgtgtgtgtggttcaggggtcagatagagattcgaacagttttatacatagaatatgaagctccctctctctccagattatttatttatttatttagacggagccttactctgttgcccaagctggagtgcagtggcgcggtctcggctcactgcaacctctgcctcctgggttcaagcaattcttctgcctcagcctcccgagtagctgggattacagttgcctgccaccatgcctggctaatttttaaatttttaatagagatggggtttcaccatattggccaggctggtctcaaactcctgacctcatgatccacccaccttggcctccaaaagtgctgggattacaggcatgagccaccgccctcggcctcagatttttatttctaatatttcctcctccatattccaggggctttggaatatgagcccttatcgctgggtcttcaaaccagtatgactattttccagtggcattttagctatttcacatggaatagatgggcttgccttcaaattcaagctattaaaagaaaaaaaagggagagaaatgcatcctatgctgttctttttttccagatgttaacttgcctccagtgtccacctgtttcattgactttttggtacctttagatgattgtttttttacagtttgttcagaatttattgtttcctgcaggagaatcagttcagtgagagtttacttggccatactggaaatagggttactgctttatttatttaagaacggtttagtatcccactgtgtgatttctctgtaatttatttaacttcttagtcctgtattcatggacatttagttgttttgaatcttctgatgttatcagtgttgcagaatgtatctttatacatacacgtggtgagacattcttatgggtacttggagtacatcaacagacatttctgtcctcatgaagtgtacattctagttgggggagatagaaaataaaaaataaatacaagtacattgtatagtagattagaaagtgaaaagtgcttatataggaagaatagagccctgtttgagtaaaaggatgggaatcacaatttgaattaggtcttgctgagaggtgagatttgagcgaagactttaagaaggtgagagagtgagccttgaggatgtctgagggagaagcaggagatcagccattgtaaaggccctaacgtggaggcttatatggtgagtttgaggagcagaaaggagactagtgtggctagagaagagtaagtgaagaggtgagtggtagaagaagccagagatgtgactgggagcctgatttatgtaaggccttgtaggccattgtaaagattctggctactatgaatgaaatgcaaaaccaatgtaggtttttttattttttgtttttttgagacggtgtctcactctgttgccaggctggagtgcagtggcgcaatctcagcttactatatcttctgcctcccaggttcaaatgattctcctgcctcagcctcccaaggagctgggattacaggtgtgtgccaccacacccagctaatttttgtatttttagtggagatggggtttcaccatgttgaccaggatggtctcaatctcttgacctcgtgatccgcccaccccggccaacgcaggttttgagcaaaaaataaataaataaataaataaaaaccgttttgctgattaagagagcagttgggaggttattacaataatctagactagagacgaggctgttttgaatgttttggagttttttaccaatataattaggtgaagaatgatacctctttggcattttaatttgcatttctttgattatgaatgaggtcaaacatcttctcatatgcataaaatcatttatatttccttttctgtggtctgtaagtgtataacctgtgctagtttttgtgctgattcagtagtctttttcttttttttgagatggagtctcgctttgtcactcaggctggagttccgtggcatgatctcggctcactgcaacttctgtctcttgggatcaagcagttctgcctcagcctcctgagtagctgggattacaggcacccaccaccacgcctggctaatttttgtatttttagtagaaatggggtttcaccatgttgtccagactggtcttgaactcctggcctcaggtgatccagccgcctcggcctcccaaagtgttgggattacaagcatgagccaccgtgcctggcctcagtggtctttttcttactgacttgtcctcagtattttttaaagctcctcatgtacttccggtatataggcaaagatgaaaccactgatctagcccatcctcatcttgtagccgcctcaaggtcagatcatgcccaatgttaagaggtacttggagtctatagtcacaaagtacattcactcccagcacttccccattcagatctcacatgcatcctttcactttgaacttgtccttctgctagtcctgattgctttactcccacatagctgagaacctggcccttgctggtcctgtctctcccttgcaatcattcacttttaagttgagaggaatatagtaatgtagtattgaggttagggggtgctgtggagccactctatcttcatttgaaacctggttccgcctaggccaagcaacttatcttctctgtttttcagtttcctcaactgtaaaatggaaatgataacaatatgtatttgccttatcaggctattgtgaggattagatgagttactgcatgctcagtgccggcatatagtaaaccactcagtaattgttagctataacctctccttcatttaacagatatgtagtggactccttttaagtgctaggtatcatgctggataccatacactagggctgcagtgaatacaactccctttttccctgtgtataagcagaaattgtcccttttgtagccttcctagaacactattcctggaatagcatgcgtatcatttactctaaacttttccctttgttgaggaactatgaggtctaatacagggttctcaagcatttgcaggggagtctggcctttctaaatttgagaagtaacaggatatacttattttgattatattagaattacattttgattaaacaagagtcaagtgacaactaagattataagtttagctcttcatctgtttgattttatcatgagttcaccagctctgaagtgttcagtttctggccagaatttcttatgcataactggggtgattttagcttcctgagagatcaccatggtcatactcttgtcagtcttgatcactctcctgctttggagttctcagtcttataagctcagattgtattgcaggtttctaagtctcataagaagtgtcatcctctgcaaataggattatatggtcttatttgcaaacccttttttgttctcttgagtgactttttcaggataacaaagagaacaataagtaaaatttgcttaagatgcattctttctttactcccatgtgggtctcagattttcagaattctccatgttgattcctcaaatacttaaggaaccttatatacactgggtttgaatgacttattggtttgcttgacatcctgtctttgtaagagtatgtggcaggctttctccaaatcaataaaggcagcaagactttttttttttttaatgtactgaacttaatagttgtttacatactcattttaaaatggaaataaaactatcttatattctgatcttttctaaatccaaatcagttctttatgtcagctttcaatcgtctatatttctaatgcaatataatacaatattcttaatatcatacctactgtcagcaagtattttttgcccttgttctcttgctcgtgttcgtgtgctgtctctctctcctttcctccctctgtcttcctccctccctccctccctctcctccccccttcttgcctcgtccttatccctcctctctctcattgagataaaaatgagcaacttcagctttttggctgttctcttttgcgggtgggtaagatttaggatcgtaggcagtaatatttggactatatatttaatcatctcaggtattattctcatcatggcttactgcttttctcagtttgagtttcctgggagcttattattcattaatttcccaggctttttcttggcttcagttacaaggaccttgaccaacttgctttatttatttccttatgatttgttgacattctcatgttctctggtcaagatgcacttctttaaagataaatgagttactagactcctgtactgtaattgactgacaggtcacagaacagtctatacagaacagtctgtgtagaacagaaccccaaacatgtaaataaatggcctttacaatttttaaaaattgtagtaatgttatttattattttacattaaattcttccagaggcttatttagttgatttctactggtttttatagtatctgaatttatcagcttatcttctgcacactgcttggtgttttgaactgcattggtgttcattttttattcctcttttttttttttttaagagatgaggtctcactctattgcctaggctggagtgcagtggtactcaaaccgcaagggtacatttgatgctgagctcactgtacccttgaattcctgggctcaagcaatgctcctgcctccgcttctgagtagctggaactacaagggtgtaccaccatgcccagataattttttatgttttttgtagagacagtcttgctattttggcaaggctggtctcaaactcctggcctcaagtgatcctcctgccttggcctcctaaagtgctgggattataggtgtgagccactgtgcctggcctagattggcattcttgagtgaccaatgaaccaaatgtcagatctcctagacaggcatgaagtgatgttctcccgggtatggtacaagcgctaatgggaaactaggggtgccactgagcgtgtgaaatgaaagtctagagattctgccagcataaccacagctaagggtattctttacagggaataaccaaaagctttagagatgctgcagcttcatagaaacattgtagaatatcaaagaaggctgatggattagttgtcaagagggaaagaggccaacaactatgatttcctggggctactatgttctgacacagcatgtatcttgcatagggtgacacagctagtaaagggctgagctggccctccagcccaggagtaatatgtcatcaaagctcgtgctttttctgctatgctacactaactcatgtaaacatccactctttgggaatagtaggatgtcatgatgactgagttatttcagaatatcttcaaaaactattttgtccacagaaaagaatgtctttggccacactttgtatttagtgtgactaaaatacacgtatctgtattgtgaacaggagtaaaccatcataacccgaggccaaaactgttagcctttcaaagctctaagtattacttcagcctcttcctatgtgtggtagtcagactggatatcaatattgtctctaccaatatcatctcccttatttgttgctgtgttttacctcagggtacatggcaaagataaagaggattggatagttctcagcttagtgtgcatcctggaataagagacagttcacactgactaaccgatgtaaaagcataccttgcgtatctgcagcaatgcaggaaaaggagagcataggtaattgaaatccacatagtgcattccccagaggatttgtgcaggaaaaattttacaaattaatttaaaatgactgaaaattataaattgtttaacgttaatccaaggtactttaaaagtggaagagttttcttaaagttccaagtactgtactattttagcaaatgttgctttttttacacttttaatattaaacagtatgaaaggatccaggtagttgagcaaagttcattttcctatttctttgaaaagcatctctataaaacataaaaataaaaaaaaattagccaagtgtggtagtgcacgcctgtggttcctgttacttgggaggattgcttgagccttgaaagttgaggctgcagtgaggcataatcgcacgactacacttcagcctgggtgacagagggagaccctgcctcaaaaaagaaaagtgggcttcgagtcagacagtggtattggctccagagcatctgtataattccagtaaatcatctggtttggattgtaatgaaccccccaaagtgtgttactcatagccgaagaaatttctaagacccttaaatgattactgtcaataatctgagactatttgcattgcctaaaatctgacaggagatctccatgtggcagttccagctaataaattatatttctacttttagtttctacgaagctactttaaaaccctgcaatttttttaaaacatacgtgtccttctaatgattgtgagactatgaaacaaaatgattatcttttagattaattcttatcgcaggtgagaggataaagtgttttgtaaaataatgtattaaacatacctattccttggcatgtatgtttagatttttaattataatttttatgatgtgttggagccagcattttcctgtagaaatataactcaagatttaatattgggcaacagtgggaaaatgggatttagtatgaaaatatttgctttatgtaaacctttttatgaatgcacctaatgtataaagtgaagtcaagctgtaaaaacaattagctgggaaaatgccaagtaaattttttctgttccagtgagtatctattaactatacattattgttatcattaaactgtatgcaaatgtatgactaaattcatttagatttgagtgaaagagacagaatactagaagtatgcagtaagtataattagtttgcatctccaaacaaagcacattaatctttctgcaataccgctgatgtaatgtctccatgttacttttgggagtatgtgaagtgggcaaacatccaaagttgatagttaattctgatcagcaaaagcactggagtagatgcctgggctggacgttgtaataaagcaaacagtttttaaacttcttggaagattttagtgcaaacgtaatcatccatttgaatcttttattatagacattataaaattaatttatcgaaaaagagtgtaaaccctcttttaaaaaatccagtatgtttgtatcttttatactttcatgctttttatacttctaacaaacttttcaaaaacatatgcttgtggacttaatggagagatagaagttttataagtattttctagagctcgtttcgtgaatccttttgttggtgggaaggacttgagagattttctacactagttgttttcaaagtgcattctcagagaacccttaaccaaagatgatatctgctgctggaattaaataataggaatattcttacaactcaaagaaacaataagccatattttccataagtttttagtacgtaagattctgctattagattactagcatgcagtatttagtgaatatatattgaaaagttaaaagtggctgggcacagtgactcatgcctataatctcagcactttgggcgcccgagttgggaggattgctttagcccaggaattcaagaccagcctaggcaacatagggagtgcctgtctctacaaaaaaaaaaaattagccaggcatgatggcacatgcttgtggtcccagctacttgagagactgagatgggaggattgcttgagcccagcaggttgaggccgcagttaaccataatcatgctctgcactccagcctgggtgacagaacgagaccctgtttcaaaaaaaaaaaacttacattttaaaaaaaattgtatgtttttgaactgcagagtatatgtgtgaacatatatatctatttgaaaattgtccctcagtacacagatatgctatatttcatgaaaagtataataattttcaactggtttgtcacttgaataaagctgaaagttgatacagacaaaattgttcttattactgatggctcttagagaacataaggcttcttgcccaaagtctttatagatctagtagctggaacttaaatccagtagatcttattctaaacctaaaaatattttcctctgtccacactgtcagtgttttttttttttttaacaaggtttaatgagtatttactagccgtgttcccattcaagtaagaaataagaatattctttatcagctgctatttagtattcttttggaagtttggatcaacaaaattagcaaaataaattgtggaaataaataggaaaaacaaattctggaaataataggaaaatcctaattttttcttatgaaacaaatggtgagagaattaactaaaatcccattaaagacaggaagagcactctgtaaggcagatgagtacaaagttgatattcaggaatcagaagcctttgtattcacaaacagggaagaaggcccctgtgacgaggcccttctcaatctgtagcatgtgtgcaaaccacctaggctgttaggtaatgtgcgcattcctggactccatcctgaatccctttggtcagccctgaatctgctttttagcaagtgtttctagaccccattaggaagactccagtgttttctatgtgggacccacttgagaaatactactccagggaacccgccctcctgcccccccctccccccccccccccgccgtattcctgcagcatcactccacaattctgctggtttccacagtgctagccatttacctctcagacaggcctgctgcagcacccaggggaacacagtggcagcacactggaagaagaggcccccagatcgccttgccagggacccttcttcacagttgcaaagtaggaacacttccagcactgctttgcttgtcagccaccacaggggaggcacatcttactgcttctgccacacactgtctgaccaccaggagggcaagaaatagggtggtgtcctttagcacctgaagactttgagcagaacctccaggctgggtgcaccctttcctcacctgccagattcagcgtggctgcttttcactagagttgatcacccatttttcactagtcctatggctacctaattcctgtgtgttctactgcctcccagttggaatgagcagcgatgcttggcaaaactgtaactggttaattccagctcctctgactctgctgcagttgctcctaggaagctacagaaaaacatctatgctgactagtccaccttgatataatgaccacaatccttaagtgaaattgtagcactgcctgcaatcctatattttcttgagcagttcagtctcctatttttagagatgacttttcctgcactatggaatggcttgtcacctattctcttcttgcctctcctcgggtaaatagcaacaagatccttttaaatcatgtcagattgtgccactttcctgcttaaaactttccagtggcttccatcatgtggaattaagttctgatttgctgcctggtgacttctcagacctagtttcctactaatcattccttgactcagggcttgtcaggtacaaggaacacttgccctttctcaaaaatggaccaaccaacatgttatttctgcagggcctttgcacttgctgtcttatttgcttagagcactttttctttctggcatttccatgcctagaattctcactttattcaaatctgtgttcaaatgtcacctcctaaaggagcccctgttaatctttttctataccatgctttatttttcttcctagctcatctcatttgttgatgtgtatgtgtctgtgtgtgtgtgtgtgtgtgtgtgtgtgtatgtgtacttacttgattgatagtttcctgagggcagtcctccatctctagaaactaaaactccatcccagcatgaagtaggcctttaataagtatatgttgaattattaatgtaattcacatacccccctagcaattagacaagagtaggaagaagaccaggtcagtaacatcctagagtgcaaaagggaggtcttttacacttccctttacaaaatttggtaggctagtttgtgggagtctgccaagaatgtgaatgagagtaggtgagatcacctacaaaaactgtcttgtcagtgagaaacaaaatagaaccctagggagtatcaacattttttaaaaaaatgatttgtattgaaataaaatttacgtaacacaagattaactattttaaagtatacaattcattgtgcatttagtacattcacagtgttgtacagccatcaccgtggtctaatttcaaaacatatctatcactcctaaaagaaaccccatacctgttaacagttactcctcaaactccatcctcccagctcctggcaaccactaatctactttctgtctctatgggtttgcctattctggatattttgtctaaatggaatcatagagtatatactcttttgtatctagcttctttcacttagcataatgtaagttcgtttatgttgtagcatgtaattatacttcattcctttgtacgactgtaaaacactccattgtggggacataccacattttatttattcatcgggacatttgggttatttccactttctgactattaggaataatgctgctgtaaacatttacctacgagtttttgtttgaaccccagttttcatttctcttgggtatatatttagaagtgaaactgctgggtcaagtggtaattctgcttttaattttttgaggaactggtaaactattttccatagcaactgcaccattttacattcccaccagaatgtatgagggttccaatttgccatgtctttatgactttttttttttaaactatagccatcctagtgggtgtgtgaagtagtgtcttattgtggtttggatttgcatttccctaatgagaacatttaaacctgggctccagatgggtgggttaagaggagacaaaaaatgagcagagaggaaataggactttgcagtcaacttggtcttctagacttacagtgtccccatcattgcctttggcagctgatatcctgcacctgacttttggcgtacagagatcttcagaatctgccagatctcatacatctagagagacttaagttgctttgatattcccagtccagcatgacttcttcagagtttatagttagtacttctgcagtttatagtgttcatctatccagttcattcagaggcagcatggtatagcagttatgagcatgggttctggagtgagactgcctgggctcaaatgtgagctcaagtcgggtggccctgggaaggttagtgaatatctctattcttcagtttcctcatctgtaaaatgaagtggggttgtgaggattcagtgagattagtatctaaatgcttggaatagtgcctggcacatagtaagtgctttgtatgttttagctctaattatgataatggtgatgtgataatgatttatctatatatccatttagagaaggggcaagaacaagtttatgttggttccaagtatgagattgagggtggtgattgtgtgtttacaataatggggctctttgataacgtgctgtgctttgcatagtcctgattatggcactactgtcagtgatacagtacaagttacttattctcttgatttgtgttctgtattccataaatcattccactagtttatcaaatttaatttcaaacacagatttacctttgtttggatagggactagacttccttcaattaagtatttttttttccatttttattctagtgtaccgtattattttttaaaacttgaaattatgagaggaaagaacatcatttataatgctatcatttcaaaacaccctatcctagcttttagtgcatatctttctatatttcctctaggcatttaaaacatacttacagtaattctacaaatagaatatccatacacctcttttaaagcatattttcatctgacctgtgaatcttttctaatcagtcctaatatttgaaattcctcaagaattaacagttagatctcataaaagatatatttttcaaaatttgtagatatgaatagagaaagaactgtcttctatctagatattttatatacatacaagtttgaaaatgtgccaaggactattttatagctctatgataaaaacctgctgtttttctacagcaagaaaaagaatgcttagcagtgccaaaaagtgtacaaagagtcaaaataatcgacatgtcatttgaattcttagttttggcctttagggtcctttaaacataaattctacaaatattttgtagataagtaaactgagatagaaaggttaagtgacatttctgtttccagtcaatgttagaaataaacacagaaatccaaagcctctccttattagatcggaagatagcattttcatatattttaagatgtaagtctgtaggggagatatgaatgtttaagctgtgttgagatttatgaataatgctatcaaatagaatgaggtaattatttttcaatttgtaaaaatcctaatgttatttgggatatgtctttctcaccttgtaaaaatgatactcaggaaagtggagatgttggagaataaaacagtcacagaatggtagggaggacatacgggattttagttgtttagaaagataatacaaaatgagtccataaagagggcattaaatgaagtaactttagggaggttggcaaggatatgtggtataaaaagttgctacaactaacagtcagatataagtgaatgtaaaatctttcctttactcaaaaaaactgtaaggaatatcaagtattaaatcaaaggaaccagtatacattctttcttactgttgtattgacttgtggtatcttgaagataggctgaatctcaagacttgtttgggatctaaaggaaaggaagattctattttattttatttacaattttatttattttttgcaagacttccagcagttagaaggcaaggagacatggggataaaaaggccttgcaagcagcatttgtcagatttagtctgttaagtaatgtggcacacaacgctgttcattttgatgtttcactttgattttacgtcatgcacttgtgtctatttgatctgacatgctgcagaaacacagtgtttcatcatggttgtctgtttgtttcagcagccattcactcaataaaacatctctgaagtctatcagtgggccttactttagatcccttgcattaggttctctggccttccatgaagatagacaatttaataaacaaaaattaacaaaaatggaagaagataaagcagatttttaggaagctccatacggaatttcctggactctgcagttaggcagacttaaatttggttcccagcaactcttttggggacatttgttacctcttaaggtgaccttggggacatctcctgcctcaccaggctgtagtgaggattaaatgaaaaagagatatgaaagacctggccaggcgtggtggctcacgcccgtaatctcagcactttgagaggccgaggcgggcggatcacaaggtcggagattgagacgatcctggctaacacagtgaaaccctgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaattagctgggcatggtggcgggcgcctgtagtcccagctactcgggaggctgaggcaggagaatggcgagaacccgggaggcggagcttgcggggagccgagatctagccactgcactctagcctgggcagcagagcgagacttcgtctcaggaaaaaaaaaaaaaaaaaaaagagagaaagacctaaccattgtgcagtaagcattgtgtgtggtctccttgaatggactctgaagcaattgccaagtcacatgggccacattgtgggatgtggtgataatcctggacctttatcgtgcagagagtcagcagggcagcttaaaattatggttccatcctcagaaactctgatgcagcagatcaggcttggatcacaggaatcttcatttttaacaagcatggaagataattctgatgaaagtaggatctttcaaatcccaagacttttttgggatttaaaagaaatgcaaccatttgaccctgaaacttaaataacttggatgggggagttttcgtggttcatcttttaacagtaatcattatggggatctaaacattgaccacagaattctacttgagaaaaatcattcaagaatagctatgtctgcttaggtaaatatactaatttgtaaaaatatgtacatcacttattatacctactgtgttagtctgatctcatgttgctgtgaagaaatacccgagactgaactgggtgatttataaagaaaagaggtttaattgactgacagttctgcatggctggggaggcctcaggatggcagaaggcacctcttcacaggacagcaggagaggaaatgaatgccagcaggggaaatgccagacgcttataaaaccgtcagatcttgtgagaactcactccctatcatgagaataccatgggggaaaccgcccccatgattcacttaacctccaaccaggtccctcccacgacacatggagattacaatttggattacaattcaagatgagattttgagtggggacacagccaaaccatatcaaataccttactaaaagtgagcttaatacttgaaataagtgaaagtagaaggaaatccactaaatagaacatatcgatctttataattaataaactttgggtatttctttaccaaaggaagtaagtattttgagaccagacctatcacacaaaaaccattctgcatcatctcccctgtaattcaatctggatgcaattaatgagagtgctctggctaatcttgattgtcatgatggtatgaggagatgtgatatataaggtattcaaaccatgtggggtatattattaagaatcattgttaagtaagaggatgaagtgaaacagaatgaaataagtcaggcatccagtcttggtatttcctgttgttagtgctagaatttttaccttttatgttaaaaatgcaacatacttaatttttcctctgatacttacacaatataatttatatatacatatatatccacatgcatgcacatacacatacattgagccatatttgatgaccaaaaagggagaggccccaagggctctttggtgtgcaattaatattttggccagaaaatcagcagattgtttcagtatggttatgtgttatgacatcatattccagtaaagttacaatgaacagaaattttgtttgtctctgtggcaaaccaaaatgagttttgtaattgtcagcaggccttagtgattatagtggcgcccactccctctactgtagttaaaggtctgttagcatttcagttgtggaccttctattttcagaagtttataattaattgtaaacatttgctctatggtgaaagtttgccatatgagatctcacttcaggagtaaatttctgatttcaagttgtctgttttaaagttttatagtaccaccagttaaaaataaacaaagttatgtggaggtgggaaaattgaattttgtgaaatatgaagtgaagatgaccggcgttattcatattagtctgtcagatttctgcattaaggaattaaaataaatttctgcattaaagggattaaaataaaatagatgataggaaattgtgcacttcagtacacaatatttaattgttgtaaccaaaaagcaaaaaagattatagttttttaatgctttttaatctttgtttataataaaaacatttaaaatgcgttatcttaaattaatagaaaactgtagttcaagaaaattgattttaggttaagcatttaaaacagcaactttttcttttttttcatactctgaattcctctccttcatttgacactgttaattactcctgtccctgacattgtgttgtaatttttcttctaactttgaccctttttcatctctttcactgctgtctattgtttcccttgcactttgatcacaggcattaatcagttccgagccttaggctcttttttgattcctttacacttaccctttccaggtgcttatccacttgcatggtttcaattattgcctcacaaatctgcatcttcagtaccaatcaacatttctagttcttcaccttcagtaaaccttcattgattagtcccatctgcctggtgaatgcttacatgatgcgctctatccagtttatctcaggttggacatagagcgtcactacttggatgtgcagtaattatctaaaatatagtaggacctcaattggacttctttttgcttggaaacaaacattttttaggactggagtgatttttaactcatttttttcagcattgcagttgtaaatccaccattccatcaaaatcgattctgtttattttgctaagttgctcaattcagtggtcatatttctcagtcatcattttacttgacctgttagtagcattagatccagttaatccctcccttctccttgatagacttttttcctgtttgactttcaggaaggacatcgtgcttgcttggcttttctcccatcacaccctcccacagagttctcattatattatgcctttaaataccacctatatactgatgattcccaaatattatttctatcttggacctctttcctgaagtccagactaataaattcagttgtccagttgacatctacacttggatatctaataggtctaataattgaatatccccaaaacagagctgttgaaatccacccccagcaaacccatttcttttgcaatcttcactgtctcaatagatgggtactccattttccagttgtttagttccgaaaccgtgatgtcatccctgactcccctctcatattccatagccagtctttgggtaaacccatcatctctactttcaaaattcatctagaaacaatgacttctcgttacttccattgctacaccctagttcaggccactgtcacctttccccttgattatcccagtagcctattagatatccttgcttccagcattgttcccctacagtgtgtcctcaaaatagtagtcagatggttattccaagagataagtcagattttgtcacttctctgtgcagaaccttccagtggctggtcatttcacttgggttaaaaatgcctacagcaatttgtagggaaggccctatggaatcttgccacctcttctcatctagcttttcctgtctccctaaacttttgccagacaggcttcctccgagttacttgaacatgtgtggcacactcccgcctcgctgcccttgctgctggtatactctctgcttcagatgcactgtcccagagatctgcatggcttgttccctaacttatttcatgtctttacacaattgatattttctcaatgaaacttctcttggccaccctatctaaaacctacctccctgacacttctgaaccctttcctctttactttttcttacatctacatctaacatactaggtattctacatatttttcttattgtttatcttccccactctaagtgttgttgttcattgtcatagtcccctgtcaaatagaagacgctccataaataattgttgaattaatggattttattacatatcttaattttttctgcttaatttcttttggtttttttgtttcttcttacattctctgttatctcttcatatctgcattattgcagctttttagtcacacctcattagcctcattacctcaggcaccgtaaaatgtatgaatataacacttcctgcttaagaactggcctaaactccttattcttatgctgaatctgctctccttattactttgcattgtagtcggtccatttctaatctatatttctaatcgtaattatcttctgcaaaaagcacggtaatctacatgttgtcgcctgaacagtcttgcctgacccagcctctgttgtagcttcatcagactgttctcttacttctgtcaaaatctgaccgaaaacttctcaccaggaagtatcctgtgatataattaaataatttttactgtattgttttatgtttaatgttgtattctatatatgtttttcatggagatcagtataagctattatctatagatgtattgactcacattttatcaaaaaagtatgtttttgaggttaaagttttattaagagtatagcacattatataattggtatcattttaaacaaatcttatgaatgattatagagtggttttattaagctaactttaatgtttttattttcttattttaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcaggtgtggtgctgctgcatgtgacagtctgttctttctactttcccagtgaaacaaatcagagcattttataattaaaataaataatctgttctgatagggaagaatactagagtgaagacctgacagtcttgcttcatgtgttcctgcagggtgactacctttcagagctttggttcttcccttgagttcacttcccaggcaactggggatttggggatgtatatgaggatgagaaataacattgatttggcttatatttcatactatgtttattgaatatagattacattgtgtgaatctagaatcaaggatttaaagtggaagagattttatggatttttcagtcctcttttgttttacaaatgacattgaggctgttcttaagtaatctcactcattctcatggcttcagctactttcttgattgacttcaaaatagtatctctagctcaggcatgtcctatacatagcatagtgagcttccttttttttttgagatggagcctcgctctgttgcccaggctggaatgcagtggcaggatctcggctcactgcaacctctgcctcccgggttcaagcgattctcctgcctcagcctcttgagtagctgggaccataggctcatgctaccacgcccagctaattttttgtatttttagcagagatggggtttcactgtgttaaccaggatgttctcgatctcttgacctcgtgatttgcctgcctcggcctcctaaaatgctgggattacaggcgtgagccaccatgcccggcagcatagtgagcttcttacttaccctacagttcaacctctacagttttcctttccccaaaccaattgtttctttctcctttgatatttatcttaatggcagacttaggtgtttttctgcttgtactctttcatgagagctcctatctatttcttgatctgttttcccactagatcattctctcccagttcttgacagcaaggaatactgtctctttctaatagttatagtaagttcagcatatatgaggccttccagaagtatgtgttaaataagtgaataaagtaaaccaatgcctgtgccagacatagatctccaattaggatgctcctggtttgcatcctgtactctttctgtaacttcatcctcatagatcacattagaacaccagtgggggaattcctgggtgttgggggttgggtgggtagagaactctaaaacaagagtgccaggtttagggatgtaggctaaactcaaattagtgtatggttgagtaaaagatttccaaagtctgcattaaatgcttttccttcaaggaaaacaagctaaaaatcgagtaacaaaaagcctggcagcaaagcccttgaccgctgtggttacaggagaatgcagcagatacagtctatatagtttgttgtttcttcttgtaatttaaataggccatcttgactgtagaataaaagtaaagtttgttataatgtcaagattcagtgttatcctattttttgtgatttagaatggtgaatcaggaaaggatatggatgatgacaaagatgcaaataagtctgagatcagcttagtgtttgaaattgctctgaagcgaaatatgcctgtcagttttgaggtatgtactcggtagagatcttcccattttttcccttgctgtggttattttaaacaaacaaatcaaattaactggtgtattagtatcctgcaagagttagtgtgcttctatatgttcaaacccagtattatgaaatgatctaggccctggtgaaaatagaaatcatgatgataacacagattccttctgatttttttcttttctgtattaagccttttgtatacatggtatttcaatttttattataaaagttattttctgggtatagataatttgtggtatcctataagatttggcattttaaataggattaaattaaatttattcaagttaagatttagtgacatacatgttaatatccaatttttttttcaattgtgtggaggccaaaatatgtttcactttaacctcaactaacaaaatcaccaagaagtaagatgtaatgaagcaactcttgacttaacagctagataaatatattgcaaatatattcataaaattgtatgaaatttcaaaaaagaaaacttaaaaaaataattattataatacttcttttattaagaggtcactaattttacaactcatgtctggaaagtagacaagaaccaggaaataagctgaaagagttgtggagattcttccctcacattgtatgacattcacctactagaaagctcccacatcttactcattggcaggatcatctgagttggactgagaaactgtttgctttctcttggacacattcttacaagttgcattatctcagttctcggtccacagcttgttaaaagcagcaaaatgaggaagtcagggagagaatgtacttgagatcctattggtccagcaagaaatgatacggaaaatttggaaaacctgtaaaaagtaattgcttatactaaaaaattattgggattttttttaaaggctacaatgagtaagaacagacagttttattattcttaggtgttcttgggaacatcaatatattatgatgtaggatatctgatgtttataatgatgatctaatgtgaacaattaaaggttaaatatttagtattgcagattaaacaaggtttaggaacattacattcatagttgacaggtccataactcattactctagaaagctaggaatttttttggcatacctacttacctttttaaaatcgtgtcacaagaataaatatccctttctgtaaaacagcttttgacatccctatcaaaaacagcttatttttatccattgactgtttttgagaggcttccacaggcacagtgccttgtggtttatagaactactcgtttctccagcaacttactcgtacataggaggaagttaggtatgtaattatatacaaattatcattctagatgaccaatctaatatggtatctaatctaatggtatctttgatgttcttaaatttgtgttccataagacatggagaaactgtaattagaatgatctgttttaaagtaataaatcattttgactatgaatcaaatgtgtttatttagatttcttttgtttcaattgcattaagcatcaagtgtcataaatagtcccagtataataccttcataatagctttcttaaagaaatactataattttggcataatactaattttggttttgatatgaatattaagtcatactttaagaatacatctcaagtgcctatccattatttaatattttacttgtatttaataggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggtaagtttatatttgtgaacatcagtcagttttactaaataaatattatagtagctatagataagcatttttctataaggcagatccctgaacttatggactatatacagtcctgaaatgagggcaggacatgtgactataaattaatgacaattctattttgctttttaaatacctgtgcacctgcatttgtacatcaaataatcataataccttaggtatttatgtatttctttgttgtttaaaaagtgctttaccattcatgtcacctttactataatccccctcatgaccgtataaggtagatgatgttagccctcattttacaaataagattttacaaaacgtgttcaaagagtttgcccatttttattcagcaatcatgtcaaacctcctgaaccgctctgatctctaatccagtgttctttctgcacacatggctgttgcatagtaacttcttaggatatcatgaaatggtaacaggatacacacaaaaaaatcatgtgactaatactaacaatgatagctacagcagctggaaatcataaagcagtctatgtgccagactttgtcccaacactttgcatgctttaatcacatttaatccacatagcaaccatatgaagtagatggtgttattttgttgccattcgttcagatgtgtataccttgccaaagaagaatatagagcacacagcttttcaagatattgtgactcttttattgggtcagaatttatttacattaataagagaagcaaggtaaatatcagaggaatgagatgaatcagcatttagtacaggacagtgcctgtgaatgcttgacacgtatgacatgtctggagctagagttctgtgtttccagagaaagccttaaattgccagcattttagttgctggctcagcctcactgatttagcagccttcttctgatcaggctatacaaatgaaggattacagataagaaatatatttaatctcaatggatttcttttgattgcacaatggcacaatttaggtatttttacaggttttatacctttgtacctttatttaaaatacatatatacatatatacaaaaataactacttaaatatttgtttttaatgaatactgacatgacttcacttagaagatgtagtaggtaatgcattccctgaactggaattatatgttatatgtaaggtagactaaaaataaatacaaatagatccacttatcatgagtcatagtggttccaaagaggactggcactttcattcatatgctcctcctacacagtcaggagtagaatatagctattaagagaatgaactttggagtcagttctgagtatgaatccctgtggcctgagcaagttacctaactttaaaaatatttcttcatttataaagtgggaatagtaactgaccttgctgtatgggattgttataagtattaactgaaacaatgcacaaaatgcattagtaattattaagtattcattgttattaatgataatgcaaatactataataaataacacatattaactattggtattttgtatctaatactacctattcacattttatgtttatgtgaatatatccatgaactgttttcttaaatctattaatatataaaatctatggcttttctgtgatggaggaacagcattttatgttggaatggtggcacaaaactggtcacataacttctgtctgctctattaaactaagttttatcttgataaattaagaataataaaccaggcaaaccaggctgggcacggtggctcatgcctgtaatcccagcacttttgggaggctgaggcgggtggatcatttgaggctaggagttcgagaccagcatggccaacatggcgaaacttggtctctactaaaaatacaaaaattagtcggttgtggtggcatgcgtctctaatcccagctacagctcaggaggctgaggcatgagaatcgcttgaacctaggaggcagaggttgaggtgagccaagatcactgccactgcactccagccttggtgacagaatgagattccatctcaaaatgataataataataataatcataataataatcatcataataaactgttaggctggaaaagatctgtacatttctatagtaggatataaatctaactcttgttttaactatagctattaaaagcaagattattatttaaatgttattccccagaggtgggagacaggagaaacattttgaattctcagttatttgctactgcttccagtatataagtaatattatcccagaacttccctcctatgcatcattcagatctcagcataaacttgacttttttaggaactcctctggtcctctcctactcccagactaggttagcctcctgcatttttcctcatatacatcacacttggagttacttttgccatgtctgtcttatgttaaaataaagcttgtagataccctctgaaatgtaagattattttgagagaacaacatgtgtataatgagttggaatctagataattttaagtatgttcataccttataatatgtcagtaaatggatcagcttggaatagtatcctgatttttagcatattcctcacttccttgtatggcttatacattgagggtctatagtttgttacactcaatggaagcaggtaaaatatctatgattatttgccttggttttatttaaagtaataaaataatcacattgtctcatttgatcacttaatcactctgtgatgcagcattcatttccatcttacagatgaggccctttatatttaagaaacctatccaagatcctgtagcagaatcagctttcagatccagttgtcacatctgactccagtgcccatttgatactggttaattgtgaacttttggattttcagagtcactgtatagggttatcctgttaacatgtaaaactgccctgataatgtctttgtgtttacattctgtttttaaatgtaattctcctctataagacgagactacaaagaaggctttctaatcttagagatcaaatgttctggacacaattattacaagactgtccttattggtatatagaatgatgatttaagatttgctgtccaaggaataacttaattgtcaagggtgctggtagttcatttcaatcagagcaagaaaccaagtcatcccctcccccgctgcctttttttttttttttttttgagacggggtctaactctgtctcccaagctggagtgcagtggcaccatgatcttggctggctgcaacttctgcctcctgggttcaaacgattctcccatgtcaacctccagagtagctgggactaggcatgtgccaccatacctagctaattttggtattttttggtagagatggggtttcactgtgttggccaggctggtcttgaactcctgacctaaagtgatctgcctgcctttgccacccagagttgttttttttttttttaaacagggtctcacttgttgcccaggctggagtgcaatggtaggatctcagctcactgcagctttgatttttctggtctcgagtgatcctcccacctcccaagtagttgggactacaggcacaacaccaccatgcacagctaattttttgtattttttgtagagacagggttttgcaacgttgtgcaggcaggtctcaaactcctgggctcaagtgatctgcctaccttggcctcccaaagtgctgcgattaaaggcatgagccactgtgcccagccccaagcaattcttaatgtacactgaactccatcattatctaaattggatttatgtatctgattcttttcattgcaatctatatcaacaataatttccttggaactcagagacattctttgagtcaaattaaacagaaataaagacagtatgccactggaaacacattcctacttatttaacatcttcatgaactgggcatactacttctagtgctagactcagagcttctctttaccttttcattgggatttcaatcttagacttataaattattatgtggatttgtcttttctcatcagtccctcttcattccccttataattaatttaatttttttttaattgagacagggtctcgctctgttgccaggctggagtgcaatggcatgatctcggctcactgcaacctccacctcctgggttcaatcgattctcctgcctcagcctcccgagtagctgggattacaggtgcacaccaccatgctcagctaatttttttgtatttttagtagagacagtgtttaaccatgttggccaggctggtcttgatctcctgacctcatgttccacctgcctcggcctcccaaagtgctggaattacagacatgagccaccgcgcccggccctttatttaattttttttttcaggatataagtggaagttgaaaccagtattttatcaaaagctaaaagtttcctttgctctttcctttcccttcatctaaccattgcaacagtgaagttctcagtctttttcctcctctttccctaagctgttcttctacttctgggggttcaatttcatctttaaatagatgattcctgaataccgtatgctctgcactacctattagacatccccacttagtatttcacaggtgcctcaagttttgggcccaaattcatcattttcccttctaaacctctttctcctgcagcattctttatctcagtgactggcacaaacatccagctgctgaaactgctgggggtcatttttaacttctctttttttttgaagatggagttttgctcttgttgcccaggctggagtgcaatggcactgtcttggctcactgcaacctctgcctcctgggttcaagcgattctcatgcctcagctgggattacaggtgcccaccaccatgcccgactaatttttgtatttttagtagagatggggtttcaccatgtcggccaggctggtcttgaactcctgaccttgtgatccacccacctcagcctcccaaagtgctgggattacaggcgtgagccactgcgcccgacgtttaacttctctcttaccccttacgtcctatcagtcattaagtcctattactctgttagctaatatttcttttttttctttttcttttttttttttttatgggacggagtcttgctctgtcacccaagctggagtgcagtggcatgatcttggctcactgtaacctccgcctcctgggttcaagcaattctcctgccttcctcagcctcctgagtagctgggattacaggcgtgcgccaccacgcgtggctaatttttgtttttttagtagagacgggctttcaccatgttggtcaggctggtctcgaactcctgaccttgtgatccgccctgccttggcctctcaaagtgctgggattacaggagtgagccactgtgcttggccttgtcacctaatgttttttaagttggttcctttttttccatcccttctgccactcttttgtccaactcacagacatctattaacctgaactactacagttaaggttttaactggctacaagtactcttgacaccaaatgatcgtttaaaaagtatgatcttttagagacacctgtctaatcatatcatgcctctgcttaaaacctcttagtaattttcttactctttggataaagtccaaaatcctaaacatagtttgaaagaccatgagggatctgcctggatgctgtacctggagcaccaaactacagattgtcaagatgaaatggcagcaatcatccggaagagctaagactgcatagtggctcttacataagtttagtgtaacgtgtaatctgtaacagagtgattatccatgtctccatgtctctacagatagtagagacaagaataaattttcataggtggaaataaagttttgaccgtatgatatacgcagacttttatttctaggaaaaatacatgaagaaagttcatatgcagaaagataatttggtttccaagaatttttgcttttttttttttttttgagacggagtttcgctcttgttgcccaggctggagtgcaatggtgtgatcttggctcaccgcaacctcctcctcccaggttaaagtgattctcctgcctcagcctccctagtagctgggattacagacatgtgccaccatgcccggctaattttttgtatgtttttttttagtagagatggggtttctctgtgttggttaggctggtctcgaactcccgacctcaggtgatctgcccgcctcggcctcccaaagtgctgagattacaggcatgagccatcacgcccggcctgaatttttgcttttatgttataatacatacaaaaagctatatataaacttgtgtataagttaaaaagcatactaagtaagtgtgagaaagacctactgcccaacttgagtataaaacatttctcaataagctttgaagctctctgtatgctcttcttccatcacgtcctcatgcaaccttccctaggcaacctctatcactagttttgtatgaccatttcctaccttatagttttactatgtttgtttttctaaagttatttgtttagttcctttaaacaactttattgaggtataattgacatagagtgacttgtacatgtttaaagtgcactgtttgatatgttttcgtatttgtttgcatgtgtaaaactataaccaccatcaagataatgaacccatccattcctcccagaattttccttatgcccctttgtaatcttctaccttaatttgccgagaaaccactcttttttttggctggcttctttaacccagcataattattttgagattcatccttattgttgcatgcatgaattggtagttctgtttttttgcaggtaatatttcattgaattgatataccaccacttgtttatccattcacctgtcagtggatatttgggctgtttctaatttttgattgttactcataaagcagctatgaatatttgtgtgtgtatcttaagagcatatgctttcatttctcttgggtaaatccttcaaagtggaatggcttggtcatttagtaggtatatagtcaactttagtttttcaaagttgtagcagctgtgcacttttacattctcatcagcagtgtgtgataactccaattgtttcacatccttgctaacacctagcatagtttttaaaatttcagatgttcatgtagatgggtattgatatctcattttggttttaatttacatttcctctgtggcagatgatatcaagaattttttatgtgtttactgtcacatgaggcctgatgaagtgtttatttaaattttttgccagcttaacaaattttaattgcttatttcaaataataataaatttattattgaatttttagaggtctttatatactctggatacaggtgctttattacatatgtactttgcaaatattttcttcaagtctgtgacttgtctttttcaaagagcagaagttattaattttgaagatttattatgtttattttattattatttatattgtttcattttattattattagtttttttacatggaacgtgattttggtgttatatctaagaaattgttacctaaccaagttacaaaaatttttcttctggaaatcttatagttttagaaattacatttacgtctgtgaggcattttgagttaattatttttataaatgttatgaggtttggcttgaagatttttttttctttttctttttctttttacatatgaatagccaattgtcccaacactattggctgaaaagactaccccactgaattccttttgtgcctttgttgaaaatcatgtgaccgtgtgtgtgtgtgtgtgtgtgtgtgtgtgtgtgtgtgtgtatgtgtgtgtgtgtgtgtgtgtgtgtgtgtgtgtgtatgtgtatgtgtgtatatatatctgtgtctgggcacttattctgtttcattggtccctttgtctgtctttataccaatactacacacactgtcttgaatgccatagttttataatcttgaaattaggtagtctgagtctttttttttcccccaaaattttggttctttgtcctttgcatttccatatgaattttagtatcagcttacacattaaattttaaaaagccaactgggggccaggtgcggtggctcatgcccgtaatctgagcactttgggaggccgaggtggaaggatcacttgaggtcacgagtttgagaccagcctggccaacatggtgaaaccctgtctctatgaaaaatacagagattaaccaggcatggtggcgtgcgcctgtagtcccagctactcaggaagcttaggcaagagaatcgcttgaacccaggatacagaggttgctgttagctgagatcatgccactgcactccagcctgggcaacagagtgagactctgccaaaaaaaaaaaaaaaaaaaaaggaaaaaagcctactgggattttgaggagaattgacatcttattgttgagtcttctgatcgatgaacatgatgtattgactatttagatcttaatttcagcagtattttgtagttttagcaggctttacataaaatatactatatatatattattctgtagcttgccttttttacttactattctttctgaaaatcattcatcttgatgcatgtagcaataattaattcattttcactgctatataccattccattatatgaacatgctgtaatttatctgttcttttattgatgaatattctagtttttttttcctatttcaaataatgcatctgtggatattcctgtacatatgagctactgtgcatgggttacggttttctagggtttatatgtgcctaggaataggctaattggggtaggatgtaccatctcaggctttactagacattgccaggttgttttccgatttatagtactcccagtgttttataagagtttctgttactccccattctcaccacttggggctgttagacttcttaatttttgctaatttggtggatgtgaaatagtaactcactgaggtttttaatatgtattttctgtgtcctagaggttagttatcatttcatatattgagtttttccttatgtgaagtatttatctcttttgcccatttcccttttatattctctttttcttagtactttttaggggtcttaaaaaatatattttggataccggatacgtctttttaaaattatgtgtgttgcggccgggtgctgcggctcacacctgtaatcccagcactttgggaggccaaggccagtgggatcacctgaggtcaggagttcaagatcaggttggccaacatgatgaaaccccatctctactaaaaatataaaaattagctgggcatggtgtgggcgcgcctgtagttccagctatttgggaggctgaggcacgagaatcgcttgaacccggcaggtggagtttgtggtgagctgaaattgcactaccacactccagcctgggcgacagaatgaaactctgtctcaaaaaaataaataaaataaaataaaatgataatgtgttgcagagatctcctcccagttcatggttggtcttcttctgttctttttgatgtttcttgatgaacagaagttgtgaagcacctctggtatactgaagagtgtgcccaatttaaaaagcatagttgacaccttgccattaatacatctaagccccaagtcccatagaagccttggttacaggtctattttatgattttcctttataaatattcataaatgactcatttatcttttctagtcacagttttggggtgtgggggtggagggaagaagcactgtttctttaaggattcaataacaggtttcacaagcatattttaaaactttttcttaaattaatttttaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtatttctaaccttttaaaactattgaaaagatttagaaatccccaggatggaataggcatttgggcgaaaggcaaactaggacttaagagcagaaagtaaaactgtttccagttaaagcattcattctgtccaggctcacctaccaacttggtggaaacattcaagtgtcaaggacatgttacaatagacaacatgagttttccaagggactctgagttcacacaggttatttaccatggagtttatcatttaatgcctatcttttaactttttgtgttacattttgtagccggagtctgttaactactgggaattggagacacatggaattagaaacaaaatttagaaggatggatgtagtagatggatcagggccaaaatcctgagcttgtgggctgtcaggaaagttagaaaaagagagtaagcaggctagctaaccatggtgggggctgaggcactcaggattgctgagatctgactgctgcattgtggagccaagaaaatcaaggaatggctgctagtgtattggcagatgggctaggaatgaagtagaatgcctaaaatgctctccttttcaacccctacctattcatcttcatttgccagctcaaactccagtcttaagaaatttttcttttacttttttattacaatttcaaacatatccaaaggtggggagagaataataatggaccattaatatgcccatcactcaaacacaacagttattaagatttttgccacacttgattcagctattaatttttctcttctccctctctttcttcctttctctcttcttttactgaagtatttcaaagataatttctaactacatgtcatttcagccttacatattcagtgtatgtttctaagaaatatgaaagcttttcttacattagacatgattcattagaatcatctaatacccagtctatatttaaattattattttccccaagctgttttttaattttttgtttttttttttttttggtggggcaacagggtcttgttctgtcagccaggctggagtacggtggcatgatcatggctcactgcagccttgatttcctgggctcaagagatcctcccttttcagcctcctgagtagcctaggattacacgcatacactaccatggccagctaattaaatgttgttttattgttgttgtttatagcaacaggatcttactatgtagcccaggctagtcttaaactcctggcttcaagtgatcctcctgcttcagcctctcaaagtgttaggattacaggcgtgagccactgtgcttagtctcaaactgttttttaaataattggttagtcacagaaactttttagtcaaatccaaggatctcacattttatgtaacttagataaaatcaacaaatattaagtgctgaccatgtggtagacattttggcactcaaatacagtgtctcatattgattaagtttaagtgtatagctaagttgtgccttccctcccaatttataatctccatgtttctttatctttcagtacccaatacagtggtttgtaaatagtaggaccttaataaacatttgatagatatttgctgcctgcctttctgcctgtatggtttttttttggagatgttaacttataatgtagtcatagataagtcactcctgggaacccagatatccaaaaagaggggaattctctggttagtaatcacattattgtcaagatgttattaggatccagcacatgattgtttcattattttcactggtaaaatatgttcactatttttttccttaacattcttaactttgaagaattctggaacatatactttgaatgccaaagcttgaagaaaaaaatcgcctgaattttagacatgtattgggaatataaactggctttggctttattaaacaaatccttttctacagagtatattgagtaccccttttgaaagaggaatttagcatatcttaggccagcttccattttatgggtattcataaacattctagtcaaatggggacatttggctgtgcttttaaatgttttcgcactgaattcatattgttttttccccttctggaagccccagtggattcattacagtattgcagcaattttatcaaagtaacggcctttgtataaactacttaggcaatgttatcatttgttataattgaatgtggcagcaaaatatctagagatgagatgctcatttttatctgttaccaaagaaaaagtctatatattaaaaaatggatgcagttacttatgttgattactagataaacgaaagaaaatctccgatgacattatttgggtattttattccagagcagatttcttaaagcttttcatttttttggtgaggagtattttaatctttcaaacagaaaataatgataactaaaccaaattgcatatcagcacactgtattactaacttttcagcctgtgattgagatcaccaggttgttaaaaaataaataaaaattaagtttttggtaaatcctatttcagaactttttagtttcttaggtttttgaggatttgattcatgtgaatgagctgttaaatttaaagacaaacatttggcagtcttaaatttactgcatggtaaaataattgagcttctttacagatagaaattaacatttaaatgtagagaccatatttacaatagttataaaatttgtgacttctcaaggaagatgacttgtgaaatttataaacttacttaacttttataataaagtgatgttttgagtgaccattgtgtttattagcagggaatgaaagtcctttggcaatgtggtctttttatattaacaaattaggataactgcttacaaactattcaaccatgcgattattaaaatttgcatgaggcaagggctgggtgaatgggtaaatgaatctgggaagcacttgttttagaagaagtaagtcttgaaggtatcagaataggccagatggaaatctagcagacggagagacaaggtgaatacaggaatgggaacagcattacagctgacaagtccaagaccaggcctcagagcagtagaggaagcttctgacataactggcctaatcttttcaccagcaaggattccagcagcaacatagggactgatgaagctgggggaacaaacaaagcattggaaaaaataacagggagcagaggtactctagccagggatttgagtagattatccatagggcctgccatgttgaggcagacactgttacggcaggtggtgtgtattcatctggctctgagtacctggtctgactgtactagatttgtccttctcagagtgaggtccaaagactgcttctgatttgtcacgacatagtggtttccagtttcagaaaaaaaggcaatgaaatatttaaaaaatatttcacaggtttaaactatgcaatttgtgatagttgttacagaaattctgtaatgaatatgttttcagcgtttcatgtgctgtatgaactgtcatttagtttgtctttactgaaactctgttaaaagagagtacagcaccttttttatatcatttgtacattgtttatgtttaagtttgtattttcttaccattttgttgtatattctcccagttccttaaaattgggtggttcactgaagcttaaaagtactgttggaggctgggcgtggtggctcacgcctgtaatcccagcactttgggaggccgaggcaggtggatcacgaggtcaggagatcgagactatcctggctaacacagtgaaaccccgtctctactaaaaatacaaaaaaattagccggacatggtggtgggcacctgtagtcctagctactcgggaggctgaggcaggagaatggcatgaacccgggaggcggagcttgcagtgagccgagtttgcgccactgcactccagaacctgggtgacagagcgagattccgtctcaaaaaaaaaaaaagtactgttggaaataataacacaaataaaaactgtaaataaggatgtaagaataaatgatgaacagtactcaagtgtggataccaaatgggaatctgtatgttctgggacagatgaaacagccaatattatgattttacacaatagacaaaaaagaaaagtatggttagagtatcatgctgtatagctgaaaactgaattttgttgtcattgtgaaatgtattaaagtggcatgaaactattattgaaactttctaacttttttttaagtaaaatgataactggtaaaacaattcaacttttcagatatggattgcccacttttcttgctcatttttctgctcgttttttaaaaaaactgatatatgggaacctcctgtatattctggatgcaagccctttgcagttatatggcattttaaatacctcctcttgtgttgtgactttcctttctaaataatgcttttagaagaacaagagtaatttttagtgtagtcaaatttaaattttttctttatattaacttcataataagtctagatatccagacaaataagtgtcccacaccttgctcttcctcaaaaggattttggctgttcttagcacttcacatttccatgtaaattttggaatcatcttgttcaagtattgtaaaaagatatatggaattttgattgagttttcattgagttcaattaattgagtttaggtcaatttgaagagaactgatactattacattagtattgtcttcaatccatgaacatggcattttgctctgtttatgaggtttttcttaaagtttctcaataagactttgttttctatgtagaagatttgcacatcataggtatttgattttcatttaatgtaaatgttatctttttaatatttttcatcttctacttgaatgtggatggaatgtagaaatgcagtcctctttttcatactgagcttattacaatctaatcaattcttataattcatctgtggagtttcttagattccttatatatgaaatcacatctataaataatgagttcttttcccttctgcttctttttttacttttccttgccttatttctctgtctaggatttgtgtaaactgttaaacagtagtaataatagggaacatccttgtcttgtttctaattagtttcgttcaacattaagtacagtgtttcctgaggtttgctgtaggtgttttgtaaaatgccctttatcatatttaaaaggttttcttctactgggcgtggtggctcacacctgtaatcccagcactttgggaggccgaggtgggcggatcacgaggtcaggagatcgaaaccatcctggctaacacggtgaaaccccatctgtactgtaaatacaaaaaattagccgggcatggtggcgggcacctatagttccagctactcaggaggctgaggcaggagaatggcgtgaacccggaaggtggaggttgcagtgagccgagattgtgccactgcactccagcctgggtgacagagtgagactccatcccaaaaaaaaaaaaaaaaaaagttttcttcttttcctagtttgctaataattttcattatgaataaatgtcgatttctagtttgaatttcaaatgttaaaccaaacttgcattcctgcaataaacctaactttgtcatgaatctttttctttttctatattgctttattcattatactgtttaaaacttttgcatctatgttcatgagtgaaactgttctgtaaattttcttatactgttcttgttgggatttggaatcaaaatgagagctcataaaataattggggactgatttctcatttcgtgttttatggatgaatttggatgaaaagaatagcataattcttccttaaatattgagtagaactttatggagaagatctgaagagtcctttttgcgaagtttttaattatggtttgatttcattagtagttttagtcatattctttaggcttattctgtggcaatttggtaatctgtattgtctaggaatttttccattgtatctaaatatgtttttaaattttagcatgaaattgctctcagtattccttttttttttttttttttttttttgagacagagactcactctatcgcccaggctggagtgcagtagcatgatctcggctcactgcagcctctttctcctgggtccaggcaattctcctgcatcagcctttcaagtagctgggattacaggcacttgccatcatgcctggctaattttttttttttttttatttttgtatttttagtaagacagggtttcaccatgttggccaacctggcctccaactcctgacctcaagtgatccacctgccttggcctcccaaagtgctgagattacaggtagtgagctactccacccggcctcagtaatccttattattttgtaatgctacagaagtgatggtaatctccctttttaattatttcatttcttatttgtgtcttctcttcttcttttcttttttaaaaatacccatctcagagaagaactcgtattttttttcttgatcagtcttacttttggtttattgttttattagtcttattagagaaccaacttttggcttttctaactttattgtactttgttttgtatttcctttttgctttttattcttctattttctctgggtttgttttgctgatatgtttgggacttcttgaggtggatgtttagctcattacttttttgccctcctgtaagctgttaacggctatgcattttcttctagaccctccttttgctgtgtccttcaagttttgatatatgtccatggattatttaaaatattttctagttttcactggaatttcttcttttgcccttaggtaatttggaattacattgtttataaaatttttaatttttaattttaatttttttagagatgtggtcttactctgttgcccagggtgcagtgtggtgatgtgatcacggttcactgcagccctgaactcctgggctcaagcagtcttcccacctcagcctcccaagtagctgggactacagccatgcaccatcatgcctagctaattaaaattttttttgtaaaaatggggtctcactatattgcccaggcgggtctcaaactcctggcctcaaacaatcctcctagtgttggaattacaggtataagccaccacacctgaccagaattacactgtttaatttccaaagttgtgattaactatttaactacttcttcaatcacttactgagaccactgtgtaaaaagaaattcaactatagttgtgtattttctatttctccttgtaattctatccttttttgctatctactttactttttatagttgtatggttgatgtgtatttaagtacatgtataaattgctcacagaagataactgtagaatagttctaatgataaaaatcttttttttggagcaattgtgatggattaaatgctgtggtttacatacattatcttgtttaattttcaaagcaacattgtgcagtagttggtattaccccggctttactgatgaaaaacctgaggcttagagatattaaataatttgtaccagttcgtacagctaggaaataatagagttgagtttcatatcccaatctgacttggaagcctttttttttttttttaaagatggagtattgctctgtggccccaggctggagtgcagtggcgcaatcgtggctcactgcaacctccacttactgggttcaagcgattctcttgcctcagcctcctgagtagctaggactacaggtgtgttccatcacacctggctaatttttgtatttttagtagagacggggtttcaccatattggccaggctggtctcaaactcctgaccttgtgatcctcctgccttggcctcccaaagtgggattacagctgtgagccactgcgcctggccagaagccttgtttttaatcataatgttgtaggaacacttgtatattaattctcttcaggaactatttaatataaatctttgtaaacttgaatgtttacataatattgcaatttgaacattattttaaatggcaccaatatgaattttagccttttcagtttattaattgaaatataagaatgctaaaatgtagtcataaccaacatgaacgctgttaaaatgtaaattttatttttctgcttatataaataatataaatttagtgtttaaaaaatcaaatagcatataaatatatatggaagtaaaaattctataaaattctaccatcctgagataatcctccattgatactttaaggaccattttttcatgtacatatacaacattacataaatgttatcttagttgccatttttactttggactgaactttatgttttcaaatgctagagagtagaattgctttatgatgtaaggacttcctgtttaaatttatcataaatgtatttctttaatttatttctttaatcttatcaggtgaaggtaggcaatgaagttgctacaggaacaggacctaataaaaagatagccaaaaaaaatgctgcagaagcaatgctgttacaacttggttataaagcatccactaatcttcaggatcaacttgagaaggtaagagttaagtttacatgtatgtatcctatctgtcataatatcaaagtgattaataaattttgatcttaactgatattaaagtaaatgtcaattttaacttttctgaggcaatacaaagatagatgatccaagcacaaaataacatatggagtaagatgagatattaatgagtatttataatcttatgattagaaaatacaaaaagtttgttgtatggttgtacatattttatgtaataccaatttaacatttttaacttgttgactggttgtttttgccatatagacacagtcttaatttgtgccttttaagaacacaggttgttagcctttatttttggaatacagctgaaaacactggaaataaaaattctgacttacccctttagggcaggaactgtattggacagacactctataaactaatttttctatttactttaaatttaaaggtgaactcataggttgtttattttctgccaagacctgtgttcatggtcccctattttttctgcaacagttaatgacatcattaacacctacatctgttacaagggaagcagagaaccctgaattcagaacttggcagataacttggcagaaattggcttatttccattttgtattaagtatcattttgttatctgtggatatgtagacattatttctaccaaacattttatttatgtgaacattcacaaaacaggcttactaattacttttatcaaaagtaatatgctttagaccaggccatcttctcacacaagaattctgtttcagagatttttttagtttctacaggaacacattttaaaagtttagaattagaaacaaaaatatataaagacacttagatgtacttttttgttttctaggcaattcttttgaatgattttaaaaaatctttgtctgtgtattattgctagagatttcaattctgtttttataacctggctagtcaacactttttcttcttttaaaagtatttgtaacgtgaaacctaacatgtgttccagtttctatagtccttatattgtatatatgttgttttaacttaacacatttatattgacttaaaactggtgagtgatctataaaaatatgtcaaaataaatctcctcacagacatgtatttgtaaattaagtgaaagcaaacacaacaaaaaaccagcattaattaatttcattaatttgaaaaacattttttgcataaccactgtataagtcagggttctccaaagaaaaagaaccatcaacgtgtgtgtgtgtgtgtgtgtgtgtatgtgtgtgtctgtctgtgtatatatattaaggaattggcccatgtgattgtggaggcttggctagtgtaaaatctgatgggacagcctgacaggatggagactcaggaaagagttgaaatttcagtccaaaaacagtctactggaaaattcccacttgcccagggaggtcagcgttttgttctgttcaggcccttcagctgattagatgaggactacccacattgtggagggtgatctgctttactcagagttcaccactttaaatgtaaatctcacccaaaaacactcttgcagaaacactcagaataatgtttgaccatttggcactgtggcccagagaagttgacatgtaaagttaatcatcacactcactaaatgccagacacttaaaatgactgattttaataagatgactgagacttggtctctgcactcaaggagctgatcgttctttaagtgcagggagtgaggaattttaaccatataacaaaactagaggatgaacctggaaagtcaggaaaagctgaggtcactgttattatgcgaagtagaaggtttgaagaaatgcttatttaagatttgaacatgaatgtgaattgatctggtttgcattcttcaaaagataactctaagtaatggggagcatggatttgagcagagtgaaaccaaaggcagaaaggccagtcaggaggcaaccagagttgtttaggtgagagatattgagggtctgaactgagacagtgaaggtagagaggaggaatggaaagactccagagatatttcacaaatgtaatgggtaagatttgaatagtagataagatgcatgcaaggtacaggaaaaaagaggaggaaagactacctgcaaaaaggaatagagaatgactgctaggtggtagtcagatgctgcagagagatcaaataagaggactgaatatattgatttatcaataagacttttgatgagtgtggcaaaagcaatatttaaaaccagcaaaaacaggatttttttgttgtttttttgagacggagtctagctctgtcacccaggctggagtgcagtggtgcgatcttggcttactgcaacctccgcctctcaggttcaagcgattctccctcctcagcctcccgagtagctggtattacagtgtgcaccaccatgcctggctgattttttgtatttttagtaaagaagcggtttcaccttgttggctgggctggtcttgctctcctgacctcaaatgatccgcctgccttggcttcccaaggtgctgggattacaggcgtgaggcacctcacctggttggtatttcttaattatttggtagaagttaccagtgaaggcttttgggcttagaattttctctgtggaaagggttttttaactacaaactcagattttaaaaatagatagggttacttaggttacctacttctgcttgaatgaactttggcagttttagtctttcaaagaattagttgatttcatctaagttgttgaatttactagtataaaattgtttataacattccctttttcttttaatagtggcaaaatctaaataacatttctttactcttttagtagtagcagaatctgtaatgatactcactttcatttctgatattgatcatttatttcttttctctttttcttctgttcagtttagctagggggtttataaaattttaagtcttttcaaacaattaggttttagttgcattgatttttctctgtttttctattttcagtttttttggatttctgctctttattttatccttcacttgtttttgtttttaattttttgttcttttctaattttgtgaggtagaagcttaggctatacatctgagaactttcttttttctaatataagcatttaatgctgtgaatttttctttaagtactgatttagctctgccctacacattttgacaagttgggtttttcctgtctctctcttggtttttttttttttttttttttttttttttacctctgggatacacgctgtatgggtttttactttcattcaactcaaaatatgttctgatttccctcttgatttcttctttcaggccctgtatctgttatgattacttgttttgtccagtgttaaagtttccaactataagtttggattttcctacttctacttcttacagttttattagtttttgttttatgcattttgaaactttgttgttatatatgtatacagttagtgttgtgtctttgttgacttgaccacttctattggatatttccctttattccttgttctgaaatctgttttgtttgatattaatatagctactccagttttattttgactggtgtttgcatgggatatttttttccctgtgcttacttttaacctatctttaaattggtttcttttagaaagcatataattgggtcttgttctttaaaatttaatttgacaaactttgccctttagttagggtgattagaccatttgcacttactgaagttattgagattgttgtatttaaacacaccattttattagttgcctttttttttccccgcacttactctgtttactttttttcttttttgacctctattgtggtcacataggttacttctctaagtttctctgacctcctattgtggctatacattttagttttctatatttttcaaaccgtacaattcactgttactaattttgctttatatagtcagttatctttttaagtgattaaaatcagcagaaaatgccttttatatttactctcattttgattattttcaatatccttcatttatttgtgtaaattcaaatttctttctggtattataccccttccttgcttgaaggacttcctttaatattacttattttagcagatctgtaggcagtgcattctctcagcttttgtttgccaaaaaagtctttatttcactttcattttttttctttgcaggttttattatacacaaagtggggtgggggctcagaccttcttggcagctgctttcctcatggcagtcaggatattgcctcagctcctcttgcttcctgttggtgcatatgtgtgttttcatccttttcttaatgaacttgagggcccgcttgtccttggagactttgagcagcttcatggcatgccactttcagggggaagccacacacctcccagatgatgtcttacacaagctttgtgtgcttggtaaggtgtccagggtggcagccctgcctcagcttgctcatattcttgttcaccttgggccctggttgaggcccatgggcatggggtaatgcagaactatggctgctgctcttcagtgactgctctagcagaaaatttcacgttattttttcttttttaagcctccaatgaatcaccttcatttttgaaagttatttttttctggatataggattctgggtttcctgtttcttttagtactttaaagatcttgctcccttgtctcctgataggcataattttcaatgtaaagtctgttgtaattcttacttgttcttgttgatgtattttttttcctctctcagcctttaatatatttcttttctttattttccaacaatttggttgtgatgtatctaattgattttttttgtttcttcctttctcctctgcccctgtactcttttcccacccttcttcctcccttctttctatttttcttccttctccttttcctccaccttttcttcttctccttcttatcctcttccttccttcttctcatttcttctctcgttttttcttctcctcctacttccttctccccctacttccttctcctctttcttctatctcctctttattctttcttctcttcctccttccctattgttcttcttctctcctcttccctcttccttctcctcctccctcctctttcttcttcccttctccttttccttgtcttctttatcctcctcctcttcctcttcctcctcctgcttctcttccttcctcatcctcatcctcatctttgtcatcctccttgtccttatagggttctctgagcattttggatctgtgatttgatgtcatggaatcagttattttgacaagttcttagctattatcttttaaaatatattttattccttgttttctccctcttttccttggagtttccatttatacattcattagaccattggtattgtcttataggattttctttattaaacagtttgagtaatttctgttgatttgtctacaagttcaacaatatttcttcagctgtgtgcagtctgaattaatgcattattaataatgacatcaatgttttgatctctaatatttttcgtttaggatttccttatgtttttgttctgtggtttctattggtgtgctgaaattccccatatgctcatgtatgttatctgctttttccagttggtctttcaacctatgaatcataggtgttgtaaaatacctttctgaaaggtctagcatcagggtcatccctgggccctgttttgttgacttccctgtgttttggcagtggtttatttcttcttgcagttttgggtatctcataatttttgaatgagtgttggaccttgcaacagaaaaatagtagaggctaagtcaaatagtatttgttgagaaatcagcatatgtctctctctcagactttttggatcgagggttgcatcagtctagttattaactgaattcattttgggttttgttattgccatagtcactgttaactacaaattccttcaatagtgatatgctgttacccatgctttgtgtaatgtgaggttttgagaggattttttcacagtttctctgctcagccctcaggtttagaggtctcttctttgctgtgtcatggcatggggttatctctcttcaggctctgtagtagactgctgctatttattatttaatcctgggattgtggtgggtgtcatagttcttgatttttttgtccagcttcattttctggcagattctgtgagcctggatgtcagaggtggatctttctgtttttgctgtcttctctgtggtaaccaaattttatcttggatttttgggcagtttgggcatgagagagtttcctgtacatttcccagcatttgcagacctctgctttatactggtgtagtgtcttactctcaagtaggttttctatctttttttttccccaggagcatatagcttttgctttcaatcctcttcagaagcaatgaagctttactgagctcttaggaccagagaatttcctgcctttgccccaacggcatataggatttgtttctacccttcccccggtggcttaaattttttgttttgtattggagaatggcctagagaagtggcaaggttctgtgcttatccctcagtgcagccattaaccagctgcattcctgcaccaagttgggctctctctggtctgcagctgtagccccagttgtccttctgagaatccagggcaggacaatggaaaagagctgctgtctggagctcccagtttttctaaactatcatgctagctcatactcaggctttaagaatttaacatttcatctactttcttcttacttacattcatggcagtcatctctgctatccctgccctgccaaagctgttaacatttttgtgagtcctatctctcccagaaggatttatcactcactagaattcattttgcttgtttaccttgtaatctcaggtctctaaagggttcaagaaaagttgcaattgtctttttcagattggctgtttgtcattgttatgtttccagattctaaggaaaagtggaatactctcttcacctcttttttatatgccattcttgcatcttgattttcttcattcagatatcttagagtttttcttaatatcttggagtttgttgaagtcaagacatgactactcttttttgtatttgatcattatattcatcaaagtagtactcatactcaaaataatacatatataaaaaggcagaatttatacaagattaatagtataaaaactcaaggtttataatttaaaataccaaaatatcctgttctccttccctgccactggccatttctgcttcccctttgccagaggcaaccactttaccacctattgtaactatttattttattacttaccactatgggtagtttgtgctatctcttggtttctcatgtttaaatattatgagaagtaatataaaagtaaaaaaattaaatgtactttctgctatggaaaatgagggtttaactctggtacatactccacacatacacttttctacatctttctgtccccaaagtctttaccagtcaagcacatcatgcagtttttttcgttcctttcccaacgtacaccctacccaacccttagagctctttatcctcctcttgtattgcagattgatcgatatgcctgctgcagagctgctgttaaggttcttctcttcaccattatcctgaaaatttctctggcctctgtcctttgttgagttgactattttctggacagtttcccttgttcttggtttactttcttgttttaatggagtacatactttagggccttccctgtgaaggatacatgggaagtaaactttttttttgagatcttgtggtctgaaatttttttatatttgccacacacttgatagtttttttctaagctgtaattctaaattggaagtgaattttcacggagttgggaaggcatcgcacccttgtcttgtacctcccagcattgctgttaaaatttcaacacctgattcttcagcctgtatatgaaacttttacccttctcttccctctcgatgcttttctattttctcaggggttctgagatatgtgtattttatatgtgtatttgataaattgtgttggacatttgagttttaatctagaaattcatatactttaaactgagaaatttcttatttctttaataatttctttacttttatttttgctgttatttatttctgagatgccaatcttatggatggtcttgtggtttttcttttctccccctatttctgtttttgttgttgttctgttttctaggaagatttcctcaagtttgttttctagtccctctctgacattttcacatcagctattttatttttgatttcccagagttcttcctcattctcagaatattccttttaagccttcctattcttgtttaatgggtgtagtctttctcttatgtgcctgaggatttttttttttttttttttttgcattttttttcttctgttctcctcattatctttctgttcctgtggtttggaaccctggatgtgtcttctgaggggcaaatgagaaaagagtcttggaatcttatttttcagtatgaaaccttggaactcccatctccttatttgcagggtgacacatggatttcaccctcaactatgcctggtatccagagcctctctgttttagcctctcccaacaggaaacccctattaggaaggggtaggcacctgactgcatggggtcaaagagttgatagggagatttcataataccttgaaaagacttccagacaaatctttctgtttcagccccttccaggattcatctttaaatgtaccaggtgtactcctaattctggaggctttctagggttctgggtgacacatcaccttactgtgagctctttgttggcttcttcctctgcaggttaggtttcagttactcacatctgctaagctagctacaacttcttcatctgctttccactttccagactttgacttacctcctgctgttgcctcctatatttgtttgctataaagaactgctagagattgggtaatttataaaggaagaggtttaattgactcacagttctgcagggctggctggggaggcctcaggaaacttaaaattgtgccaaaaggcacctctttatagggcagcaggaaagagaaatgaataccgagtaaaaggggaaaccccttataaagccatcagatcttgtcagactcattcaccatcaagagagcaacatgagggaaccacccacttgattcagttatctctacctggttccacccttgagacgtggggattattacaattaaaggtgagattttggtggggacacagagccaaaccatatcatctccttttatatttctcgtttgtgtctgaggggtacagtagaagaaatacagaaagtaaggattgggagatgaactgtactttgtgcttgctgggtttctccttttcaagagagaagttctcgtagtaattactttgacctcatctctcctgacctcttccccttactcttcaaacaatgatctttaaaagaaagaaattttgaagttaggcatagctctcagatgaaaatcatatgttacctactggataaattgtataatatatacatgttttgagacggagtttcactctcgttgtccaggctggtgtgcaatggcacgatctcagctcactgcaacctccgcctcccgggttcaagcgattctcctgcctcagcctcctgagtatctgggattaccggcatgggccaccatgcctggctaattttgtagttttagtagagacggggtttctccatgttggtcaggctggtcttgaactcccgacctcaggtgagccgctcgcctcggcctcccaaagtgctgggattacaggcttgagccaccacatccagccaattgtatagtattgaggtaacataaggtaagaatagaagaaattagtttagtcaaataaaacagattttattaattccacttattaaaaatgaaaaacttgtttagaaagactagaatcctgtggctaattgtagaactgctccaggattctggaaacgtaattatttctctaagaacctaaacagttgtcagcactttgataagtacaggctatgttttggaggtatgaataaaattaaaagtatggtaggaatgtaaaagaaaaattgaacatactttgtttctttctgttcaccaggttttcatgtgaataattattttagctgcttttcaaaatcttttaaatttctttcatcccttggaactggtctacttctgttttctctcatttgtttttgcagtagtcctttccatcctggccgtacctttagagcattcttcttaatagttccaaactctgttcttcatctcactgtttttcttttcattcttagatggcacagttttacttaatctgtaacttttttgctcattcctttctttagcttcttttttctctcctgataatggcagtacaaaggtagcatgattactctcctctagttagaagatgtagtttgatgtcctggcacctgtgcatattatctgtgtgaccttagagtaattacaggaactctaaccctgtttgcttgtctgtaaaattgaatgttaatatcacttatcttaccaaatttttgtgaggatgaaaatgagataatccatatttatgcaaaacacttagcgcattagcaaccccacttttaaatcttcagtgttagctattagctattactactatcagtctattttattacatagtaatttctctcttgtgaaggatgcctgtgttagcattttgcagtcaaaggttatagcagcaatctctcaggatggtaaatgttgatgaagacaggaatttgtgttttaaagagataaaagagctaattagagagagaaagagatgctccctagttcatatgaagctgctggttgtttctaacatactgtcaacttactcttcaggattctttattttcagttttgcttctgctgtctgccactatatatttccttgtcaccctaagatgtatgattaaaaaggaatgaattcaataagaacaacttttttttaaaaatgaacatgggtaaactatttgcagcaattgtattttgtgtttatatctaggcttaattatctatttgacctttgaccgttaacataaatataaaatgctgatcatcataagagataagttaccagctgtacagaaagataatataactaaagtcacttattaatttgatttgaatacttactacttcaaagcatctacatttcagaatgtattttataccaaacactaatcatttggcaaaagtcagaatattacatgttttgcttaaagttaggacttagtttgcttaaagttaggacttaaagttaggacttagttttcaatttttttgtatatgtcatttttttatttttttattttttttatatttgtattttttgtatatgtcattatagcagtatttggtgacccttaccataggacttttctagatggacatagtaacatttttgtctacagaaatgtttgattgttaggttgttaatttgacctcgggaatcatacaaaagctcttttggtcacttaagcatttgtggtgatgattattatttactattttaataagatttactttttggccaggcttagtggctcacacttataatcccagcactttgggaggccaaagtgggtggatcatttgaggtcagtagtttgagaccagcctggctaacatggcgaaaccccatctctactaaaaatacaaaaattagccgggcgtggtggcaggcacttctaatcccagctactcgggaggctgaggcaggagaatccttgaatctaggaggtggaggttgcgatgagctgagaccaagccattacattccagcctgggcgacagaatgagactctgtctcaaaaaaaaaaaaaaagatttatttttttcaccacctagctagagcttacattctaataatacatatattgaatattggctttatgccttgaattataaatttacatgatcagacaaaagtagaaggacataagtagatttaggtgcagaaaaggaataaatgatacccttcatgttagtttcttttgtagccatcatcccagggtcaaagatagagataatatgcagaataaccatgtgagaggactttgcctttgcttaattggtcacctttttttttttctttttgaataagcttgtttctctggatttgaacgattgatttaatctttcagacaggggaaaacaaaggatggagtggtccaaagcctgggtttcctgaaccaacaaataatagtaagttctcatttttatgttgtctgcacttggtgttcatcagtggctcagtgactagctgtcactgggattggttgggtctgtctgggtctgagaggctgtgttaagtattttggagggtacaaaggagtcctggtgtttgctttcctggaactgacagaatagctggaaaactaagacacagatacacttaacacagttaagccattgcagacagactgccatttaatacatgtagtgatcacatgcttttttaaagttgccatttttattgaaacaacattataaaaaatataaaaatataaaaaataatttaaataatataaaaataatttttataataaaaataaagaagtaattatctataagctgattatactgtcaaatcaactttcaaagttccaattattttttatgcacacaaatttttatataattatgatatacataaaattttattgttttcacttaacattgcctaagcattttttgcgttttgctgagtcattagaattttaatattttattaaagtcactaagtgaaatgtcagaagtgtaagaataaaattgctgctttgttccacttacagtattgtcaaacacttaaaaaacaatttcagtttactaatttttttcaaatgtatatgatcaagatattttacattggacgtttagacatttttccttaatactctccctcacttcctgaaaagtatctatttcactgaagttaacattttactgtaaatcagtgaatcaaaacatttggctagtaaaaacacccagtctatcccatttccaaccctatctatcttctttacaacctctgggcactgaaaaagcttaaatctgtaaattatcgtaatccatggttttagtctttgatattagtggctcgtctcttgatgtataatgaaattagtaacaaattcttatcaaagtatgctcataagaattgaattcttggattatcaaaactagcctcttgaaaagaatatttcagtgaggtaatggcattttggggctgctttctgggaataatttaaattaatgtgcttctgagcccttggcctgtataaataggggtgatgaatatgatggccttagcacatagcccaaggaaaaaatggaatcagttcaggattcctagagtttgtgttcagttcctttgatgtttgaatatattggtttataatgatttggtgagggaatgtaataaacatgaaattgattgcagttttatgtaaagtacttagcacagtacctgtttcctagtaagcacgtaatgaatgttgatttccttccatgcctcctccctcttgtcttttataaaaatgatactattctatgtaggcgtgccagaaattccattcttatacttttgtctgtcagatggtttgtgcatacatatggtgaccaagaatatatagcttattattgaatagttacattcaggcactaaacttttttttcaaagaatataaactttatgtattttaatataaagatcaaatagttattaacttgacaattttaacgtgaaatcactttatagataacctgcaggctccatcattaaacaatgatgttttggcccctagctttatgtgtttgtttttttttaacttgctaagggatacatctcatgggatgacaagtgggggatacttctgtcctgtgcagacatgggaaggaatatcacaaagaggccagtgagtttaagtgatcagaaatgtgtaagaatgcataacgggtttgcttgagacataaagttagaagtgagaaaactatttgaagccagcttaaatcttaaccagacggttaatgctttaggaattcatggtctacaatggttcagattaaggctttgaaataagaatgttctgttatctcttcccagctgtaaggaggtgagaaagctgctctaagagttctttgaatgaacactggattgtcccttccttggattacgatagaggataagggcagcccagctctgaaaagtagctgtttcattccccaagggttagttctcacaagtgaaacctgagtccccttgagccagctcattggcacttaaatacaacattaggaagaagttggactgtgcttaggaattgatcattcagatgatggaccaattagctgaaaattaatttaaattcatatattatggtaatatttaggttaacttcttaatcagtttcttaagtttgaaattctattctaaatggtttctgtcctgtgaagaataccagagttagcattttgcaggcaaaggttagagcagggatcttgtgggatggcacatgtgggggaagacaggaatttgagattgccagtgctggctgcctcactgacatactgtctgaccttgaacaactcaatttacatcttattattcaattttctctgttaagagttatgcatactaatttataatgttgagaatctttaattatgtaacatttataaaatgattacccatccttgaataacatctgaaaaggtaacatattactttgtgaaaaacactgtcatcatgaaatggctaactcactatggttttttgtttgttatgttttgttaaactctacattgcttcaaaattgtagttttaaagatcaaatttttagccacccattatttggataaataatacgaaattagcttggaaccataatgtacaaaaatgaaaagggaatgtagaattggaaaggggaaagaggggaattttaatctggcatagcacctaactataagtagacaaaaaacattaatgtacatgtgcatttaattttttaagtggaagatattttttaaaagattacagtcataggaaactgctaacaattacaactagaaaatagtttaaatggttttgcaagtgattgtgattacatagcctggttcctcaatttattttccttgcttgattgcctgcagatttaaaatatggacctagtttttgggtgctgctcaggctttcttcattgtactgaaatgcagcagaaggtagactattctaagtgtgtttttatcctttgaatcactgtaatagttatgttgaagaataaaaacacataactctgtaatgtgaggtttatgttaagtttagcatagggcaattttatgcttggtgtacacataaaaaactagatttttacagatgaatgaataacttttttaaaaaaagatcatgaattttaaagatctactgacagctcacggctcttggaaaactttgtaaaatatttagatacagttcagctgataacatctctttttgtattcacattccatgtttcttattaatacaggcttttacttaaaagcaggttcatagtttcttgaaggtgaactgtagcttaattcaagattggactaagctcaaaggtattcactggtatgtgccaaatccacccactaaaagattattcggaggcatttttcacataaatatttttccgttaaccttttaaaaagttttatttagcccctgtgaaatatgctggcacttgtaggttcattagagatgaccaaagacaaatacttgtggaatgagatagcattcttattgacctctttaggatcttagttgacttaccaatatttttgtcacttttgtttcatatgcatgtattattaaacactgaacatcctgaaaccaggaggctacactgtcccagtgatatgacattgggtagattgcctgctggtttcccaaatgctatgtactatatttagaacctctagtgtttttttggtttttttgggggggtgggtaggggtgggagatagaagggaggtatataagtgttggacttttaaggtgacagattaatatatactttctttaatagtgttttgagagagctccctgaacaaattccctttggggttcccatagtagaaaccactttgtagtgagacagttaaaacagttggagccaattggatgtaaatataaagctgagtgatccaacttaattatttctttagacataaatactgtgttagaaatgtaagaatgtagccagcttttagtgatcttatttagaaggattggtgggttacttgtactgggcagcccagtccctgaatatctggttgttttcaaacaaaggtcccgtaaatagagggctatctgaagcaattgggagcaatgggaacatacatattctcattgctgtccatttgagcctgcaggtagaattgctgcttctcctctgaacacaggaggaaagatccaaatatttcagaatgatatcatccttcttttacattgatgactgtatattagacctacctgagtggtgagaagctatagtctttaaaaaattacattgacaagaattctcctttcttgcctactgaagctaggaaggaagattagaggtaatgttaagcttgcctctgttttagtcataccagttgagtctgtctctgaagatccattgatttaaaggaaaaagaatctgaaattagagagtaagtttttaatcagattagcacagataacatgtttttctgcaatattctccggaaagatttaatgaatttaaattgtgattttaaaaactcgcttggctcatttttacatgtaaaaagatatcagatacattttttttaaaaatggaaataatatgagcatttttaggatgcatttattcattgcagtatgatagtttttctaagcataagagcaacggatgaaaccataaagtaaaaaagatggatttatatacgtaaatgctaaaaacaagttcaaggagccgcataagaaaataaaaaggcaaatgacagtataaattgcagcatagcaacaaattgaatatatgcaaaggacacataaaagtcaattttttaaaaaaaggcaaacaccccaatggccaaaggtcttaagaagacatttaaaaagagcagataagaaatcatgaaaaaatgtttagcaatcaggaaaatggggattaaaaataaatgttatgaaatttctgatccacgcaaattgtcagggatttaaaaatgatacttccaactgttggggaaacagactgtcacatgctgctgatgggactctgacttattgtcattctgaagggaattagccataagtatacagagcttaggcccatttctttgtagggcttggctaaaacatacggaaaaatagattagttttccataatgaacatatactggttttataatcagaaaaaaatgaatatttaaaacacttacatttacaaactttggcctgaaatacacaatctgactgcatttaaacataaatattatatatatgtgtgtgtatatatatatatataattttttttttttttgagatggagtcttgctctgtcgcccaggctggagtgcagtggcgcaatcttggctcactgcaagcttcgcctcccgggttcatgccctctcctgcctcagccttcccagtagctgggactataggcgcctgccaccacgcccggctaattttttgtatttttagtagagacggggtttcattgtgttagccaggatggtctcgatctcctgaccttgtgatctgcccaccttggcctcccaaagtgctgggattacaggcatgagccagtgtacccggccataaatattatatttaaacagctagggaagcagaattatctgtatactgaagtcttgaggaaacttttctgaaggtaaagaagaagaaacagttttctagagtctgaatgaaatttcaatttctgaaatgtatgctgaaatttagaatatgtactgtgtattctaagaggtctatggggatcaaaaggtgtttaaaattagtcttttcaaaattaggagcagactgtaatgataacacagataaatatcttgcagaaattcaaagttgaagtattaagaactacttaattgcttttctctgttagcaaagaaactttacagtaagcataaggagaaaataaaggtaatgctcctaattactcattcagtttgtctagaaagatggagttttataaaatcttaaagtgtattacaatttgtgaagaaacattaactgctattatttttaaagaaaaataggcaatatttgatgcataacgtatttaacacttatataacttatgaagcaagataatgaacacccatgaacccaccgcccaatttaagaactagacattaccaatatatttaccttcacctttgttctcctctttcatatcccccattggctatgcctcccccagcagaagtagccactatctctgaattttatatgtagtcgccccaccctttattcctcataatttcatcaaataaatgagtccttatcagtacttatttaattttgcttttttttttaaactttagaaaaatagcgtcgtatggtatattgccctctggaattctgccctctcccgccccccacttaagattgcaatttaagattattttgttttgttacataaagtatttcatccactatgtgaatatcccataatgatttatccattcatctgttggtccacagttgggatattttcaggattttgtgattataaacaatattattatgaacatttttgaacatttctatgggtgcacatgtataagagtttctgggagtggaatataatatgtgtaagttcaaatttacaagaaataccagttgtttcatagtgggagggcccttcaaagtatctaattttccatgctgtaacaagtagaaatcttttatcgttttttaccttcaatttcatttttgatgatgaatttagttgaagtttagttcaaattccactatttcattaattttatttttcattttctatttttactggggtttttaaatggggaaaaattaaaaatgcaaaacagctctccgtattttttgtcctcattagtgcagtggccaccctgaccttcaagcaggtaacttgtggttgtttttttgtgtgtgtattgtcccagaatttatatatatgatttatatacatatgtataaatgtatatacattttatacacacatatatacacacacaaattcaaatatatattattcaatcccctagccttttgaacatgctgttctacccattttattttagcttaacagtatgtcctgaagatcctttcctattgatatgtatagggatttattattatttaatcaatttttcacagatggatatttagattgtttatagtattttcctattatctgccatgtaaaaacctcatacataagtaattttacgtatgtggtagcatatttgttggagaaattcctacaaatggaattactccattacagagtatgtatccttttaattttgatggatgttgccagagtactgtcaatagacagcagtttacgtctctaccatcagtgtaggagatttcctgtttccctacagcttcaggaacacagtgtgctatcaaagttttgaatctttgccaatttgatagttgaaatatggtattcagtatagttttattttgcatttctcttattaagaatgagactatgtatttggtagatctatgagccatttctatactttttctgtgaatgacataaccatatctgatgtccctttggacattagattggttagtctttttctctcttttttttttttttacttggtaggactgtgtgcatctgtgtgcctttatgacatgaaaattcttctctgttttcttttaaagtttggtttttctttttaatatatttgaatgacattttaaaatagtcttttcttttatagcatgtgtaagttgggtataataaataatacctttccgactctgaaattaaaaacatttctttatttttattttattttatttatttatttattttattatactttaagttctagggtacatgtgcacaatgtgcaggtttgttacatatgtatacatgtgccatgttggtgtgctgtacccattaactcgtcatttacattaggtatatctcctaatgctatccctccctcagccccctaccccatgacaggccccagtgtgtgatgttcctcaccctgtgtccaagtattctcattgttcagttcccacctatgagtgagaacatgccagtgtttggttttctgtccttgcgatagtttgctcagaatgatggtttccagctttatccatgtccctacaaaggacatgaagtcatcctttttttatgactgcatagtattccatggtgtatatgtgccacattttcttaatccagtctatcattgatggacttttgggttggttccaagtctttgctattgtgaatagtgctgcaataagcatacatgtgcatgtgtctttatagcagcatgatttataatcctttgggtatatacccagtaatgggatggctgggtcaaatggtatttctagttctagactcttgacgagtggccacactgtcttccacaatggttgaactagtttacagtcccacctacagtgtaaaagtgttcctgtttctccacatcctctccagcacctgttgtttcctgactttttaattatcgccattctaactggtatgagatggtatctcattgtggttttgatttgcatttctctgatggccagtgatgatgagcattttttcatgtgtcttttggctgcataaatgtcttcttttgagaagtgtctgttcatattctttgcccactttttgatggggttgcttgatttttttcttgtaaatttgtttaagttctttgtagattctggatatcagccctttgtcagatgggtagattgcaaaaattttctcctattctgtaggttgcctgttcactctgatggtagtttacttttgctgtgcagaagctctttagtttaattagatacccatttgtcaattttggctttgttgccattgtttttggtgttttagtcatgaactcccttgcccatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgtcttttctctttattagtcttgctagcggtctatcaattttgttgatcttttcaaaaaaccgcttcctggattcattgattttttttgaagggttttttgtgtctctatctcccttagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctatacactgctttaaatatgtcccagagattctggtatgttgtgtctttgttctcattggtttcaaagaacatctttatttctgccttcatttcgttatgtacccagtagtcattcagcagcaggttgttcagtttccatgtagttgtgtggttttgagtgagtttcttaatcctgagttctagtttgattgcactgtggtctgagagacagtttgttataatttctgttcttttacatttgctgaggagtgctttacttccaactctgtgatcaattttggaataagtgcgatgtggtgctgagaagaatgtatattctgttgatttggggtggagagttctgtagatgtctattaggtccacttggtgcagagctgaattcaattcctggatttccttgttaactttctgtctcgttgatctgtctaatgttgacagtggggtgtttaaagtctcccattattattgtgtgggagtctaagtctctttgtaggtctctaaggtcttgctttatgaatctgggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcttttttttgtttcccatttgcttggtagatcttcctccatccctttattttgagcctatgtgtgtctctgcatgtgagatgggtctcctgaatacagcacactgatgggtcttgactctttatccaaactgccagtctgtcttttaattggagcatttagcccatttactaaaatctctcagcatttgcttgtctgtaaaggattttatttcgccttcacttatgaagcttagtttggctagatatgaaattctgggttgaaaattcttttctttaagaatggtgaatattggcccccactctcttctggcttgtagagtttctgccgagagatccgctgttagtctgatgggcttccctttgtgggtaacatgacctttctctctggctgcccttaaaattttttccttcatttcagctttggtgaatctgacaattacgtgtcttggggttgctcttcttgaggagcatctttgtggcgttctctgtatttcctgaatttgaatgttggcctgccttgctaggttggggaagttctctgggataatatactgcagagtgttttccaacttggttccgttcttcccgtcactttcaggtacaccagtcagacgtagatttggtctattcacatagtctgctatttcttggaggctttctagattggggaagttctcctggataatatcctgcagagtgttttccaacttggttccattccccccgtcactttcaggtacaccaatcagacgtagatttggtcttttcacatagtcccatatttcttggaggctttgttcatttctttttactctttttttctctaaacttctcgctttatttcattagtttaatctttaatcactgatacccttacttccacttgatcaaatcagtactgaagcttgtgcatgcgtcacgtagttcttgtgccatggttttcagctccatcaggtcatttaaagtcttctctacactgtttattctagttagccgtttgtcgaatcttttttcaaggtttttagctcctttgcaatgggtttgaacatcctcctttagcttggagaagtttgttgttaccaatcatctgaagccttcttctctcaacttgtaaaagtcgttctccatccagcttttttccgttgctggcgaggagctgtattcctttggaggagaagaggcattctgatttttagaattttcagctttcctgctctggtttctccccatctttgtggttttatctacctttggtctttgatgatggtgacgtacagatggggttttggtgtggatgtcctttctgtttgttagttttccttccaacagtcaggacccttagctgcaggtctgttggagtttgctggaggtccactccagatcctgtttgcctgggtatcaccagtggaggctgcagaacagcaaatattgcagaatgacaaatattgctgcctgatcgttcctgtggaagcgtcgtctcagaggggcacccagctgtatgaggtgtcagtcagcccctactggaaggtgtctcccagttaggcttctcgggggtcagggacccacttgaggtggcagtctgtctgttctcagatctcagactccatgctgggagaaccactactctcttcaaagctgtcagacagggacgtttaagtctgcagaagtttctgctgacttttgttcagctatgccctgcccccggaggtggagtctacagaggcgggcaggcctccttgagctgtggtgggctccacccagttcgagcttcccggctgctttgtttacctactcaagcctcagcaatggcggacggccctcccccagcctcactgccactttgcagtctgatctcagactgctgtgctagcagtgagcgaggctctgtaggcatgggaccctctgagccaggcgcaggatataatctcttggtgtgccgtttgctaagaccgttggaaaagcgcagtattagggtggcggtgtcctgattttccaggtaccatctgtcacagcttcccttgtctaggaaagggaattccccgaccccttgcgcttcccaggtgagatgatgccccaccctgctccgtgtgctgcacccactgtccgacaagccccagtgagatgaacctggtacctcagttggaatgcagaaatcacccgtcttctgcatcgctcacactgggagctgcagcatggagctgttcctatctggccatcttggaacctccaatcaaaacatttcttttaagttatcttctggaactcttatagtttcattttttgaaatcttgaagtcttgatccatctgttacttatactgaaagtatggacccaactttattccccactgcattgagagttcactgttaccatatactaagattatgaatttggtattattccagactttctgttctcctctgttcatctaactatctatgtgccagttttaatcgttgtctttttttttttgagatagggtctcactctgttagcaaaattctgtcagttgtgcagtggcatgatcatagctcattgcagacttgaactcctgggctcaagggatcctcttgcctcagcctttcaagtagctaattttacaggcacgtggcaccacacccagctttgcccccactcccccgactagagacaaggtcttgtggagttgcccaggcttgtctcaaactcctggcctgaagtcatcctgccttggcttcccaaagtgttaggattataggcatgagccactgcacccagcttaatcattgagtctttcttgtgttttaacatgagtcagtttaaagtaatgtgtgttttaaacaaatgtgaataaagatgtacttggtctgtaatcttcttgcacgtactacatggagtacaagtaattgaaaagacaaaaatctccttccttggcaacagaaataagagatgtgagagtagtcaaagcatcaattatgaagcactaaaataagcaacagggaactaactgtatggttgaaaactattaaggttcaggaaggcagtgcagatagtttccctaaaacttctttgtataatgttaatgcatcattcattctttcatttttttagaaagtatttgtttattataatgtaccctttttggtattattgatgatttcagtagtttttaaagatgaaattgcttattgaaagacgagtccatatttaagataaacaccaccatcctgcccaactcccccctcccccccagcgagtaagaaaaggtgggatgcctgtaatcccagcacttcaggggctgaggtgggtagatcacttgaggtcaggagtttgagaccagcctggccaacacggtgaaactccatctctgctaaaaatacaaaaatttgccaggcatggtgtggcacatgcctataattccaattactcaggaggccaaggtgggagaattgcttgaacctgggaggtggaggttgcagtgagcacagattgtgccactgcagcctggaccacagaatgagtgagacttcatcttaaaaaaaaaaaagagagagagacaaatattatttgaaaaaaaaatcaatttttttaatcgttttttaatcgttttcttgttgcccaggctggagtgcagtggtgtaatctcggctcactgccacctccacctcacggattcaagtgattcttctgcctcagccttcctgagtagctgggattacaggcatatgccaccacacctggctaattttgtatttttagtagagatggagtttctccatgtcggtcaggctagtctcaaactcccaacctgaggtgatctgcccgcctcggcctcccaaggtgctgggattacaagcgtgaaccactgcgcccggccttttttttaatcttaaaaagtaaatcacatagcacagtgtctggcattgttggtgctcagtatttgagcaaatgcaagaattgcattttcacttttttccccactgtattaatgatcttttgagtagtttataacatataacaattagaattctaggaatttaggtgtgatccagacctgagattctcagcgtggtattgttggattcaatataataatggttggcataattagtatttcagcaacctaatggaagtaatacagttactcttagtagattgctttgctttggattagaattttatttgaattcagacctcaagatgttctgaatctcaggttggcagtctttgaaagatgatttattattacttaataaatgcagtctgtctgaaagacagatcctttaagcatggtatacatagaagaaaaacaacataaggaggcttaagtgtgaaaaggttggagaatgtccaacctcacatgttttacatacaggaaaattgaggctcagttgattttataacgggtctaaagacactcttagttaaaggtagtgaagacttgaactcatgtcttctgactccagggtctctgcagttgccactagacagcacctttatttctagatatatcatttgctggtaattaaaggaaaaaaagagaatagtgtttttaagaaattccattaaaattaagtacgcatttttttgaaagaatgttttatatatcatgtaccagaatctttttttataaaacatttaagatgttttattacatggaaaatgttcaaactattgtttcagataccagattgatatttgggtggatcatgtaaaaacactaaatggctgagaaactatgtgaaatgtttgttttaactattattacatcagtgacacagccatctacattacttgatttttcttaagatttaaaaaaactttagtaatagtcaaatttaaaaaacactcaacaggctttttgggtgatgttattcaagtgtgttcttttattccaagctttctggtttgtgttaagatgattcatagattattagggctgaaagaaatgaaaagttccttaagactaattcatcttacagatgaagaaagcatgataaggagaatatctgctgcctcaactcaaacccagatagctgggctccagtctggtgcatttaccaatgtactattgttgtttttactttattacattttgtgttaatacagaacattagacttcttttttttgctttaccactaaaaaaattaaatccagtaagttcttacttaacatcattgataggttcttggaaactactactttaagtgaaatgacatataacgaaatcagttttatcataggctgattgatataaacaagagttaagttctcacaacatatttgtggttagagaaatatcaccagacttctcaataaagacccaaattgtaatattaaacattgaaataaatatgagcttacatgtacaattaagaaagtttaataaaaacaagataattgtttactcaatgtggggtgaataagtgagtgatagcagtcatggtggtggtgggttaaatcaaagtataaatgtttgcaaagtgaaaattgtaagcagtacttcctaccaccacacaattaaaaaacaaacaataacaaatatggtgggctcactgaacacttttatactgcattgtttattgttgtgcatttgtgtaatgtattagtctgtttttgcagggctgtaaagagatacctgagactgagtaatttataaagaaaagaggtttaattggataatagttctgcaggctgttcaggattttgcttctgggaaggcctcaggaagcttacagtcatggcagatggcaaaggggaagcaagcacatcttcacatggccagcaggagagagagagcaagcaggggaggtgctacacactttcaaacaggcaaatcttgtgaacactctatcaggagaacagcaagggggaagtctgcccccatgattcaatcacctcccaccaggcccctcctccaacactgggactccaattccacatgagatttgggtgcagactcagagccaaaccatattatatgattattgtgcattttacagattttaattttacattcatttgtatacattcagtcattcattttctaacccacttattccagttcaggattgaggttggtcagagcctatcctagcagcttagggagcaaaggcaagaaccaactctggacaggatgtcattccattccaggacacatgtgcacacgcgtgtgcgcacacacacacacacgacacccatactgggacaacttagacctgccagtgaacctaatatgcatatcttttaaatgtgggatgaaactggaggacctggagaaaaccagtgcagatatgggcagaacatgagaactccacataagacagtggcccaggtgggatttgattttttttctcatcaatattataacaaaatgatgttgaacaaaacaacattatttgaggacccactgagtatattttcttttttttttaactttcattttttaagttcaggggtacacatgcaggtttgttatgtaggtaaactgtgtcatgggggttgtcatacagattatttcatcatccagatatgaagcctagtacctgttagttatttttcctgatcctctacctccttccaccttccaccctccaccctccacccttcacccttcgataggctccagtgtgtgttattcccctctatgtgttcatgtggtctcataatgtagctcctacttgtaagtgagaacatgcagtatttaatatctgttcctgtgttagtttgctaaggaaaatggcctccagctccatccatgtccctgcaaaggacatgatctcattcttttttatggctgcatagtattccatgctgtatgtgtaccacattttcaacaaatggtgccgggaaaactaaatatcccaggtatccaaaatatgctggctctgtcggcactccaagtgaagcaagacaaaaattagtcccttgggaagccctctgaaaacgtaaaatgttggatgcacattccactcacctttaccccaagggagaagttgtgatctggaatgctctctcccggcactaagctatgtggcactaagctatgctgacttaggggggtggtgtgggtaaagtgaaattgttcttacatgtttcagtgtggccattcttggctttgtgctcatctgggatactgcaacttcttaactggattctggaattctcaaaaaggtattttggtctgtatatcattgttaaatcaatgtatgagttaggaataagggctgggacttcctgttctaccatcttgctggtgtcacccaagacttcttttttattaaactttttattttgatggccaggcatggtagctcatgcatgtaatcccaatgctttgggaggttgaagtgggaggccaggagcttaagaccagcctgggcaacatagcaagatcctgtctctacaataaattttaaaataattaataaaaattttattttgagaaaattgtagatgcacatgcagttgtaagaattaatacaaagagatcctatggaccctttgccttgtttatctctggtaacaccttgcagaactatagtacaatatcacaactaaggtattaatataaatatgatacagaacagttctgtcaccatgagagttcctcatgttgtgctgttatagccataccctttcccctacccccagccctggattgagtggaaattctggtccccatatggtctccactgacaccatagtgaggtgaccttgttcccactagttctgattctcctttattctctcctgacaccactccagcacggaggtggggggcatcctattactgctaggtgggggtagaagtttagtgtccctacatgatctccactgacaccacggggctaggatgaaagtccaagctgcctactcagttttttctgacactaccacatcagggaagttggggagagttgttacagctttgcaagggtgaaagtccctctctgcctttgatacatagataaaagtgggagaacaggtttttttgtgtgtatttggctggactaaggtgtgttttgtctaaattttatttcttgctaggcttcttctttcctggttctaaaaagtgaatttgttatttttacaagaaaatttaaaaattggataagtactttatatatatatattattttaaaaatacagtttttgagatgaggttttgctgtgttgcccaggctggtcttaaactcctgagctcaagcagcccttttgccttagccttccaaagtgctgattataggtgtgagccactgcacccagcccagtacttaatatttatacagttccagttagttgtttttattaataatattgtggattcttccataagtttctgaataatatataatagactgaataatagactaatgtgtagtaaattgttaaatcataattagatcatataaggagaattgtaagaaagtgttttgtgggttaagttctttcatcctaaggctgtgcttaagtttttctttgtgtgaacctaatatttgaatttattttcttcccacaaacaaaattgtgaaaatagccaagtgcattatttttacatttttcccaatgggtggttttacagtgagaaaaatctcagtctctctctctctctatcttttttaaagagacagtgtgtccaggctggagtgcagagttgccattatagctcactgcagccttgaactcctctgctcaagggatcctcctacctcagcctcctgagtagctgggactacaggtgcatgccaccatgcccagctaaagttttaattttttatggagacagcaccttgctgtatagcccaggctggttttgaacttgtggcctcaagtgatcctcctgccttggcctcccaaagtgttgggatcacaggtgtgagccactgcactgacctccatcttttcttttactatgagaggggagactgaggttcattgagcctagaaaataggtctgaaatgaagaaatgaagttcaatatcttgacagtttcttgtctctatcatggtgttagaatatttcaagaatctaaatgcccagaacttcttaaatgtatagatataagaacagtagttcttggtttatttgttttactactgaaaggtagttatacttgctgactgtagccagatgcctggatactgccccaacacctgccacttactggctgtgactttaagccagtcatatcacctgtgtcttagggccttcaagtgtaaaatgggaatattcatagtccctacttcttgagggtcattgtgaggattactaaactaatatatgcaaagcatttggaacaagcctgatatctagtaaggactctatgagttttagccagaattattattgttattgtattgtactattattgtattgtgagccgtttgcaggtattgactaggaagcaataggaatcctggcagaggagtattgtggtgcagtgtttggaagctgctgcggtagacatttcagtatgtgtttcttcctgctgagagatcaggtcacttttgtcatatgtcagacttatataatccattttttggtgtttttctgtcgtagggaaatcataactaatggagtttttctgagaagaatcataaccaagaagaacgatctttattttacgagcaacattttaaccccacttaaataaactaaaaattgaagatgactcattatcctcacaaggtgctctcaaacatcattttcacagcaactattttgtcttacttggtagaaatagtcacagttgtgtctttattgaaaagctgagccttgaaaaaaatttcttctaaataagccaactaagtgaaatcttccttattattaagatgagtggtgaatgcgcttctggggaattcctgaactccccaatcacttccctgcaccacactgactctgagtcatatacaatgtgcactgcccttgttgtgaagtcaacctatttcaaactatttaggggcccttggatcactattaataacccctgtgccagactgttctttgatttgcatgactcactttgggctccagaatcttcttgttaaagaaaatttctggcaaaagtataagttactgcatttggggtaagggttaaannnnnnnnnnnnnnnnnnnntcaccataccccagggtttatattctttgttattaaatactttcccatttgcctgttttaaagaaaaaatagcagccagtcctgaatttgaaaactcactcgcacttttatttgactaagggtacaagctttccaaaggcatttcccagttcatcataaattgatctttaaaacatttttgaaaaacctttattgctgttatttctgttcattattggtgttttgaggaatatgtattatttactattttgtattcctccttcttcctcttggaggtgtgctggatgctatgtcatgacctgggattctgcctttttgggggcaagactggactaagtgcattttcccgttggtactgtgttcaccaaaaggcaaacatcttcctgaaaagttctttgtcagtaattttattcataaacattcaccaaattaagaacccttcacatacatcattatgttaaatgtagcaggaaaaaaaggaccaataaaatgcacaaattaataaaatcagtgcttccgttcaactctaagggtaagagcaaggttgattttcaccactgttcaggttatgctttttgagcacattaaaatacatcattttggccaggcgtggtggctcacgcctgtaatcccagcactttgggaggccgaggtgggcggatcacgaggtcaggagatcgagaacatcctggctgacacggtgaaaccccgtctctactaaaaatataaaaaattagccaggcatggtggtgggagcctgtagtcccagctactcgggaggctgagtcaggagaatggcgtgaacccgggaggcagagcttgcagtgagccgagatggcgccactgcactccagcctgggggacagagcgagactctgtctcaaaaaaaaaaaaaaaaaaaaaaatctgttcagtaatgactctttttttagtgtgtctttttcgtttccaaggtgattctgaaactgatcttaagaagaaacctctaacaaattatttacctatttttttattttttcattgttttgctgttagctaacattttctctttttagttttccacaagagtttatattttgcattgttgatttttgatttcataagtagtatatatttggcttaaaaattaggcagaactaagggtctgagggccttatctggaagaccagatttgcagtgagctgtgtgtaaaagaagaggtggagtcacttacaaatactacctgttcgatttgatcccaacaacagggcagcaggaagggggatttctgtagctcacatcagtctagtagctaaagatcatgccaaggatgcattccacctgtccctgaccttcagggacatgaccatggtggtccagtaggctcccttgggtcacatgtactcttaactaatacgtggcctcaggctaccctgggagagaacaaggtcccggctatgaggcccacactgtcatcaggatctcccttgctttcatgtagctaaaagtcaagcacccagagcctggggagccagggcctgtgcattaggcaaaggccgtgagcaaagttgtcaaggagcaggcattgccagtgccagccctgcttatcctcagagctatatctaggaatggtgctgccaccagtccttcccactttggtgtccccatcaccaccctgttctggggtctctatgttgagggagaggcccaaagcagcataaaacggtgctttcaaaaaaacttttaaaagtgtaataatgatagactcacaagaagttataagaatggtacaaagaggttgcatgtacccgtcactcagcttcttccagtggtgatgtcttatataactatagtacattttcaaaaccaggaaattgtcataatacaatgaactagactacagaccttacttagagcctaccagttctcatataaatgatttttaaaaatcactagagacagataatcatgctgttgttcataattttctcacatttcctgttttgaaccagaagcccctgtttctagttcttaagaatttttaattataattttttattgtgaaaaactcactgtagcaaagtgggcctgagtattattggatatttgggtatttataaacaaatttatagtccaacattgttgaggcgtaaattcaagctggcaatggaaacaaagttttttttttcaaagcttttctgtgaaaaatgaaaagaaattatttgttgtgaaatagctatgcccattccaaggacttccagagaaactgggagttccagtggagtggcagtaaccatttggatcagtggcattatctttcttgctgcctggcttgctgtgttttaatacctctgataccacttgctactcacaaacacttatcttcttcagcatctctgaaagaatcatgacatcagtgatcattgaaaggcaaggttctcctaagttcgcttataaaaccttttaagagctctccaattcaaaagtccctcttcaactcttcagtaagaactggagctccataaagatgctccaggaagatttgtgtgccagaggattcatatacccatctgaaagaagcacagatctactgagcaaaaacatgtcaagtgggtacaatagcctggtgttaagatatcacagtccctggcaactttagacctttaaaatcatgtataaactctgtatacttcagtgagattttggtgagctcatctctggaacatctagggacaaccatcatgacatgggtcatccttggaaccaatctgggcaaaccccgggcatttacttactggatttaagccttaggggtttggagctggtgagatgttgcatttagtttcctacctgttcttttaggaggctatttaaggtaatggttaagtattcaaactctagagacagactgcctggagtcaaattctagcattgctgcttattatccatatgaccttgggagagtttcatatcttctccatgcttcagtttttttcatctctaatataggaaaataataatgcccatttcatatggttgttatgggaattaaatgagaagtaaagtactagaacagtgcccatgttgtatctgcgttgtaactgtgtactgtagttatagactgtaccaagatgggagcatcaaaggcaaaaccagggacaaaagatagatgatggcagaatgggttcaggacctcttcagataaagggtgaatgaatataatggatgttacaagcctgagcgagggaagtgtagtggttgaagtccatgagcaaaattgaggtcaaagaaggcacagacctaaagtagctacatgagaaaaagtttatcctgagcagtaaccaaacaaaaataaattaacaatgaattattgtagagtggcaatgattatttagagtaactgaaacgtgttgtgggagaagtgtgggaaaacagtcacatcctactaatagaagtatgaactggggtagttttttgggagaaacctaattagcaaaataaggtccttaaatatgcataccctaaattactctttgattctacttttagatctttatactattgaaaagcgacttaaatttacaacaggaagatcctaagtgaattaacacccatccaaatactgttactgatgttcaagttaaaagtcattcagttcttgaccacataaatctatgtttttatgctatttctatgactagtctgttagttgaactctgtagaaagtaatctttatttgtgaagaaaagtccacttaggctttactgtagaataggagagcctgaactccacgttcttatgctgtgaggtaatgcctctcttgagtgtggagagcatttttgttgctttataatattgctattggcaaacccattagtcctgtataataacaatactgaagtaatgctgttaagtttcttgattttttaaattgagtatagaagttagaattataacatttaagttattctttaaactaaaatatatataatgtttatgcagatagtaaaaaacaaaaatcagtaatatgacactccatttgtcaaattggcaatttttttttacaactttattgaggtataattgaagtataataaactgcacataatgtctacagtttaatcagtcttgacattttcatctcaccaaaagatttctcatgcccttttgcaatctgtcactcccaccagctccactccccagacaaccactgacctgctttctgttactattgataactggcaaagatttttttttgagacagttgcctgggctgtagtgcagtggcgtgatcttggctcactggaacctccacctcccgggttcaagcgattctcctgcctcagcctcccaagtagctgggatttcaggcgcctgccactacgtccagctaattttttgtatttttagtagagacggggtttcaacatgttggccaggctggtctcgaactcctgacctcgtgatttgccagcttcggcctcccaaagtgctgggattacaggcatgagccacagcacccagccttaagattttttatagtaatttccaataccaaaataggaaacaagatactttcatatatctctgtgggcgtctgatattggtacagcttctttggagggcaatttgttaagtgtcaaaaactctaaaatatcctttcaactagcaattccgcttctaacttgaggaaataaattttcatgtgaataaggattgagttacaagaatgttcatcactgtgtttataattgcaaaaaactggagataaattagatgtctgataatatggaattgttttaagaaacagttcatataatgaaattttatacttttagtattagttgtagaaatatattgttttataaacagtgacaggatcatattttattcctatgtatttaacttgttttttcaagtaaacaacaactaaaaagtgcatagataaaacaggattaaaaacatatctttaaagcaaaatgttgaaagtaatgtcctctggctgatgagatttatcttaacttttttcagtacataatgttttcttgtaaaaaaatttattgaaattttttcctgattataaaaaaactaacacatgttaatgtagagaatttgaaagctaacataaaggaataaagaaaatacataaaataggattgatatacagtcatcccttgatatccgtgaagaattggtttcaggacaccttatagataccaaaatccacagatgctcaagtccgtgatagaaaatggcaatggcatcatatttgcatataacctatgcacatattccagtatacttaaatcttctctagattacacaacatcaaatattatataaatgctatgtaaatagttattatattgtattagttttaaattttgtatttttttttattgttgcattattttttattgtgtgtggggttttttgttgttgtttttgttgttgttgtttctctttgcaaatgttttctatccacagttggttgaatccagggatatgggactcatgcatgcggaggactgtctgtattattttaagctatttaaagtgtttttaaaaaaacttacaaaactcttttatacttaatggcatcaggataaagttccctggaccttggcccctgcgtgcctccacctgcatttgcaattctgactctctgtatgctcttgtgataaggcatggcctgaggtttcctagaacacaaaccctccaggtccctgcccttgctcctgctggccatctgctctcagtcctcttcctcctggactgtattctcctcatcctttgaaatttactgtcatcgtcatctccagcaagccttccctgagcttttagcacttctcctttcccattcccactgctctatacacctgtctctagtgagacccctatcacattgtattatccattttcgttcctctcctgatagactgagcatgacttgaggtcaggacagtattggttggtgcgatgcctgaagcttaactagcacaatagcagttggagcttaactaagagagtatgtgcatgtgtgtaaccgaacaatagaaataaagatgtgttgggatcaaacagcctggagtattggatatatctgtgtaactggagcatgggatcttcatgaaatatttcgtagatgaagatagagcgataagtaggagccagattattaagggcttcctaggttatcctaaggagtttgggttctatagtgtaactgataaactggtgaaagacctttaagtaagagaatgttctagccttggcaagatggtagaataggaagccctggaacacagcaattcaacaataatttataggcaatttttctttgtgagaaatccagaaaccagttaagaggctcctgtatgccgggtgagcatgaaaccagccagatcttaattggcagggaaatttaagataccctcatgccataatccctcctcacagtgcagggccatacaatcaggacaaccaccctccacccccagctcccagcttctttctgcctagaaggggaaagatgtataccacgcatccaatgccttagcttttctggggctacccagaggactggcttctgtctggccagtctcagagtgctgacaggacatggcatattttagcaaccccggggccaatgaagaaagaggtggctggtggtggtggtcactgtaaccatccccctgctcagcccagcacaaagctaactgttgaaaagcttcagctttcagctttttcctggagaggcaaagaggagcaccatgtatccaatgacccaacttatctgggagttgcctgaagaattggcttcagtcttgcttgtctcagagctctgatgggactgagacaagcaagggactgatgcctggggactgccaagaacaaagaaagtggattagactagcataaaagtttgagaggcctccagaatctctgtccaggctgattggttaggatcttctccagtatgaggccagtttgtgcagacacaaacacagagaatcaaggaaaaatgaagaaacaggaaaacatttcctaaataaaggaatgagataaagctctagaaactgaccctaatgaaatggagatatgtgatttacctgacagagaattcaaagtaatccttacaaacattcccactgaggtctggtgaacaatgcatgaaaaaaagtgagaatttcaacaaaaagaaaactttaaaaagtagcaagcagaaagcatggagctaaaaaataccataaactgaaaaagttaccagagggattcaatagcagacaatgtcaagcagaagaaaaggtcatcaatctcaaagacaggtcattggaaatgactgagtcagaggagagttgggctagcctccagcatttcccaaagtgttagctgttttattcatgctatgttaaaggcttggacaaaaagtaaactcaggaatcctgagttaaaccaagtcgaatagatttttgttctttgagttttctgattcttcactatgctaatgtgtatttttaatttcacaaaaggcatttgtattatgtaatttgcattattttcagtttttatttatggaaccattttatttggggaccatgttatagaacacattttgggaaatggacactgagaatactagcagcagagaaacattgaaagcttgaatcagaaggttagcatcaggagaggaaggggcaagaacaggaaattaagttgtgtctctcagagcacattctttatgagtggtgacttaccaataattttaaaagataatatcatttgagagttattgatacctgatcaaaagataagaataagcagtttgaaatgtggtttgaaacttctctgagacaaatgatagtcaaaggaaagtgcttctctaatatggtttaagctccatcaactaatgacatagcccccactcctcttgatttcagaacctgtccatggcctggcttgaattaatgcactagataatccctacaatggtcatattcttgagatgtttgagcaacacgataactacttgcttatgagtaaatcagagatggttgccaggagtctaggttgggtcatgagcagccacatggtagtatgagcaaagcaagttagagacagtgctagttttgagatgatacccatttgcttttttatgtgttcgtgagttagagttgtctgtgggacatccttgtggaggtgagaggatcactaggctgttgaatacatgcgtttgtacctccaaagaaatttggactgattcagcctttattttacctgatgtgcctcaattgctgtatgtgttggggtttcatgcctcttttatgagatataaaatattaaattgcagggtgaagacactgcacattcctgattttctgccccattatacttccacacattcagtttcccttgtccctttatagcttcactactacacataagtcccattgaaaccactttttttggatgtttttaaacctctaattttaggaaaattgaaatagacattattcacctttcaatagaagctgcaactgcctctacagtatgacaaagatacttgtttggcagtgtttctcatttctttgttactacaccaagtaaagccattgagttaataatgctatgtttctatttcggttattttaagtgtaataacagtgttcttcattttatttatagctccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtgcttaattttttaaatttgtttttatttnnnnnnnnnnnnnnnnnnnntaattataattttaacatatcttcactgtagtcaaccatgtaagagtctgcttcccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaacaaagttgttttaacttttaattttgtttcatcacccagtctttaatttgaatttataaattacaaaaagctactttgatcaactgaatgtaggtatccaagctcaaattcttttaaacctacaaaataggtaaaattattatacaattaaagttattaataaaactgacttaagagagcagaatgtgaccgaacacttacacattctcagcagttctgttattcttgtttggtctcacctaaagtttttatcgtattttagaatcgaaccttttggatctctgtcagaaatgaatgtttatttctttcaagttttatcaagtattaatacgttttatttatattcttttaaatgttttattcagtagttctgtgaacttcagactttgttgttcagcctaatcgtatgcttctgtaacttctacacattttataagaactcattcaaagttgtagtcctaccatagtgtttcagggttccttgttgtgtacacttttactataatggcaaaatgtttcaaaatcattcagctttttaaagaaacttattatgcaaaagacactcttgaaatgctgtgcatttgagctgaagtgaaagaatttgtttcatgttgtactttgcattattttaagttttcacatctttaatatgcttttctatgctaattatattagaaatctataaatataagtggtttctttgtttaaactagtcattaaaaattaggttgaaaatgaaagtggattattttagcaaatcgtcccttctagatggatttcatttcagtttgctattctgtgcctctcctgtgagcatcatccactgtaacagtgttgtttgtgaaaccttccgagtatagtgtaacaaactaggttttttccctcacataaataatataaagaaacacttagttggtgttttagttaaactataattagtttattgtccaaaatcagggagtgttttatggaggggcatttcattattgatcataatcatgccatttccagcaagatgagattgtccacttaaattaaaatcttccttttcaaatataattcacgctgaatacatttcaactcatatgcctccttttgtggagtttaatatgatgatagcaggtttttatagccacaggcttcttttaagtatttattttttaacaatatgacttagtataggttatattgggatggggctggtggaagtgggggggtggtggctggtctccctgagaatctgagaatcaacctttcacctatttattcttatctctcctatacctcatgttttccaatccatatagttatcatcaaggtggctatttgcagcagctttttttttttttttagaataaggtattcatttttgttaggagatcaatacaagtacaattttgtaaattcctcttaggagaatatggagaaagaaataatgcatgtacatacacacccacatttaggaatatagttgtctcttggtatctgcaggaaggattggttctaggacccccaaagataccaaagttcatggacgctcaagtcccttatataaaatgttgtagtatttacatataacctacacacatcctccttatactttaaatcatgtctagatgccttataatacctaatataatgtaaatgctatataaataatggttataccatattgcttttttgtggttttttttcaattcttttttaatatttttgatatttggatgcatagcccatggatatggagggcccaactgtgtgttttcccttatttttaatttgtcattgaaacataacttactgtgttgcctctgagaccaaatgttcatgtaggctattaaacaaatgtataaaaccataataaattacttagactacaatgagcaaaacacatttgtgggtttggtcagcagatactgctctgatttgccattaaaatcttaaaaattcttaaaaagctctcttgaatttgacctctactaccttccaaggaccttggaaaga

SEQ ID NO: 12929 - DNA, 8735 bp, Human
aatcatagacatctgctaatcaaagctgacagcatttccagatcaggctggttttcctaggactgtgaccttgtaacatgacatcagaatgactgaaaactggcacaaggatataatgtgcaaaatacctcagattattaacccactttgagcaagtgtgtcctatacttttcagggcttcctgaaaacttgaaagagaacttctgtaaactacccccagtatcctcagaagtcaagaataattatttacttgagaatgttgaatacaacaagagaaaaggggaagggaagacaagtatattaaaatgtcttcaaaaatatctttaatattttatgtaaaatttcactgtaggtaattgtttgtattaaaaaaaaaagtggatcacaagctaatatgtcaaaggaacagggaactttaatggatgcactgacattaggaaatgtgtgggaatacactgatctggtcaaatcttcagaactccccaaggctatctctctgggctgctacggttcttctccaaaaacatagatacatacaaaaacatagcttcatacatgcttggttggggtgtaaaatggtacaatcatcttgaaaaaatcctttggcagtgtctaacatttctaagtattttatccaagagtaataaaaattgcaggtccacacaaagcagcttttttcataagagcccccaaacaaactagaaacaacacaaattccagtaataagacatttgtgatatattagaatattactcaatgatttaaaggaacagactattgatacacacagcaacatatttatacattgtgggatattcatacgttttggtaaattcataccttggactacgcaggaattaaaagaaacagactattgatgcagtgacctgggcgtatctcaaaaacaggaagtgtgagaaagaaatactacacagtgaatactttataattccgtttatatgaaattcaagaataggcaaatctaatctatggtaatcgaaatgagaagagtgtttgcccctggcctaaggatggaaggattgatttaggaaaaagtctgcaggagctttctggagtgatggaaatgttctaactcttttttttttcttcttcttcttctttttcttcgtttcgagacggagttccactctgccgcccagactggagtgcagtggcgccatctgggctcactgcagcctccgcctcctgggttcaagccattctcctgcctcagcctcccgaggggctgggactacaggtgcccgccaccacgcccggctaattttttgtgtttttaatagagacggggtttcgccatgttggccaggctagtctcgaactcctgatttcaggtgatccacccgccttggcctcccaaagtgctgggattacaggcgcgagctaccgcgcccagccaaaatgttctaattctttattggtggctacacagttgtcaaaatttatcaaactgtccacctacgatatattataagcctgtattaaatgtaaattagaactcgattgaaatctgtgtgtataaatataaatatacacttatttacatttctaatctaatctgaaggtccattgcaacgaatcccgctccgctctgacccaagaactccgcactttctctccaccagcctttcaaatacctgaacttcatgccttcaagaggtggattccggcttctttacagcgcaatcactagcaggtcatttccgtctagcttgcagatttcccattactgacacaaacgctccctcagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggtatctggccgctccaggagcttctctccccaaccggcggagagggcgcagcgggccatggggccccgtgtaggcgccctccaagcctcgctttctccaggtccctgccgcgcgctccgctggcaggggggactcgctcccaagtttgcactttctctgcagaggcccctccgctcggaaggggacagaactccccgggatgttctttcctcctaggagctacgcctgaccactttccctctcttttgctctccttctgccccttcttcaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaagtaagtgccctgcgcgcacccaggactctcgcgctccttgcgccggcggctggtagcagcttcgccagtttcccacgtctcgctttctacaggaagttttagcctgggttttctcaagtgttaagcaaacctcatggttttcagtttcttaaaagtaatcacaaatttacaaccactaacacatttcctgtctcccaactgacattgatcataattcagtgcctgtgcggactcagggaaagatttgttccctcaccatggggtataataaatgcaagagaataacgtgttaggtacaacgtaagtgcttctctgtatttttcattaattccaaacctatgatttttatctctcctggagtacatcatttccttctgtcgattatccatcaatctgaaatatttttagtggattttattattgaagtgtgacttagctcattatataactctacttttgtcccgatacccaaacatgtgttggattagttgcgggacatggtggagattcataatactgttatattttaatttatttttaatttttaaattatatcggttaaggcctgtaagagaacatggggcttttccattcaaggaactgagccaggggaaaatgcgtattcatgtgaataagctttgattcactgcatatgtacaatcagagaacacccagagaaaacagagagtctttctactgaacttgaaagatacatcacagctgagtcagctctgaatacactgttagaaaaaaaaaaagtaaatatctggattcatgggagtattctgggtatttactatcccaacactaatacaacttctctccccccacaaaatgttgctgaaaatacagtgatggtttaataagaaggctacttttgactaacattgttctattaccctccttttcctagaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaagtaaatacgatttttatggtatttctatttcacttttttgaaaagacatttgggtggaaaaaactcaatttgatgcgaaattaacatgtgcattttcatgatttcacattacttgacaagttagtgacttgtcaagttcttaggactggaaagtgacaaagccatgattcaaatttttgctttctgcctcttctgatttgttgtttttgagacggactctcgccctgttgcccaggctggagtgcagtggcacaatctcggctctctgcaacctctgcctcccgggttcaagcgattctcctgcctcagcctcctgagtagctgggactacaggcgcccgccaccatgcccagctaatttttttttttttcttctttctctttctctttctttctctccttccttcctttctctcctttctttttctctttctttctttctttctctttccttccttccttccttccttccttccttccttccttccttctttccttccttccttccttctttctttcttttctttctttctttcttttttctttcgacggggtgtcaccgtgtaagccaggatggtcttgatctcctgacctcatgatctgcccacctcggcctcccaaaatgctgggattacaggtgtaagccaccacgcccagccctgaattgtttctttagaactatttctcagctactcaatttatgcataaaagattaaagtattcattaatgaatgttatgacctcagatttgtacacaataagttatacatgtgagatagtggaatatatacagaattaagatggtgaaacttgaaaatttctttctaaagttttcggttagatttctgtattcttcagtaattgcaaattgcagcacaaacatctccacacgtttctgtcctatccatttgttacctctcccaccaccacccctgaatccttgaaatgatagtctcttgagtagtatttaatgtttgcagagggagacaatacaggcatttcccccagacacagagatttttgaaaagttcaacaaacaaggaaaacttgctttggcagagaatttgataaagctttatagctgtactgtgttgaatatgcaaaatcttgagttaatgtggtgatggttactgtggatgttctcttgtttgtgtacatataaatgtttgctccagtggttacctggaaattagtatgcatatattattgattaataatggaatgagagctgttaaaaacattaaagcaaaactaccaacacgacaaaatttaccaaatcatgccacatattgtccttgaaacttaccccatttttacctaaccatatctggtatttgggtttaacttctttttacatttaaaggatacaaagatgtagcttcagaagaaattctatccagtttacaaaaatttagaattaccaaaatatagcatgtaagcttacctgcaatttgaagcacatctttttaaaggtttagtatgatattttggattcagactgaggcttctatgggattagattttcttcagttacttcagtaatcaccataatttaaaaattctggtattataacatttctaattttcttctcttttttataaagttccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaaggtagtgaatgttttcttattccacctttagataaactttataaataacttatcagaaaaattatatttttatttatccattttactaatagcaaattgctgtttctagactacttctacataagtatctccgtagtgttaatcagttttgtcaaaatgcttttactggctagctgcagtagacggtagctgtatcttcatatcttaaaggtaaaatattattaactgagtgtataatgagttttgacttcacagtccttaaaaataagatgaagtgagctcaataaccttatcagaaatagtgatttatagtgagcctacagactggagatgtatgattttcattgtcgttttattgattttagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaataaaaaagaaaaagcatttctttaagcattcaaacccaactgaataccaaatagtggcaaaactacacaaaagatatatacttattttcaatgacttcacaaattaatatgagaatgtcttttggggaatataaaggtgaaaaaattctgaagaaatctcaaaatgcatttttaaatttgttattactttttatttgaatagttttggagttacaagtggttttttattacatggatgaattatattgcagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctttttttgtttattttttaaaaactgtaccacagggaaaatagtatatggatgtcattcatagaattccacctaatacatgcattaaaatgttagaaaatactcctaacaaaagtatgaatataggcatccctcaccattgggtgctgaaacaattgtatgaaaagtttttggggacagtctcatgggaaatcaggctaatgtctctgaactcacagatcattttgacatccataatagtttagtcatagacattatttgcttcctgatatgatacaataataagtgcaccctccccatcaagtatttttggagaaataaaacacagtaaacccaaagatagtcaagactgtagatatcactatcatattgccagattatagagaaatactggggatatgggaacaagttaaaagaaaccaaggaaagtaaatccataatg

SEQ ID NO: 12930 - DNA, 8473 bp, Human
ggagatcgtgccagtcactccagcctgggcgacagagcgagactccgtctcaaaaaaaaaaaaacaaaaaaacaaaaaaacaaaaaaaagaacaaaaacacaataatttatttaaccaatttatttaacttaggtgctgaacctatttaatttaggccacattcacgttgattactttcactaatttaaggtatttttgaccaaccttttaaatttaagtaatagaaaattttaaaaatgaattagtgcacaagacagatatggacatttgtctagtctccctgcttatttacaagtaaacttcagcagatgctctaactactctgagcttggaaaaccctggtatttcaaatattgaaagtgaagctcttaaacattttctttgtgaaaatgatttatcatatatagacataccaacacaattagagacacaacatagcttagctgattcactacttccctgccttactatacattttacaaattagaaaaccaaaactaagaaaaattaaatgacttcttcagtgatggcctgtggcagagctgcaactacacgccaggagtattcattaagtggttcattgtttttttcattctaatttattcattgaggttgagcggagcgtggtaagaaactaggaacgaacaaaaactcctgcttcctaaacagggaatggtcatgggtgtcttgggtcagctactctgaaatattaagttaatatttcacttgcctttgactctgtgaggcaggaggttatctctggaaagaaagagaaatatccaactgctagggaaggtttcttacattcatgtttgatttttcttctactcttttgaccaccatcaacaagactttacttacagttaaagggaaagttttattgcatgtaaacttttttcacatcggacacttttcctggctttccagagcaacagctagataaatagtgcttgccagaaagtggagaaactaatactaaatgaatccactgcctacatccaggaaggttcaggagccaggaattcaaaatccttggtgtcaagtgtcacccaaaacttagggttcgggagtggagaaaggctttcggttaagaactttaagattcctgcttctgtcttctcttatatcatcctttgatgcacccctctacataacattcccccggaaaaataaaaaaaatacaaactctgctgctgttgaggatgcagatgattatttaataatagaaaatgttcttgcaacttgtaaacgatattcacaccctgttgccccctcctcgcccaaaatgtataaacccatattaggcctcgaacaagccggatggacacaaatgagcagaacactggtgggtatttctgggattagggctaagcttcattttcttttcagccttttcttaagcgtccgcattctccactatgcatttattacgttggtgcaaaactaattgcaccaacctatatatgtaattagagaaaagtaattacttttgcaacaacctatgtatgtaattagggaaaagctatatctagcatatttttaaaactctttgagaggtgaagggtagttatttcctgctgggtagtgtactccttttcctagcttcacaaacaaaacccggatgtgacttggaaacggaaaaaaaaaaaaggagcgggggtgcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtaagttggctgttccggaatatttccttctctgaaatgaagcagggtccgatttttcctgcttagtaacagtaaagcaaatagtttagcttatttttccccctttttgtagcttctcttctcaccaccctttggcagtgcctggggactgccagctgatgtggggaaatcctaggaggtagaggagggagcaaggatctgataagtaatttaaggccaaatgtcctaacttttaagatgcctaggaaggggaaaatagacaagaaatcttgctttccattagacagctgtttttcaaaactcacttgtaggaaaaaagcggatagctacttggttctttgatcttttacactactagaaaggatgatatttgaaagaaattttctaaaaccgtattttaaagtcttacaagtacattatttaattttgaatttcaccagtggccttcagtgatatgcaaagaacagtccaccgaaatttgggaacaaaatattagaatttctatatttatttgtaaatctcatccctttataattttcactttatgttttattagtatgcgattaatacagtagtatctgtacttatttataaataattatacatacactgtggtgcatatgaaaaatttttttagtgatcacaattttaaagttttagagactattgatagagattaccatttcattgagaacatatgacccagtattcaatattctccactgaaacgtctcgggagttttataagttttacttcaatttcttactggtcatcaagaccttccttcagacactaatccctcttcctgttttaactcaatcaggcatcctgtagactaggaaaggtctttgaatagatattgtttaaagataattaacctttcctcttcagcaagaaaattttgaactgatcttatttattatggtttagcactagaaaaaattaagaaaaacaatggaaatgaagcgttataatatgctcacttgccttcctgttctagttataataaatctgttaagggcaagagtcttcactgttgagtgatgattagaagatgcaggcatttttgtgttttactttttacatatttcttttctcaaatttaacctttcacatccaaatcccggctcttcctagcttttataatgagctgtcccttctatcatgttaagggtttgtagctttaaaaacaccaacgcgtttaaaggggaaaaaaaggaagttacactacccaatcaataagcacgcttcttgaaaccttaagggacccattttatggatggcgaagttcccagtacagcaagtgctggccacttagatatgttcacacaataaaccttaggagttacatattaaacagagtttcatatgctgaagtacagcattgtctatgcaaggttctaatatcttaatatttggtatcactgtgtagaacttaggaaaaaagacaagcgtcttctacttactcagagttttaagttaagtgatgtggatgcaaccgactatgtaaaaattgactgtatcattcattagcagtttctccctgctagccagcctgaccctttaggacacggcctgtggcatcaacttcccacctccagaaacctcaagtgtatgccagagggagaaaaaactttggatatatgtaaccttaggaaatacagaaagaggcatctaaatctcaacaataatattaagacatttgattatacacttggaattatacattattattgctaggcaagcattggaatgtttagagatcattcatctccctcactttaaggattaaaaaaaacttgagtcccacaaaggctaactagctccacatttaagaccacagagatagatagtgatagggcaggtactaaaacattcttcttctcattcccagtccattattcagtcaataaatagttaacatctgggctacgtgttcagtccttaacttaggcccagacaaaacttgcaagttgcattctggctgtagttaaatgtttatcaaacatgtcctcttgattatggaaggaaatgtatcagaggagcaattactcacatttggaggttacagacctcttctgaaacctaatgaaaaaaccttgtaagaaaagattcaatgtagggagcatgtatcttgctgagaaattaacctgggacgacagaccctaaattatgacacgtgcattatcaactctaaaaattcacttaaaatgcatgcactctgaatgtcaacaaacgagagcaaatgttacctgaaagaattgtatttgaaagattttattttgccagattttaagtcacacaactacatcacctagttttcaatttgaggtcagaggcttccacactgatttgcagaggataatcatttggggtgtggaagtaaaatgttaacattgctatttctgtttagttttaaacctcacccatttataatttccagtttatgttttataattttgcatgatgtattaacaaagcagtgtctgtacttatttgtagttaaaaattatattcattttgggatacacatgcaaacatgttttagtagtaaccgttaaaacagtttgaggttactaatttagattactaattcaatgggaacatttgcccagttttcataggtctccatttaaatttgctggtgcggcctggcgcggtgtcccacgcctgtaatcccagcactttgggaggccaaggcgggcggatcacgaggtcaggagatcaagaccatgctggctaacgtggtgaaaccccgtctctactaaaaatacaaaaaattagccaggcgtggtggtgggcgcctgtagtcccagctacttgggaggctgaggcaggagaatggctagaatccgggaggcggagcttgcagtgagccgagatcctgccactgcactccagcctgggcaatagagcaagactccatctcaaaaagaaataaataattaaattaaattaaatttgctggtacttctgtaatttttactttaaatttcttactagcaatacaggccttcattaaaaccctaatttcttttcttttgtttttattctttttttaattcattcttgcaacctgtcttttaaggatagatagactttttgaagaaactcttcttttaagaatagactttttgaagacactattcaattttttctccatctcagaaaaaaatttattctcagataagcctaataagtctcagataagtcttttattatgatcattgccctcatgcagcaggaagaaattctgaggagcaacacagagtgcgatatttggacaattccaatctttccagaatcaggctttttccaaagcttctatcatttcgtgaaatttcagaacatggcacacacccataagtgagaatcgtggcattacacaccccaaaacatttggggattatctactactgcacctgctcattagcatggaaaattaaaataagagtatatttcagttcctaaaatattgtagacatggcataattgtattttagcagaggaaggaaatcatatgagacacaatggaaaaaaactgctggagatgatttatttaatgcagtgactttcaaacattttttaatttgaccaacgaccaacagtaagaaatatattttacataggttgcatcataggtatagtaatagaataaaaatattagagtgcagagcccagattttatatatgtattatatatataatatatacacacacacatgcacatatatatgtaaatgtaaaaaaatgtttaaaaacttcttgtattcaattatacttatttcattaaggcgtagggacaaagtttaaacaaccctaacctaatgtattctcttttttttctatacttaaggtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaagatgagtgttggtgatttaagaagacacttttcatgcattaacttttatatttctccccgtaatcttttgggtgtggagtatgattgggtttggaatatgattcagaaggttaggtggttcgacagatcacatctccaaaccctgcgtcaatggtttagagtgctgagttctgacctctggaacgtgtttgatctaaccttaactattaagaaactgagcaggtagaattcctataacattgacagaagtcagattatctgagtcaggaacaaggccaagccacatctatgttagtacttccctagtttatcatcatttagatcttcttaatagtgttcctgtagtagtagccttgaagaaaatactgagttggggttcaggaagagtgccctgcctctctgccgtgtagtggccaggccagccctggctttgagagccagtacttattcctgcacagagctacatctcccatgtgctctccaggtcttgggcatggcactactccagttctgtggcattggtgcagacacttggacctctgcactcatgcttgccagcattttccagcaggcctgggccaaacatgcctttttttcttctcctccaaaggaaccagtgaatctttgcccactttaaagattagttggtctttttcttactgatttgtaggaattcttcatatattctggccatttattcgtgtttggtgatatgtgttgcgaataccttctcccagtctgtggcttaccttttcacagtgaccttcccttcagtggttttatcctgcagggcaacacgtcagagtataactcctgctcaagttcataacaaaggtacctgaagcccaaacctcacaaaaagggacctttctttctcaccttgagcattctcccgcttcttctccgtcttttgggtcaaaattgctccaagtttgagccaaaagaaaaacgtggaaaaacccttgctggttagctctagctcaaatggacttagtcattaacttgacctgcaattttcaatgtggcaccagaagccaatgtttctccttgactagctcttttctcccacttacacatgtaggtataccttactatcaagcgagagaggcgcctgtaacctgtagcagctttctaaagtatatcagcatcctcgttctgaaattcctttcctttccctctctgggaaagaacagaataccccaggcttttgaaaaatagtttacacagaccaaaagcagaaactatttccttcagtttcctgacactgtccaagtgatgacatcaattggctttactgagagcccagggataattttagcccaaaactactactcctaggaaggagtagtatgatctactactcttaggaaggatttaggaatagtaaaggtgtatttcttccaaacagcatagaactattagtactattagtcatttaacatttaacatggcatgggattttagagctttggtgcctgtaaagttttacttctattagctgtttcatttctttgcacttataaagttttcttctgttgcctatgaaagcaaacatttattccggttactggcaaggcagtttaaatcacctgcttctttcatgaaaggccaagacaatacatttattccctaacttgttgggagttgcgattacaagtctatatcctgatttctattagcacattcagctatccatttgtgtacactcccaagtcctagcttttgctcttcatgtctctttcaaccatatgatcaatcagtcggacgacttctggtttttcctgaataaatatctaatcttataggtgcttctattaaatataattctgtttctttttcttaccatttatcattataacccagccaacatgtagaagtgcaataaaaatattttaattttcaactgttcaactgctaaaattattagcttgtaattaaaaaagaaaaaatacatccactatatatttagatatattgtaaatgtaacctttggtg

SEQ ID NO: 12931 - DNA, 14237 bp, Human
ttgcacctcgattcagacatttcctgcttttattcttgcttttgtaattactagaaggaatacttaatattattttaagtaatttttagtcctttatctcctagagacctacaaacattagatgttttctgtgagactatcctgtgagaatagagaagaggttctaaatgctattcatctctgtgaaatttatttgctttcaatcagtaagaaaagttaaggattttaatttaaaaaggaaaaagcacaacgagaaaagtgaaaatgattccctctgatcgctaatgtcaactatggtcacatttaataattctttttctgcacattgagttcatttttcctgcctcttcctttgagtgcaaatttttttcagatgacattatcctaatttgatactagcaacgttagctaaaaacaataattggattttttaggtaacaacttcaatatgaactagctttgccttacttcagttatattcttagtacattatatatgttttccttttaactacatttcattcttatgtcttcctaccatgtaaaggaagcagtatattttatgtaatctaaatgattagttctagtaaatattaccatattttcaaaaataacgatttctacatttccatcagcaagccttctgtaaggcaatttttaaacgttttaattatagaacatgcatttttttaaccaaaggactgtcacagattttaagttataaagggatacctagctatcatttcttttattgaatctccatcttttatttgtaataattgtccctgatattatgcttatttaatttcattgcttttagaaaatggcggttttattttaatgatttttttctatcaaaacactattggataaagcctccttcccaggttaataactcttattaaaaattgttttcatgtgttttttacaaaagcaacttaacgcagagacttatgccagtattatagtcaatgttaataatgtcctgggaaactatgaggaaacgctaaatgatcaaagatcacatattcggaaatctctagtgtggagacgattccactgccatatatacagcagcaacaacaaaaccgcagacacccagtgaattttgatcacctactgtgtatcaggtttttttgttttcccttcaaaaaccacgatttcatcgtattctcacgataaatcctctgagataaaatgaaattctaggattaacctcgataccagtaacacctccaactcgccaacaagttttaaacccctaattggcacactgccttgtgtaagcagtatttcaataagctttgtgtaagttaaaaaaaaaaaagtgggagagcgtttaggggtcctttggtccccataacaactaaaagtcttggttctttctagaagtacaacagatgcagtaacagggaactaactattcagtgcctctgaccagatcccgcagcctttcctagtctgctctcatctgagcaggagtcctactcaaaggaacctggttttctttcctttactggatactacaaggcacaaatcggttacttctgtgggtgtcggattacttgtttgtaaactgagaaacctggacaaagttttctctaactttccctgaatcgtctctggaggtgagagggagttcgaggctaaatcaggaaagataccccaaccatcctcttgtgggtggggaggagcagatctgctgggttaaacttggtggtcaacaaactgaaagcagcgacccgcgggctgcgagcggaacagcgggaacgttggatcagagacccagaatcagagccgcagtcgaagccgcccccttttccggacgccccgtccgctcctggaaccgggttcacatcacgccctcagcaacacgttatgcgttggtgaactacatttcccagaatgcctttcaaccttcttcccagggctccaatgagcgccgtggtgacgccatcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtaagaagagggctgaggttcgaagttcggggccctagaaccgggagcgctggggcgcgggaggaaatcgaacctgtcttatgttcctggcatttggtccaaaaaacaggatgtctagaggggatctttggggtccatgtcgagtggaaacacaccatttgtcccagatctttggaatttccttaagtttgagtcagattcaagtttggatggtaggctagagaaagtagtggactaggggtgggtgtgtacaggtggcatctcagtggtcgagtgttttagtgttattgactgagcgtggttatggacgctgctatgttttccaaagcccgactccggtttctgtttccctactggccctggatcttagtttcttcagaagcggaatttgaagagtgggtggttgcacccaaagcacgctagtaatggtcgttaatctggtaacagtgagttacaaaggtaaatgtatgtgtcattattgttaaaggtcctggaactggaacttctgggtcaaaggcgatttcttaatctgaaccttgtgccacggttaaggcagtagaacgtggttaaggtttggcgacttaacatttgatctttacctttggggttaggaaactggctcatcagcaagaataagttagacacaaggaattttaatggacccttatagtaacgcacagctactagaacggcattttctggttctgaagctttctcttaggacacgattttttttttaaagaagaccccgctaaattagagtgcagtatacttcagaaaataaatgaaacatttgaaaaaagatattacctttctcagtcattataagattgaaaaaagaaaaaaaaaatccccaaagtgtcagatatttaaagtcagtgaaagttgccaataaccgtagacttgtttattgatcaataaattgtagtatgagaaagttttttgtttttttaatgaagtttttatgaatacttagatcatagaaaatggggccaggtaaattgaagagaaaaaaaaaagaaataattttgagcaagtttagctttatatgtctaaatgtttttcttgttcatcatccttaataccaaaaaagatttattgtgtgcttgagtaagctctaggtatacagttgtttgttgccctgtttgtgatccccaaagcttccagtctaggtggggagtaggaatatgtgcaaagataaattgtagtacaaagtgtcgctatacatccaaataccagataagttctacatataagggatggtctcagagatttcagagatagatcactgtgtactttgtggggaagatctttgtgtatttggtggagacataggaatttgaagtagaccttgaataatggagagtgggggaagtgagttccagataggaggaactcaaaagaagtaagggattatgattaagccagtttgggtgaagtaggggattcgggatcacactgtggagatctttgcatgcgaggccaaagagtttggatttcatcagtaggcccctaggcccttttgagtattttcctgctgcagtgtgccatgttaaattgcaggaaagtgacttgagtaatggttctcagccctgactgtacattagaatcccttgggaagtttttaaagtattgttacctggacctcagctcagccagtaaaattagaatttctccaatttagagcccactaccttctccttttttcctttttttttctttcttttttttttttttttaaaaaaaagctcttctgtgattgagaggagaagtaattacctaggtaactactattgctataatttacattggtgtgaagtgacaaaggcttttgttacacattttttcttttctttttttttaaagtatgaatgcatattgacctgaaattttaaatttgggatcatagtgaatctgatacatatccataggcagaagctgccacacttcacatgaatctctaaatggttttgttagcttactgatagaacctatccaaaaaagtagcgtttatctaaataaacaaaggctgaggatgatcttcagtactcactagcttttttacaacttttcatagcagtacaccaccagaagagaagtggctttgtttggaatagcaattctagcattttatttggtttttacttttgtcattgtatttgggatgggtcatagtttgagggaagatcaactctttaataggaatgtgcattgatatatttctggacgataaatacaacaagaatttcactttgaataaatggaacagcatggaagaactctaaaattaaaattaagataggcaaaagcaactaaacaaaggaaagaaaaaatagcagttaatttataatgaattccttggtgaagttgtcaaatgtttgaattcaaccagtcagtaattacttattgggtaaatgttatatactcagaacctcagccacacaaaataagaagacattctttctttaagtatcttggcccttattaaactacagtttgcacagagtatcattggttaacagagtaagaatgcatttttaaatggtgattttaatatttgactgagcggaaaaatatgcccactccttgagttcttttataataaaacatgtggagagcttcatggatagtgtgtcatggatagtgtgtcagcagcaaaattcagatagtacaactctcttctgtttggaaaatacttcttcaatattttgttgtggtttttgtggtggtggagattgcataggtatctgctgcatataaagtactcattaggtacagggaggatatggaagcatgagatactgtctttgccttcagagaagcatatgattccattctggacaaaggtatgcacattcaaagttcaataacagtgaactcagattcttttcattaattagttcacatcatgtattcattgagtgtgccttacagtgtgtatgtgtttgtaggtttatggggggacatacagtgttgagtcaaacaaacttattctcttcccttatagtactgtacagagtgcaatattagtgttacatacaatcagagctgtaagaaatcagtgagagttttgcttcatagggaaaatgaaatttctattgtgccttgaaagaagttcctattcacaccttgactgtccttcagtgatcagtgctgttacctcctgtcactgctgctgcatctgctcattgagcatatggagacttctagttttgtttgtttttaatagatgaggtcttgctgtgttgcccaggctggtctcaaattcctggcctcaagtgatcctgcctccctcagcttcccaagtagctgggattataggtgcaagcaactgtgtgcagcaggctctgagacttctagttttgatatcattcctttccccacattctcaagtcactgttgaatctgctttaatatctgtccaatctaatccccataatccagatcttcaaccgctcttttggcaagcagtctcaacctcttggggctccgtttttctgcaacctcaatattataagcttccaactatagattagtccaaccatccaccttctcctggactaactcaggccgatgaactcttctgcagaaaaaaaccacacacctgggacgattgaagccaccgtagtatattgcctcaaacaagtttgttttatctttagtaatcctgtgcagtcccggtccctttcctccatcattctccttactgtatattctgaatgatcacccattcttcagcagatagcccgttttctccctttactgagaaaattgatggcaacaattatgttaaaaaaaagttcacgcctgtaatcccagcactttggggggccgaggcggatggatcatgaggtcaggagatcgagaccatcctggctaacagggtgaaaccctgtctctgctaaaaaatacaaaaaaaaaaaaaattagccaggtgtgatggcgggcacctgtagtcccagctgctcgggaggctgaggcaggagaatggcctgaacctgggaggcggagcttgcagtgagccgagatcgcgccactgcactccagcttgggcgacagagcgagactccacctcaaaaaaaaaaaaaaagtatagttaactaacaccctgaactatgccgtttcctgttaatcgcccaacatatttatatatgtattcactaaggcccactccatctgttgtttgatagcctgatgactatgaagtactatattaggcagggaggtgtacattcttatcccttagagttccataaaagtagcacctagaaagaacagtggatctgatacatggtaattcttcaaatatatgttgaagaataaatgaatctccctcttgactctcagctagcattctgcataagttattgtgtctctttcctagagcttcagtttgccccctccctgctttggctctttcctgtccaactgtctatttaagagaaagagatgccagtaaagaaccctcgccgctatgagctcccgtccttctgtattaaccacttttcccttcctcttcacagccacgctttttcaatgggtagatgatgttactgcttttagaactttcattaaaatatatgtttctcttgagcagggaatgtatcctgaatattcttgtgtattagtacctatttttgtatcttctggacaatcaataagcaatccagaaatgtgtatcaaaatgaactgaactgaatattctttggttaacagagagtaatggaaagaattggtctgatctctgtttggttatttattttttaaattcatttggagtatgaatattagagacatatgtggtttgcaaggccctccaggggtctttttcagttctttcctaactaacagtgtttcaaaagtggcttctctagaaccacctttgtgactctgatccttgcaggtgaaggagtacctcctggcaactatgggaactatggctatgctaatagtgggtatagtgcctgtgaagaagaaaatgagaggctcactgaaagtctgagaagcaaagtaactgctataaaatctgtaagtatataacaaatattatatgtgttttaattcatatatttctatacatataattataaactatatattcttattgacgtcatcctaaggaattcatttactcagatactgtggttttgtgaggtcaaagtacactcaaaatttagactgtgctttgagtaagttaaaaaatgtggcacatcaaaagatagattttttttaatacttaagaaaaatctccagctcttttttgtatactgtatgctgtctgctgtaatgtctcaaacagagctgtccatcttccacccccaagtagctcttctgctttttttaatctagccttctaagctataaatcttggtctttcttatttctacctttgtacttcatttcagtcactgagtcttacactgtctttctgatgtttctatctttgcctttctatttctaatactatcccctggttttcttttcttttctttttttttgagatggagttttgctcttgttgcccaggctggagtgcaatggtgcagttttggctcactgcaacctctgcctcctaggttaaagcaatccccctgtctcagcctcccaaatagctgcgattgcaggtgcccgccaccacacccggctaatttttgtatttttagcagagacagggttttaccatgttggccaggctggtcttgaactctttatctcaggtgatccgcccgccttggcctcccaaagtgctgggattataggtgtgagccaccgcacctggcctatcccctggttttcttagttgaactattggaagaacatcttaacctatctgttcctgtttttttgcacattatgatctgagctatataatcattgccacagtcctcgtttagaatattttaaaacttgcatcctgcactcccagaagtcttcagcgtccttccatgatttaataaagttcatgcttcgtagcttgattaaatcagatagatctttcaaaaattggccttagcttttgagatcttatctctcacacttccagaatctgtatgtgcttcctgctagacaaattacactttgtgtcctctgtatgctgtcactttcccacccccatatcacactatccctttgccttaagcctccacttccttcttagatcaactgaagtgctgcttatccacatccgccccacttcattgcaccccctccctccaaacttttacctgattaccacatccaaaagtaacttttcttcttatgaacataagaccatttgtgccatttctgtagcacttattcatagtgatttgcattggcattatttgtatgtaaaaggaatttaccagaatgcaggttttctattgtacttactttatattctatatagcacttagcataattccttatcaatggtgttgagtaaatttgtattgaaccaaagaattacacgaagatgattttaataatatatgtgattgatactgcattataatgaacatgacgttcacttataaagcattcagtagaagcccatgttgataaaacttaattggtatttcaatatagtctttggaaaatcgaattacattcagtctggagacctttagattttgaaacaggattgttttcaaagtcatattaaactaaagttgatttatgaactaagtaatattgtataatgttaattttaaaaatacaacacttggaaggacttaagaattaaatgcctttaaaaacccccccaatgtagataatttagattacttgttagaagaaagttgtgatgtcctggaaatatttttccttggcatgaatgacagtgatagaagttgagtaatgtgggcagtctagctttatagttactttattatctctgagttgttaaatctgggaggaaagctcatgttctgatctatagaattctagtatggttttgtatcagtattatcccatgtgctttcacacagatgaagaacaatatttgcagtgatttaccaagattttcagtagatgattctatttatttaaatatcttggaagtgaagcctttgatgaatctgtcctataaagtattagatagattttggtttgaatagttgtcataattagctatagtattgtattttgtaagctatggctcttttcttcagagcttcaggaagtaagtaacactaatatttatttttttcaatttattatcatattttaaagcaaaaacctttaaactaaggaaaaatcagtttagacatatttaaagtaatgtaacatttcattaggaaaatattaaatacttctgtctagatttgaattggttgtatgggtacttctagatctttcaaaatgtaataaggttgggtactaggcttaattcttggttgacgaaataatccgtacaacaaatccatgtgacatgagtttaactgtataacaaaccttcacctgtacccccaaacctaaaataagttaaaatatatatatataatttataaaatataataaataaaatgtaagaaggaaatatacagatatttgtaggaatttgtagcttttgtaggaatataataaagatataaaagcatacaaggttaagagaatcagagagaagtagtacataccaaattaaaagatggaattgaatattaagatgaaattaaaataaagaggaaagaagaaatgtccataattgggaggagtagaaattccaaatttattttttattgatcttggtagaaaaagtatcagaaaaagagagtttatgtgtctagaagaccgtttcatttcagaaaatgtgtatgcttagaatgacattatttttactttataacacttgaatacttttatgtgagtaatcctgtgtataccttcttctttatagctttccattgaaataggccatgaagttaaaacccagaataaattattagctgaaatggtaagtggttatgattttaactttaagaaatttgatctaatattcgcaaataatagaatttcaacttttattcattttgaaatacagagatcgtaagtccttgattcccgtccatttgtatctaatgtgtttggaataactataaggtttattttgccatgcttttgcatttttcatctcgtcttacgcatgtaagtgggaggaacaagtggaagccaatatatctttaatcctgtttttagaatgattgttaaaaacaagacaaatgactattttgagtagtcttagaagtctcaatagtagagactactagtaatttattaaccaagcaatcaaaaggcacttgatatccaaccaactaaatgtcgttcacttaatggatacttactcttttgcttgatttcctaaggatcacttatgaaaaaagtgctcatacatttgaacagcccagagccttttctctctaacaacatataccttttcttgttagagtccccttccatttgttaacgtttatcttgaatgtcaagcttctctgaaccttctctggttccatgtgcttttaaaattgtgctattcaaaaatgaatttggcatcaaaagcaatgttcttgctaagcttgtgcgctataataagctagggacctctttaaaaatgtatatgcctgattctgtctttaaatatactgatttagaatttcgtgaggagggatctagatgtaaatattttgaaaaaagcatctctggtgattctgatgcataaccatgaaaaagcatctccggtgattctgatgcataaccatggtgaagatccatagatctaaagtatatgagccacatagacactgagctatacaaaggatatttattattatgccagggcttttacatctcaggatattataatttctatgaaagtatgtgtaatatttctagtccctacctaagcctctctcatctttaggattttccagctatgttttaatacgttagtttttccccatccatatttatagtccttatcacattttactacctctatatgatattctcttaacttaatagactctacttcaaagtcagctgtctaaacaaaaggatattaaaagtaaaggtccaaggcctagcatggtagctcacgcctatactcccaacattttgggaggatgaggtgggcggattacctgaggtcagtagttcaagaccaccctggccaacatggtgaaaccccatctctactaaaaatacaaaaaaattagctgggcgtggtggcgtgcgcctgtagtcccagctacttgggaggctgaggcaggagaatcacttgaacctgggaggcagagattgcagtgagctgagattgcaccactgcactccagcctgggcaacgagcgagactccgtctctaaataaataaataagtaaataaaagtacatttaactgctaaccgtattacattttggatgaaatcctctacttgggtagcagtcaaccatttgaccttggagagcaatggcacaacaaaaagtggggaaaaaaatctgtgtgataatgcacaaagtacttacatttattgttaattttttttatccacataattggaataacacctaaatagttttgagttgttgaattactctgtggagctgaaagaagtgtttattggacaatgaaagagctttttattcgctgagagtattactgtattttgcatggagaaatcaggctgattatccaaggttatcaacaggctcctgaattgattaaacacaaaactgtcattacaaatgtactatggtaacagttattcaattacttggatatgcatatgtagactcttagaatctaactgtgatattttatttgcctttatctctgataggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcccagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtgttacttctttaagtctcttttacattctcagtagaatctgagaaatggtcctgacaactcagattccaacccaaatcaagcaaagttaatatttgtattgttggaacttgattcaaacaaataagcaaatcttgactctatttcaaaaatctctttaattctttatattttgggttatgaatgtattttcttggattttactgagttttcaattctttttgttcatccctaataacctgtcagtttgggttctattttttctggcttcattcgtcattatttgggcctctacctgacaggttaaaaccaccggaactgagtgtggttaagggacttaaacagataagcctgacgtgtgatgggagaggcactggtttgagttagatgacctgggttcatatctctattccttaacttgctcactgcttttgtccttgatttcttcattacaccatctatttcataggatagttgtgagaagtagataatatgttgtaaagtgcctggtatgcgataatcactcaataaatgttggttctcactaccattaacagaaattctcagaaaaggtagttattttaaggacaagacaataggttgttttcaggcttcaaggtgatgaaatacctccaagtaggtattttcatcaggcaattggagagtgactcattcattcaagaagtttttaactgtactttgtgtcaagtatgtgacaccagagctcacgggagattcagaaatcattgtcaataattaaagttgtgaaaaacgggaagagcagaaggccaaagaaaatgacttaaaaatgaaaacaggagaatcaacaatggaagtagaggatatcaaagccttaggaaaaccaatgatggcaagagaaggatggatttcaggattgtttagctattttatgaaagtactttgtaaaatatttaaaaattttaatgtggacagtatcatcaagcagatagagatttcaggaaaagggattttgggtggtataaaagtgattctcatcactgcatggttcaacatttcttatgatttttatttctaagtactatttaaagtaggtctctacctggcattttgtcttgctccttcacatcactgtgtctgctgagattcctggcaggcagggaactcctc

SEQ ID NO: 12932 - DNA, 8336 bp, Human
ccccatttaatactctcaacaaatctacagggtaggtaatattattgcccctatttccctgtaaactaaggcacaggcaggtcaagtaatttggtcagtgtcacatggctagcaagtaccagtaaacgattattttgttggtaagtatatgagagggcttcctggaatagagaaaatgaaattctaaacccaacacaagatctactaaattagaatctctaaggttggactcataactttaacgagtttcctaaagtgatttctgcacacactggagtgtgaagagccattacctaaaggaattaaaagttttccaaaatgaagaaaaattgtgcaaagaacaatgtcaaaaggtaaaaatgatcatcaaaaatacttaatgaagttttatatttagtctaaaagactgggaaggaagatgagaataaaatttgggttcccaaatgcaaaacaggcttatacaggaagaaataacctttgtatagtcatagtgtttcttaaagaacagaatagcaaaaataaaaacataggacacattgggctcaagtacccacagtgtgttattttctacctctatgttggcctatgtagacatttgtcccttaaaattatcttaaacttgagaccatcctggccaacacggtgaaactccacctctactaaaaataaaaaaattagctgggcgtggtggcatgcacctgtggtcccagctactcaggaggctgaggcagaagaatcgctagaacccaggaggcggaggttgcagtgagctgagatcgcgccacttcagtccagcctggagacagagcgaaattcctactcaaaaaaaaaaaaaaaaaaaaaaaaaaattcttaaactactacttatccggagaagaacaaggtattttaagactgggaagggaaagaatcttccttcaatggttttggaaatgaaaacaccatttaaattcaaggaaataagttaattgctgatagattattagcagagtattttcatgtagatgtacaatgttattttgttctctgaaatagtatgtgatctatatacacttacttttataataatacttcattacaaaaattggactagggagaaggaggagacactataggtacaatgccatttggctaaactgaaatctttcccaggcaatttcataggactatcaccagctattgagccttcttccccattactcactggtctaattggggagaagaggaattgcaaagagggcagaagaaagagtctgttctagtaggaggttattggtagatcagacttgctatgtcccctttagcctgctaaattttctcatcattgttaccagattcattgtgacagttacaggcaaatttcatgtgttgttggaaaaacactcacaagtaatacgctagtttatttctgattaataagactgtttactatatttccattctacgggtacacatttaaacaatccattatttataatgaaattatagtgatactttttatatggttcccttttaataccaggttaaatactctagagatttagggaattaatggaccgtcatccaaatgacctcaaattaagttaaatgacataaaacataggtggagggttttggaattgaaagtaaggattggaaaccccaaattttacactatacaaaagaccaggggcaaggaggcgctttaagtattttagattatatactgacaaaactcacccctcccaacaaacctgctgaacaggtgtttggagtcaaatgcttgacttaatcatattagtgaagattaggaagaagctttaaaatcccaaggctagtgtgcattgctagaattgttaagagagagagctcatatgaaattggttatcgtgggatatttaaaataaaacaaagaacagtttactttgtaagttaagagctgagggaattgttggctaagactgacttgaaataactccagcaattcatgcatagctgctaaccttctacatcttcagcaggcaaaaagatgccagtaatcaatattgaggacctgacagaaaaggacaaattgaagatggaagttgaccagctcaagaaagaagtgacactggaaagaatgctagtaagttgctgctttctttagtattttattttaagctagagatactgtgggagtaccaggttagaaaacattggctggaaaggctcaatgtagttacaaataaattgttcatctaaaaatttatcaaagattaagaaaattgataatcaatcataactatctcttgatttagattctaaatcaaggaggttggcaaaccattttcctctggccaagcccaatccttagcctctttttgtatgaccacaaagataagaatgctttttcatttttaaagagaagggaagaaagaaagaaagagagaaagaagagagagagaaagaaagggaaaaagaaggaaagaaagaaataaaagagaaagaaaagaaaaagagaaaaaggagaatatgagacaaaaaccatattttagataagcaataaaataaatatacgcatgcaataatataggcattttgtttttacttttctaaacttctttttataatgcaatattttgatattgatattttgatacaatgttttgatattgctgcaatactttaagctatgatgtcaacccctctccactgtcatggtcagtaatacataagtacattctactcttctttggcaaataaagatgagttcaaacataagaactcactggttcctcctacaaacttctgacaaatcttggaaagggttaccaacagttcactgccattagaaggagaagaaatggcaaaggaataaaccaccaaacaaacagtgatgaaagcttggagaatgtagatatgtattttagatcacttcattttaggaaagttattaacagtagaacaaaacctccacaagtggtaacagcaatctcataattttaaaacatctcattttatcaggacaaagtaaaaaaggatcttgtgttatcttcatactttgttcaaaatgcctgctcccagtcaaaactgggattttgggcttcgtctatgtttataataatctcaaactcccctgttgccctttccatacaggcaaaacgttttgctgtaaagataaaattaaatcattactaaggcttagaacatacaccagacaagttaaagtccttatttttacaattcagggtaaataaaatgaacttttaggataaagaaaagttttctcttcttaagttgaaatatccaaaagctgttttattatttatgtactcaggattattgttttgtaggcaaggtgattgtcttcgtgtttattattcacttgtggtaagttcaccttggactttttattttgggtaaacatcgcatacatcatcattaatcaggctttggggttccttttccccattattcaatgtctctctgctcttggaagtcaaaccaatttaatatcagactgcaaaaactccatatacatacacacacaaacacacatgcatatagatacacatacatatacatgtaccctcttagtctcctcagggtgctgtaccagagtatcatagactggtgacttttaaccaacagaaatgtatttctcacagctctggaagctggggcatccaagatcaagacatcagcagattcagcgtctggcgagggcctgctccctccttcatgaacacctgtcttttcattttgtcctcacctggtgatagggatgacgaagctctctggggtctcttttataaggacggtaatcctatttatgagaactctgtcttcatgacctaattacctaccaaaaaccccaccgagggagttaggagttcaacaaatgaatttatatagtgtgtagaaatatgtatgtaatatatagaaatattatttctctataaaatatataataatatgttatattatatataaaatggaacttccaggtcctgagcccctagctctgatgtataatcagtacagtatggttaagtggatatactcagtatgggtaagtggttaagtggataatcagtacagtatggttaattggatatactctgaaaccatattcccagctcagattcttgctccacaacaaatttttgcctgtgcaaccctcatctatgttatctaactcacctgtgcctctgtttcttcaaaatagcgatagtaatagcatttaattcagaggataattgggaggaataaacaagataatatacgcaaagctctgagaacaatgcctggtaatagcaagtgctttatgtcattatattattattatcttaaaattattattgattctatgaaccagactgattcatattattgtgattttttttgagtacgacaagtctttgcatccagtttctgaagctgatagatttgcaatgactataagtcaatgtaataggccatgactaaagacaacctttgtagtaatagctaaaaatagttactatttgattgtgcatcttcttgtgccaggcacctcttaggcatttaaggcaaccaatgcagctattcatattttatacatgaagtaaatgaaccttagatgaattaccttaactaagactaaatagctagtaaatgagaagagtcttgcaatcctatgttaaactacatatatttatattaagcatcactgaaataatttttaaacctatacacatatataattttaggtaatttgttgctcctttcattctcatatcctcagatcccagccaggcaccttcaaaaccaatcccttatggactactgaattaaggacagcaagttacacctctgttcctgtcatctgggtgaagccaaaagtagtgacttttagagagagagtgtgggaccactgaggaagagggaaaaaagtgaatctaaattaatgcatatttcaaaagttatgtgaatctgcaagtatcatcctttgaaggaagaaactaacctgacaaatgcttcctggctccagttgaaaataatttgttttactatgtaattaatgagtctgcctagttataaaataatcttaagtcttatatcaaatgttccttggaatttacataaaagcggactaaagatttcatttgaaaaaaaaaaaacagtaaattggttaaatgacttatggaatggccacttaatagactgacaaaaataaagtagcttagtgttactgtcatgaaagatacactaactgaaaacaaacaagttgaagctaaaagagtttgaataatttgatttcgtgtgtatgtatatatatgtatatttatatatgtatagaacatcacctctctctacaaggaatgttaagtggtaccttaacaggctatagctgaagccattaaaatattaaggcctgattttttactaaatcattaaacaataatggtgcagataagtgaagagcaagctcaaaaacaacatgaataattcagtccagcaaattattcactgagcactaaagaacacagcctctgttctagatggctgggatacactgaacaaatcagccaaaggtccctgaccccttgaagctcacctagtgcaccaccatgctcaatcattgtagatgagtgtaaagaaaaattacatgtgtatacttctgagaatttagggatggtgataagccaggaatttaataattattcattctcctccacctttactagtcacatttttgggatgaggaaaaagatttaatcaatatgaactctggtgacacccttgacttctgttgccagctgtgttgtgaaccctgggtcttgtctcctttgatgttggaggcagtgtctgctgggaatctttagctggagtgtggccagctgtttttcctttgtctggagatatatccagaaggagtgggaagggtgcaactttcttctttcctacaaagtaaatatgcattggtgtaaagtagagagaatcaaactgaaattatacaacctgaaaatttattgtaataaataaattcctggcatctggagtattctgttttaaaccaaatgagtcatccctttttccttccccttaaggtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaacccatcattctatgtttttcttaacatagctggcacagggtttaacacataattgccaataaatattgcttaaagttctttaaaaagaactatgttttataaatgattctatattattctgagttgtcagcatatatttactgttttatgttttctcacttccctttcaacacttacaattttctacccagaaattgtatggttaagtttctattttgtttcccaaactttctcttggttaaggaattaggaagcttatttttctgatatgcagttcaactgtcttgtgacttttccccagaatgccaactgggttgagggttcagtctgtggtcacggagcacggtgaatttaaccagcagcagaatcacggttataagcatgcacttaggagccagacagttctggctctgccactttactgcccaactcactttggataagctacttaattctttctaaatttgtttctcctagcataggatgaagacaataatggttatatcttctgttttgtgtaggggttaagtaatacactaatgcaactataacactcagcatattacctggtccatggtaagatacaataagtgttaactagtattattactgagaaaggatctagacaaaatttccaaaatcctttaagatacatgatgttttaccctatcctcataagactctcaacaccacagtcttttctttaacaaggtgagcacacatgagagagaaatctccatcacctacatcaggtccttctggcatcctattgagtttacatgagtcacatttcactaccattgtgttaatgactaagagaaaacttgcctctgcttctgtaacaaatgacaagttgtaattacctaaaccagaaacctcttttgtggtcagtgttttcttgttgctgtctcacatttacagtgctattttgtatacttcagtgatcagaatactcagaaatactaattgattgtcacactttaaaaaaaaacattaaaattatctattatttggtctggaagggagtctgaaagttgtaccaaagtttggcttctagcacaatgccctcccactctgatcatcataaatgctcaacaaatatctgttgactcttgtctaaactcttcattttgaaatggagaaaataaagtttcagagaagtcacctgacaaatttcttcagtcaagactctgggcttctggctgaagagtcagcaacacaccccaccacgtgtcttcatcaaatatgctctgagtattaagggattctgggattagttactgaatgtcttatctatttttcctcaagaaaagctttttatcctcctatttaagtttacaaaaccctctccatacagtcctcccaacctccaccaagcaattcctgtctctctctcgcactctattttcctccgtagcaccgtcaccatctggcatactacaatttatttgtttatttaattgtggtttgcctctagaagttttccacctgcaaattagtatttatttagtgaagtgttcagtatggcccctttcctccgattaaaataaatacaaagtaaatatttgctatgacatttagtttaccattggagacagattctgaagcccagcaatgtgaagttaaaaccccgactcttccaccttgtcattgagaactttggacaaatgaccaaatgacttcaactctttgaacatttttttttttttttgtataaaactagtgattaggatagattatctgaatacttgtaatcccttagatcacaaatgggtatataaaaggaagcctaataaatgtcctctattattatacttcccgtggacattttcccaccatctggaatttggtcatactgatccctccacctgaaatctccctccactccaccccaccccattttcagccttttgaaatcctactcttctatgagactttctctcccaatctacctcaagagtattttgtgtatctcttaagtcatttaacattactttact

SEQ ID NO: 12933 - DNA, 6708 bp, Human
gactctttatcatcttggcttttttgagctattgatcctttctttatagatgagtaaacagacacagagatgtaaagtgattaattaattagtcacctagctatatcagggactaaacttgaatatgactttcctggttctccagttcagagttcttttattccccaggctgccatcctgactgtggtgacaccgcttatatcactgggctagcttggctcttatggcaggcactctcaccacagagattttatatatgtttgacattataaccactggttgaaaagaaggaaataatggcccataaatcccagtcacttaactgattgactatccaaccaaaatgactacatgtacatgtgaacaaagaaaacagaaattatcacccttcctccaagtagacacatctgtacaaattttccatgtaggatgaatcaatttaactaattgtgctgggatatgatttatcagtttggaaagcaatacgatatattttatgtttccttaaatttgtttcaaaataattctgaggtttttgctctcattaaaatcctatctacctacagaagagccttcaatgatctcttactgacacattagatgattaacatttattgtcacctatgtgaagacattcttgtgtgcgtgtgtgtgtagaagaaaaagtatttaatgagcaacataacatatatcattcctgccattgagcactttataatcaaattaggggggcaaagctaagacttaagaaaccagcatagagcaatacaagatgtatacagctaaatgctagtgtgagtattattgattatggagagagatggccttagtctgaggcagtcaaggaaggtttttcaggagacagagaacttgatctaggttttgaaatgtattaggatgttcataggcaaaggaaacagaggaaaataattccaagtagagaaacagcacaggaaatataggaattagaagcataaaagttagaagggcaacaagacaatcagtataaatgaatcagagagtatgtctgtggaggggtaagctcagcccaaactcctttggctagcattcaaaccctactttacctgtctcataaagtcatgatacaatccagtgacttttcttcttcccaaagaataggccaaagaccattatcctgattaagtccaacatcctagtgggataccttccttcacacatgtgggaaatgatcaaaattaattgcgtttcaaaaatttagtggtaactctaccaaagcctattaaatcagtgtgagtactcaaagagcagatggaaaacattggtccttaaatgactttttttttttttttttttctagaatgagcaatgttgttagggatcatagggaaggtcatggaaacagttttggaaactttgcttgcaggaattaattgccttcagtttcgaaagggcctatttctttctcatttacagtcaaaatttggtgaaagggaaaagttgctactacataatggcaggaaaatacccactatttcattctctaaaataggtggaattgatccatctctttggcaagctgtatgtgccgtaatgtctggggtaactttttccctggtgcccccattaccacttcagatcctttgttaagcaaacaatataggagctttcttaaaacggggctctgagtgcttattctcaaataagccctgcctcagttgcaaggtctttcatctgaagatgacctatcttacatgtgtgggaatacatttttccatgattacttcaacagctgcattctgataatctgcctggggaataactgttgatggataaaatacagtcagctcatctcgccagtgaataatgtgctttctggttctaccacgtgaaaatgaactgctcagatcctcttcatctggaataatttccagggaagaatgagtgactgaaactgctgacactttcagaataaacccttgatgtctttgacaattgctccaagtgatttgttttgggataagcttgcgcgccatgtaaggtaaagtgactgattctatagcaatccaattgttcctttgtctgcccgtttacatataacaatgttgtcaatgtttgattgaaaatacctagcaggcgacacacacacctagctcctcaggcggagagcacccctttcttggccacccgggtatcccccagggggagtacggggctcaaaacacccttttggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttggttagagaaactgatttttcttttttctttttttttttcccaaaagagtacatctgatcattttagcctgcaactaatgatagagatattagggctagttaaccacagttttacaagactcctctccccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctggggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaatcgacattgacctatttccagaaatacaattttagatatcatgcaaatttcatgacccgtaaaggctgctgctacaatgtcctaactgaaagatgatcatttgtagttgccttaaaataatgaatacatttccaaaacggtctctaacatttccttacagaactactttcttacttctttgccctgccctctcccaaaaaactacttcttttttcaaaagaaagtcagccatatctccattgtgcctaagtccagtgtttcttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattgtaaaaagaatgaagtctccttagaaaaaaaattatacctcaatgtccccaacaagattgcttaataaattgtgtttcctccaagctattcaattcttttaactgttgtagaagagaaaatgttcacaatatatttagttgtaaaccaagtgatcaaactacatattgtaaagcccatttttaaaatacattgtatatacgtgtatgcacagtaaaaatggaaactatattgacctaaaaaaaaaaaaaaaaagaaaacacctagcaggcaaggaacatgctcttcagaactctgctcttcagagttccaaagaagggataaaacatcttttatcaccatcaaaatagccatagagttgcttgaagacacatttggggcaatgtgattcactgtatctggttccaaattccagatagatatgggagttaaataggaaattaggagttaaataggaattaactaaataggagatgaggttagaaggaggagaaaatatttagatatttcttttattggtttatatgtcaaattctacctggaaccaattaagaaaaaggtaagtccctttgtttatgcaactggatgcagatttggagagcggttgagtttcaaacagaagtagtccttacatccaatggtgaaatggtatttatatatttagtggtacgagttaaggttgcttttcctctaaaacaaggattctcaacctagtggagaggaggaattgcaataggtagaatccctaagcccttctgtgatgtatgccctgtgggagtgttggagatgtccttctcagggttctggccaggtagttatttagggaaaaattcacacatgagacaggttctttgaaaatccatgtgtgaacctctgagggatatatatgcaacatcaatccaacttcatttcttcagtgaggaagttccttcttgtgtggctgatgcagtctggagaaaattcttctctgttcctctcttgattaaaatttagttctttattcggttgatgcattcaccacagccattcttttctatttttgtaattcacctttgggccttgtagtagattggtatagcaacgactacaaatttgttcatatttccctgctccatgtccttgtatagtccctatccccactgaatctgggtttggctatgtgactttccttgaccatgggactacagaacatgtaatgcaaacagacatttgaaaattatttacacgttgggacttgttctctttcattgtttataggaatcctgtgaaggacacaagtgaagaagcccgtgataacctgctgaataaagagagatctgtggtccagtcacccctactgcttccgccaatagcctaagaaatgctggataagtgagtgaggctatccttggtcatctctgctagctgactggcaagctgactacaacagcataaaagaacccaatggaattggagagctaatgacccataaaactcagagttgatattttaaagtgctttatagttttctttttatatatgcaccactatagtgtccattttcaaattattcatctgttgattcctagggaaaattaatagtctataacataaagttcctttaaaacttggatatgaagtctttgtagtgttacctttttttagcagtggagtgaataacatcaatatatctaattaataccaatagagattttcccccatttgaccaattataaaaatatcattaatatttttcaggatacattgtgtttgcataagggctttattataaaatcattactttttccaggaggatatgtgaacatgaaagaactgtcaagtagttccaatgttcctccagacatggggtagattacattgtagtttaaactgtaccaattcttttaacaaataaatcaaatagacactctaaagtactgcctaatttctatcatttcaactgggtttataactcacttcacttataaaagaaaatgaaattgttaaaaatcagaatacagtcgaccattggataacacgagtttgaactgagtaggtttactcatacacaagttgtcttctgcctctgccacccctgagatattaagaccaactcctccttttcctcagcctactcagcatgaacatgataaagatgaagacctttatgatgagcaacttccacttaatgaatagtaaatatattttatcttccttatgattttcttaatagcaatctcttttccagcttactttattataaggatacagtatatactaggtataacatacaaaatatatgttaatcaactgtttatattattggtaaggcttccagtcaacagtaggctattagaagttaagcttttggg

SEQ ID NO: 12934 - DNA, 9885 bp, Human
gccttcatcactagcagggccaaaaatccctaaagcctcaggactggggcaggcctcagagcactcgttcacagtttgtttccatcattttatttttttgcggagaagggagtctcgctatgttgcccaggctagtctccaactcctggactgaagcgatcctcctgtctcggcctcccagagtgctgggattacaggcaccgcactaggggccacacgcggccccatcattttaataattcataattaccacgcttagaaacctgcctcagattcattccccccgcagcaacacccaccatccaccctcctgtcccctcccccatgcacagcccttacatctgctcttcagggatctcaactagggcacatggtctggccagtgaggagccttcaactagtgcggccagaacgctgaaggccggatacaaggagcctcggtgtccaggcaggggatttggggttgcctgagattggggcggggaaagccggagacagtgggcacagatggcgaggggttcacctccccaacacccccaacccagcccagtctccgaggcccgagtggctgctttttgcgccacctggcggccgtctccagcgagcggagcgcgggtgaccgtgcctgcgggacccggttcccgtggggcgagcgggcgtggggcccgcccagcttggagagccgggaaccgcgcggcccagggactggcaagactccggattcaacccctgcgaggccccgcaacccggtgcccgcggtccctggcggcggcgcccgcgtgcccgaggcgctgcggggcgctgcggggcgcgcggcggttagagcgagcgtgtgcgcacgcgcccaccccacgccgcgccccgcaccgccgcgcgcgcgcacgcacgcccgacgctggcctgcgccggccgctctcccacgcggggtctcgggggctcctgagccggccgcctccaggaagcaggcgccgcgcggtattgccgcatgcacctcggtcgtggggaccccgctgcagcagccctgtccacacgggtgaactcctggagggcggggcggggggcaatctgcgcgggtcaggcccctcggagcaggctgggggcgcccgagccaggccgctcccacctgccagccgcgtggccaatgaatgctaggcctggtgatgtcatgccccgaccggaccctggtgacgaaagtccgaagtcacccgtcagggaaccagcacagacccacccgcgggggttccagaagtttccactgccgccgcggagtgcggcctcgcccagcagccttgcgcgtgctaccacgctgtcctgccttctcaggtgtcccaagtcaccccttcctcccccaggggtctcctgtctccatgccctcccacctcatttccactagcgatcccattttacatctccattcccacaggtgtcctttcatccccaggagtgtcccacgtcaccttttctgcacccgtgccacctggacccctaaggggacggtactctgccacactcccacatgcctctcctcccatgccacccgtctgtgtcgtggccggggatgcatgaccccttggccttgcgctaacttcaccagcctcgagcgagaccgacagggtgtccaagtgtgtccgtccgtctgtgaaagtcgtccctgcgtttgtctgtgcctgtcactgcatgaggtcgtccgtctgcgcgtgtctgtctccacgggcttctgtccgtctgtctgtcacgtgggtgtctactccgccgctgcaggtctttgggtcgcgtctgtcactgcgctctgtcgtcggtcggcgtctggcactggagtgcgtctgggccccggggtctccgggtctcggctccaagggagggagagagaggggaggtggccacccgggagagcggggaggggcgggggcggagacagtgggcgggggcgggcgggggcgctgtgaggcccggagggggtgtgtgcggggggccggaggcggcggctgtcagagtcggctcagcctgcgccggggaacatcggccgcctccagctcccggcgcggcccggcccggcccggctcggccgcctcaggtgagtctccctccccgcccgggactctccttaaggcccgggtccggggcaccgtgcgctccccgaggggtccaggcccccctaacgggacggctcccgcttccccgggcctgccccgcgccgccctccgctgccccgcactcgtccggaactcttccccggccgcctcacactcaccgacgcccacgcaggagcccgagcccgcgggaacggccgccgcctctgcgctccgattcccgcggggacccccgagcaccccttccccgatcgctccctagtccggggccactggaagacaccccctaattggggcggtacccgagctgcgcaggttcccggcgccgggctgggcacccccatccccagggccacaagcccagcgcccctgcgcagcgccccgcagaggccccctccgaggcccaggacgccccctcccgcggagactccatctctattttttgggaaggggaggctcggcggaagccccgagttataattagcgccactcgggtttcctagttaatctccagcagcaccaccaccccccgctcagggcggcgggggctgggctaggagtgaccggcgggagaggggggagttcccacccggggaattttgatcctttggctggagatgccggaaccgtagcagctgctgcccccaaaatagcgcccccgcccctgcagccggggatctccggagtcccgggaacgcaggcgtcccggctcgcccttcaggcggctctgcaaggccctcgagcccccaggccccctccccaagttcccggctcctggctcggggcggggagcgccgaccttttctcggtctctactgccctccgccggcggcggcgtgcacggcagcttcagacggatggggggctctcgagtcctgggggacgcgggctggcgagcctgtttgctggggctgggctgggagcgtgcgcagctgatgggaacccgcgggcatcagcgctcggtgccagacattggatgagaaggggcagggttgggtggggagtggactaggcaggatttgggggaccccgggacctgaggcttccacaccctgaatgcccagcccaccgccccccagggccccgggtctggccgacccaggagagcggggctgcgccttcaggccgccgcaagctcccccagcggcgctgcccgtccgtgaggccgcgcccctgtcgggtggcctgttcgtggactgaggcttctggtgccctcactgcacgagctgggcccggcccagttccgggaagaggtgagggcagtggacccctgcggagcagagagggtgctcctctctgttccctgcatttgtctggatatgggtgtctgcctgatctctttcccctcctgcccgctggcctgtgtccttgtctctgcctgtctccttccctccctccctctctcccctcatctttgccaacctgccccacctcctctgcagctgagcgataacccttgggccgacagtgccctaatctcctccctcctggcttctcgaccgacccttcaccctttccctttctttctcccagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctaccaatatgtggacaccctatacccaggttttgagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacggtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgtggtagatggagacttcctcagtgacaccccagaggccctcatcaacgcgggagacttccacggcctgcaggtaactagtggctagctggcgtgaagctggctcctctgggtcccaacggtccctcccctccctgcagggacccaggcatgagggcttctccaggcccattcccagaagtcccagaagtcctccctgagggctcagatcccagggtggtcagcagggcagacaggaaagccaccatgggtctattttctctttctctgcatccctcccctgatctcgtcctctctctgtccatggttccgggtctgtaactgttcatctctctggctctttgtctgtccatctgtttctgtctacttgtctgtctgtgcctgtcgctccatcccacccccctctccctcacccccaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggctgggcgactggctgcccagggtgcccgggtctacgcctacgtctttgaacaccgtgcttccacgctctcctggcccctgtggatgggggtgccccacggctacgagatcgagttcatctttgggatccccctggacccctctcgaaactacacggcagaggagaaaatcttcgcccagcgactgatgcgatactgggccaactttgcccgcacagggtcagcagtgcagagggagagaaggctggggaggacaggagtcgggggcgggaggacacacaaaggcagacacacggagacagaaaggacgggtgggacaggggcaggatagaacagccagagagggatatgctcacaaagtagataaaaggggagagaaaaagaaaggagacagagaaggcagagggggtcttgcagagacagaggcaaaggaaagtgaggaggagacgaggtagacatggagggggcggggcacagtggctcacccctgtaattccagccctttgggaggccaaggtgggaggatcccctgagaccaggagtttgagaccagactggacaacataacaagaccccgactcttaaaaagaaaaaaaatacaaaacttagccaggcacggtggctcgtgcctctagtcccagctacttgggaaggtgaggcaggaggattgcttgagcctgggaggttgaggctgcagtgagctatgatggcaccactgcactccagcctgagtggccctatctctggaaaaaaaaaaaaaaaaaaaaaagggagaccaagacaaaggagttggagctggattaagtcaaaccagtgatgattcactagcagtgacacattctctcacacacacaccagtttacctggatcgagaagaggacaatgaaatctagcattggatgggtgttgttaaaaaatgtgatgtttgtagacataggacccgtcctggttatttaggaaagtctcaagacatcctagccatttttttagtgagagaaacaaagatggaacagaaaagctgagggaaacggaaggagacggagcgcttgaggaagggaagaccccaatgaccgcgcacattggagaaagtggtgggagggaggggacgggttctctggggctctccgctgagctgaagagtccgggatcccgtggagttgggggccacctcctcccactgcccgtctggactgagccttcccttccttccgcagggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccggtatgcaggggccagcgggcagcggctgggaggaggggagtgggagcccgccaggtgtaacccctctcttctccccctagcctcggaggctcccagcacctgcccaggcttcacccatggggaggctgctccgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactcatacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagccacgggagtgtgcgcgactagggagccaggggtagaggcagaacgccggaatcacgggggccgagtctatgcaggagcggggctggagggcaagaaacaggcgagctccgaggcgggcgcaaggcaaaggccaacccctagccctgccctgccgggcggagctcgcgcctgcgtaatgaggcccgcaggcaggctagctggcacggcggaggggaggagaggggaggggaggggaggggaggggaggggaggggcggggcggggcgcggcggagcattgtgggagctcctcggtcggtgccggtcggtggctgcctattgcggcctgcggtgatcaacgaggcccggggagcgcgtccccagtctgcgcgccggtcctgcggcagctggcccaagacccggagccgaaaggaagtgttggagcctgaggtcgctccgcgccgctaggaggacgctgtgcctggcctgggacctccgctcccgcccaccgccctggagccgctgagggacgtccacgtgggcctgtccccgccgagccgcggccctgtccgcctggcgctgctctcgggccactacctctactaccactacggctgcgacggcctggacgaccgcggctggggctgcggctaccgcactctgcagacgctgtgctcgtggccagagggccagcccgcgggcgtacctggactggccgccgtacaggcggccctggaggacatgggcgacaagccccccggcttccggggctcccgggactggatcggctgcgtggaggccagcctctgcctcgctcacttcggagggccccagggacgcctctgccacgtaccccggggagtggggctgcacggggaggtggagaggctttactcgcacttcgcagggggtgggggcccagtcatggttgggggggacgcagatgccaggtccaaggccttgctgggagtctgcgtagggtcaggcacggaagcctatgtcctggtattggaccctcactactggggcactccaaaaagccccagtgaactacaggctgctgggtgggtgggctggcaagaggtgagtgcagcctttgaccccaactccttctacaacctgtgcttgaccagccttagctcccaacagcagcagcgcaccttggactgaggacgaagttacagaactgagattctcgggtcccagacacgcacctatgtacctcccactggtgtccctgcaaagcctggcgcttttgacatcaataataaaagtggcagggctgagcaacacctcaggagttactctggaaggatggaggagttatgtaacacacgagagtcaggagccctgtggaagtgcttttattagcagtaaggctgatcgtacaaaaaattctcagagcttcataggacaaggtagtacaagtatggatgatacaggactgaggaacgggggacggctcaaaagaaatcaacatcgtctggggcatccaggtcccgatattccacaatggcccttgggtctccacgaaccatcctgtgaagtgagaggtacaggatgagagctgagggctcccaaaagggagtctgcaggcggcaacaaagcttgggcgtctgccctcctcacctgttgcgaggtttcccaggataacctccctggcctcggaaggcatcatagttccctcgaccagcaccatacggggcatgggggtatggagggcctcctgtggggactgcagggcggacagcaccagctatgacagagatcagtgttgagttgcaaaactatgtcctcaattccatcctctgttttcttctcccaaagccacacactcaccaagccccttcatctccctcctgtacttacctccatagcccaagatcgggggccggggctgaccatagggcatcaggccctggggagtctggtgtgggtaggggagtcctggggtcaaacctggggggagtacaacacggacagggacatgaattactgcgggggcggggagggggatacgggta

SEQ ID NO: 12935 - DNA, 9885 bp, Human; identical to SEQ ID NO: 12934

SEQ ID NO: 12936 - DNA, 144158 bp, Human; identical to SEQ ID NO: 11755
  misc_feature (1)...(144158): n = A,T,C or G

SEQ ID NO: 12937 - DNA, 8953 bp, Human
tgaagaaactgagttttagaaacattaaacaacgtccaggtgcagcagctcacgcctataatcccagcacttttgggaggctgaggcgggtggatcgcttgagtccaggagtttgagaccagcctgggcgatgtggcgaaaccccatctttacaaaacacacacacacaaaatgagctgggtgtgggtgcatgcctgtagtcccagctacttgggaggctaaggtgggacgcttgctcgagcacgggaaggggaggttgcagtgagccgataacacaccactgcacttccagcctaggtgagagtgagaccttgtctcaaaaaaacaaaaagaaacattaaataatatccttaatattgcaacttaagtgacagcccaggatatatgaattcccttgtaaggttttcttaacaaaacaccagtcacataagtgcattttattttatatttttgtttatttatttgagacggagtctctgtctctcaggctggagtgcagtggcgccatctctgctcgctgcaacctccacctcctgggttccagcgattctcctgcctcagcctcccgagggggtagctgggactacaggtgcgcaccaccatgcccagctaattttgtatttttcgtagagatggggtttcaccatgttgtccaggctggtcttgaactcctgacctcaggtgatcctcccgcctcggcctcccaaagtgctggaattacaggcgtgatccaccgcacccggcctattttttgagagagggtcacactctgtcgtcccggctggaatgcagtgatgcgatcaccgcccactacagcctcgacctccgggctcaagcaatcctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtgacttatctttcacccaaaaatcaaagcacaattcagccccgaggcgggggcggtaggagctgggcggggcgggggcagggaaagaccaggagcagagattcaaaaagagtaagagggcaaaatgtgcataatgcatcttcacaggtaagagcctggccaggctcctgttttaatggcttcctcctgaagaagattcaagcagagtgtaagatattttcggaaagtagagcattttgaaagcatttcataatctctcaaaaccggagactgctcctgtcccacctcgttagagaaaacagcgatgctcaaaggcaacctccttcctgacattgcctggtaggacgcgacgtggtgtttgcccgcgcggaatgcggacgcaaggctgctcctaggtctcggggacgcgccatccccatttccgctcgcggaggcgtagggtccgggcgcgggaccccagtcgaccttgactggcggcgcgaccttgaggcctgcgttcgcctcagttgccccctctgtgcaatggggagacgcgcctcatcgcttgacaacggccgaagagccgccgcgcttccgtctcccgcgtgcgcgcgccatgctgcccacccccgttccgcactgaccctcccccgtgccccgcgtcccgtactgccgccccgccccgagtcccatgccgcagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcggggaggaggccgggacggcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgggctccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttgggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccatcctggccaacatggtgaaaccccacctctattaaaaatacaaaaattagctgggcgtggtggcgcttgcctgtaatctcagctactctagaggctgaggcaggagaatcgcttgaaccccggaggcggaggctgcagtgagccgagatcgtgccactgcactccagcctggtgacagcgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacagaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaaccttgcagatttggcacacttcatggttatgttgtcagaagtgacatttttcctatatgttgacagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatacataaatgacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtgacttaaggtgaaccacctgccttggccccccaaagtgctgggatttcaggcatgagccactgcgcccaaccaattaagtgcttttttttttttttcttttctcagactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccgaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacacgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaaagctacctttctcgtcttggttcatgacacatggaggctgcttgtttgtggttgccagtcataatgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcattatccctagtatttcttattccattaattaacagaatagcctcaccacgttgtcattaactgcttttattcatccaagtatttaactttttttttcttttttatttgagacagtttggctcttgttgcccaggctggagtgcaatggcactatctccactcactgcatcctctgcctcccaggttcaaacgattctcctgtctcagcttccagagtagctgggattacaggtgtacgccaccacacccagctaattttttgtatttttagtagagtaggggtttaccatgttcatggccaggctggtctcaaacagacctcaggtaatccgcccgccttgggctcccaaagtgctaggatttcaggcgtgagccaccgcgtccagccccattccttttttttttttttttttaatttctccagtgcccagcgtgatccctgacatctggtattagagttcaatacttgggccgggcctcggtaatcccagcacttcgggaggccaaggcaggcagat

SEQ ID NO: 12938 - DNA, 150409 bp, Human; identical to SEQ ID NO: 12290

SEQ ID NO: 12939 - DNA, 29453 bp, Human
  misc_feature (1)...(29453): n = A,T,C or G
agagtcagactccgactcaaaaaaaaaaaaagaaacagagtttttatgtaagaatggaatgggggaatggggatacaaatatagacatatcagcttatgtacttaaagataggtagataaactgtaaaagtaatcatatgtaggagatagtaagggacagggttagaagttaacaggtttctgaacatatcttgttttgtagatttgactttagaatccagagaatgttttacataattacaaaactaaatcaaaaactttttaaaccttaaaagtcaaaagcaaaatgaaacaaatggacctaacgtgtgtcaaattggtagcataactacacaggaattattttcaaaatgtcgttaaaacagtaatttgaggctaggcctgtaatcccagcactttgagaggctgaagcaggcagatcgcttgagcccaggagttcaagaccagcctgggcaatacggtgaaaccccatctctacaaaaaaaatacaaaaattcaccaggcatggtggtacgcacctgtggtcccagctacggggtggggagggggggtgttgaggtgggaggatcacctgagcccaggaggtcaaggctgcagcaagctgtgattgtgccactatactccagcctgggtgacagagcaagaccttgtctcaaaaataaaaagtttataaaaaagaaagctagggtttaatccacgtatatgtgactccagaatgttaactcttaaccattgtaccattgtttcccataatgtggttatatcaccatatgaggggatttctgtggcacctagaaaggactttttattgtaatagctaagtatttattttaatattaccttctatttgtggtaagaaaactactggaagttttccatttaaaagtatgctgatatttaaaagtatgctgatgataagcatacttttaacataaatggaattaaaaattggcttaaagaaaaatagatcagccaggtgtggttctggaggctgggaagtccaagagcaaggtgctggcatctggtgaggactgccctctgcttccaagatgaagccttggccgggtgaggtggcttacgcctgtaatcccagcactttgggaggccaaggtgggtggttcacctgaggttaggcgttcaagaccggcctggccaacatggtgaaaccccatctctactaaaaataacaaaaaattagccgagcatggtggcagacgcctgtaatcccagctactcgggaggctgaggcaggagaatcacttggacccgggaggcggaggttgcaatgagctgagattgtgccactacactccagcctgggcaacagggtgagactccgtctccaaaaaaaaaagagaaaagaagaatagttcagtattggtatagtagtggtagaattgagatgtgacaaaaattgtatggcatgacaaagttggaacctttctaggctgtactgactccattggtgtgaatgatgaaataagcatttaataagctttgcttatacccctaatatccacattttaattttatgccagactcttttgaaaagagaaatattttgcataaaaccttgtgtgtgtgtgtgtgtgtgtgttgtgtatgtgtgtgtatatctgtatgttttcaaaggccttaaccattataagaaattacaggctgggcgcggtggctcacacctgtaatcccagcactttgggaggctgaggcaggtggatcaccaggttaagagattgagacaatcctggccaacatggtgaaactccatctctacaaaaaatataaaaattagctgggcatggtggcgtgcacctgtagtcccagctacttgggaggctgaggcaggagaatcgcttgaacccggaggcagaggttgcagtgagccaaaatcacgccactgcactccaacctggtgacagagtgagactccgtctcaaaaaacaaaacaaaacaaaacaaaacaacaaaaaacttacagaggacattttttattgttgttacagaatgtcatacccaggctatcccccaacaggctacccacctttccctggatatcctgtaagtattgccacttaatacctcacatccttaaaacaggtgttgtttgggactggcccatgtcagatcttacagatatgcttgagcaggggtcataaattcagatgctcagaggtactacgtagaagtgaggaaaggcaattgtgtgggggactagagaggtcttgctttgtctattgaaagctggcaggtgcttagcaccagccctgtgtagccatggagggaggcacactcagcgttgctagatactccagcccttcaagtaaagccagaaacttgggttctatgtgaaattgcccaaaggttcaaaatttaggagttagttttaaaaaatgttaactgctgtatgagccagtaaaacatggatgtaagcaaaatccatcccatgaatcactggttctttttcttttttttaatgcccttgagtcataatatcactgcatcttaacctttgtgttagaatgtttaaaataattaacggcttggctagacccagagataaattgcagtggatttgtagttcttagacttggagtacgttttataaatgtgctactaagttccaccttgttgatagctatactactctgaggactaagagctgagccataagtaagaattgtgcgtttcagtttttgtttgtttgtttgtttgtgtttttgagatggagtctcgctgtgcgcccaggctggagtgcagtggtgtgatctcagctcactgcaacttatgcctcctgggttcaagtgattctcctgcctcagcctcccgagtagctaggatttcaggtgcccgccactgtgcctggctgattttttgtatttttagtagagacggaatttcaccatgttggccaggcttgtctcaaactcctgacctcaaatgatctgccctccttggcctcccaaagtgctgggattataggcatgagccattgcgcctggccacatttcagttttttgtttttgtttttgtttttgtttttgagatggagtctcgctctgtcaccaggctagagtgcagtggtgtgatctcgactcactgcaacctccgtctcctggggttcaagcgattctcctgcctcagcctcctgagtagctgggattacaggtacgtgccaccacgcccagctaggttttgtatttttagtagagatggggtttcacaatgttggccaggatggcctcaatctcctgacctcgtgatccgcccacctcggcctcccaaagcgctgggattacaggcatgagccacttagcccagcccacattttggttttatactcataactgtggggctgctatctaaccctgggagaataggaagaggggtctatacaagtttatgataatatgtatccttatgcaaagtgattatatagctctcgtgaatttatcataggagagatgagaattatggatatgttcccaagtccctatgtattaaacaggactgtagtaactatttcagtcagtgtaggctaattgctaaaacagacaactcccaaatctcagtgacttaacacgatgaaaaaacaaatgtatttctttcttcagtttcctggacgtcagtggaggatagggggtgggtgggacgaggctttgtttcatgcagtgttttgggtttccaggctccttccttattctgatcctaccatcctttagcactttggagtcctccactggatcctctgcttatgggtggcagatgaaggaagagagagagcatggaggatttgccagaggtttttaggggacaggtttagaaagtggtgtatctcacttttgtctatgttcatttactgatattcattcatgtggttcgacctaactgcaagggggtctgggaagtgtagtctgtatagctttgtggcctggggagaaagagttcagtgaacatgcaacaatctctgccactctgcatattgctgctctgaaccatgaagtccaaaatgtcacatccggtgtgtgatgtgatatacaggttaccttttttatttttaaatattatgtaacagatccagatgtgttgcaagaaagcctcaaattcctctgtttaggatatagaggaggatctttctcatatttgtagatgctgggaaaatgaaggaactgatgagttttttttttttcttaaaaccttgaggtttgtaaagaatcctgttctgactcccaaatagagaagcagacccctcttgcctgactcaagtagaattaaatttaactgaattctgacaaacaagtgtccttacaaactggtatactgataaactagtataagataccaggatttctaatgggacttttaaaaagtaaaagaatgaggtagaccttaataataacctctgtttgttccttatttttagatgggtcatatttctctatgatcgtatttgtttaaaaattattctgatttttcagcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggaggtgagttacgggttgcggaattagtaatgattgggattgctgtagcactttttccttctccctttatcctcttcattcctgcttgttttgtataaggtcaagtcgctcttaggtaaccttaggtagtaaggacctagctggcaagatggagggatgaagattctctggggacatgaaagctgggagcagtttcaaaaattccactgtgaagggacttggaataaatttcatggcaataaaggaccaatatgtaacactttgcttgtttgtagtcttaagacctgattaagacatttcaattagcaagactgtgacctttaggtcagctttattcaaaggtaaaaaagaccccaaaaaacaacaaaaaaaccttagcccttttgtattttaagttagtagggaagagtaataaagtaatattttggctgggtgtggtgtctcacacctgtaatcccgacactttgggaggttgaggtgggtggatcacttgaagcaaggagttcgagaccagcttggccaacatggtgaaaccctgtctctactaaaaatatgaaaattagctgggtgtggtggtgcatgcctgtaatcccacctacctgggaggctgaggcaggaaaatcacttgaacgtggtaggtagagtttgcagtgagccaagattgtgccactaaactccagcctaggcaacagagtgagactgtctcaaaaaataaataaatatataaggtaaaaatttaaaaacttattttttactggagaatttgaagttttgaatctagataaacagggactgctattatagcattaatagcatatttttccactgttaacaatagatatttttctaaagttttttctgcaatcatgagaactgtactatagtttattgacatgttcttttctctagttcctccaggccaaggatttggagtcccaccaggtggagcaggcttttctgggtatccacagccaccttcacagtcttatggaggtggtccagcacaggttccactacctggtaggtaccagctgtccagaaaaaaacagtatcatgatattttgagtttttaaatcaccattgagggaacttagtttatatttgagataatctgcaataaatgtttatatttccataaataattttaaacataatggttttatgaaatatattaaattgatggaaaagtttaatcagtaaaatagagataaagtcacactttttctattaaaaaaatctgtcccaaagccaaaaggaagccttcaggaacttctctgcccactcctgtaccaatagtaaaaccacccccagaactgtattctgacaaccattccaggtggactcagaatttaatctgattcaagtgtgaaaaaagtattatttatgaggatcttatgtagaacatggaatattaaaaaggttcttatgaccaaagttggttttagattcagtaaattatatttttaaaaactatcctcataagtatcatagtgtgaatgttcttgtatgtttccatattcatagtcatcaatgctgttttgaaaaattaaaacatgtaagacctgttgccgtattattattattttttttaacattataggtggctttcctggaggacagatgccttctcagtatcctggaggacaacctacttaccctagtcaggtattttgttcctaccttttaagctcactctaggtagctagataaagaaggaacctatcctttgctgaggtttccatgggtcggaggaaatggcccattatagtaatggaagactaaagtctttacttctgatagactccatactttctttggtccatctgctttaatagtgtcctgatgactttgagaagacaagcataggtctattctcataggtaatgattctcacaactttatcctggagattaacctggggtcttggttttagttctttttcctcttccttgcccttaccagcagttacacctatgaatttgggtggctgggtgattggtatttctgacagtgatttatgtagggtggttttgtttcccatttttacctttataacttttcactcttttttcagatcaatacagattctttttcttcctatcctgttttctctcctgtttctttggattatagcagtgaagtgagtaaggttttctaatgtttactaatcactaggtcctttatatgtgcctttgtttctgattctcatgtacttgtctctcactacttcttaagggctcacctgtatctattttatctttgtgttcctgtaataataggtagggctttagacatagtagccagttagtctgttgactggattttctcattagctgcagagtttcctatatgtcaaatatttgccctactccgtatggcttctttttttttttttttgagatggagtttcactgttggcacccaggctagagtgcagtggcacgacctcggctcactgcaccctccaccttccgggttcaagcgattttcctgcctcagcctccggagtaactgggattacaggcgcacgccactacacctgtcacatttttttgtatttttagtagagacagggtttcaccatgttggccaggctggtctcgaactcttgacctcaggtgatccacctgcctcggcctcccaaagagctgggattacaggcatgagccaccacgcacggcctggcttcttattttaatcccaaattttattcttaaattaccttgttaatttttttatagcctatgcaagttactaggaacaaaataagcagtatacttgatgcttacttttattttgattttcttattgatttctatattggatattcatgaatgtctagcattttcaagcttgttttaggctggggtaggagaaggattctagtattggaagagaaacatcttagtgatttttttagctcactttcctgatttgaggtatgtgagctccagagaggttgagaaacttgtctagggcaacacaactagtgaaggacaaagctgagaagattctagtctatatcttctgccttctagaccagcggtctctctcttatacaaagttgctttgctgatacagtaaatgatactcctcccaagcatgtagtaagttgctttcagtcctttttttcattgttgaagttgtttgccaatcatattataaacctgtaatcacttttgttatgaaaattttgattttagtttaagcatgcatataattttagagaaatcattttacgactgaatatgaatgacttttaaacatgaaacactaaaagtaaatcacatgtacttatgcaacttatttttatttttattttttattacactttaagttctagggtacatgtgcacaacgtgcaagtttgttacatatgtatacatgtgccatgttggtgtgctgcacccgttaactcgtcatttatattaggtgtatctcctaatgctatccctccccaccaccccaaccccacgacagtccctggtgtgtgatgttccccatcctgtgtccaagtgttctcattgttcagttcccacctatgagtgagaccatgcggtgtctggttttctgtccttacgatagtttgctcagaatgatggtttccagcttcatccatgtccctacaaaggacatgaactcatcctttttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacctagtaatgggatggctgggtcaaatggtgtttctagttctagatccttgaggaatcgccacactgtcttccacagtggttgaactagtttacagtcccaccaacagtgtaaaagtgttcctatttctccacatcctctccagcacgtgttgtttgctgactttttaatgatcgccattctaactggtgtgagatgatatctcattgtggttttgatttgcatttctctgatggccagtgatgatgagcattttttcatgtgtctgttggctgcataaatgtcttcttttgagaagtgtctgttcatatcctttgcccactttttgatggggttgtttgatttttttcttgtaaatttgtttaagttctttgtagattttggatattagccgtttgtcagatgggtagattgcaaaaatgttctcccattctgtaggttgcctgttcactctgatggtagtttcttttgccgtgcagaagctctttggtttaattagatcccatttcttaattttggcttttgttgccattgcttttggtgttttagacatgaagtccttgccgatgcttatgtcctgaatggtattgcctaggttttcttctagggtttttatggttttagatctaacatttaagtctttaatccatcttgaattaattgttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattacttctgagggctctgttctgttccattggtctatatctctgttttggtaccagtaccatgctgttttggttactgtagccttgtagtatagtttaaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctgtaaattaccttgggcagtatggccattttcacgatattgattcttcctatccatgagcatggaatgttcttgttcttccatttgtttgtgtccttttttatttcgttgagcagtggtttgtaattctccttgaagaggtccttcacatcccttgtaagttggcttcctatgtattttattctctttgaagcgattgtgagtgggagttcactcatgatttggctctctgtttgtactgttattggtgtataggaatgcttgtgatttttgcacattgattttgtatcctgagactttgctgaagttgcttatcagcttaaggagattttgggctgagacaatggggttttctaaatatacaatcatgtcatctgcaaacaggaacaatttgacttcctcttttcctaattgaataccctttatttctttctcctgcctgattgccctggccagaacttccaacactatgttgaataggagtggtgagagagggcatccctgtcttgtgccagtttttcaaagggaatgcttccagtttttgcccattcagtatgatattggctgtggatttgtcataaatagctcttattattttgagatacagtcccatcaatacctaatttattgagggttttcagcatgaagtgctgttaaattttgtcaaaggccttttctgcatctattgagatagtcatgtggtttttgtctttggttctgtttatatgctggattacatttactgatttgcatatgttgaaccagccttgcatcccagggatgaagccaacttgatcgtgatggataagctttttgatgtgctactggattcggtttgccagtattttattgaggatttttgcatcgatgttcatcagggatattggtctaaaattctcttttttttgttgtgtctctgccaggctttgttatcatgatgatgttggccttataaaatgagttactgaggattccgcctctttctattgattggaatagtttcagaaggaatggtactaactcctctttgtacctctggtagaattcggctgtgaatctgtctggtcctggactttttttggttggtaggctcttaattattgcctcaatttcagagcctgttattggtctattcagggattcaacttcttcctggtttagtcttgggagggtgtatgtgtccaggaatttatccatctcttctagattttctagtttatttgcatagaggtgttcatcctattctctgatggtagtttgtatctctgtgggatcggtggtgatatcccctttatcattttttattgcgtctatttaattcttctctttttccttttttattagtctcatatgcaacttattttatgcaacaattaccaccttaagctggaactaaaaccagtaggtagaagttaacagaatgcagagtgttagattttggaagagcttttagatggaagtgaaataggctaccctgtgaggggtgagcttcttgtcactgaaagtccacaggcagattttggttgatgttgagtatggatgtgtctgtgtgtatcaaggaaggtgtaaaaaaaatttttgtcttagatgggaagttgggccagtttatccctcctgattgatccagttctctaattctgttatagtcttgttgttgttgttgtttcatttgtttgttcaattttgagtcagggcctcactctgctgctcgggtcaggctggagtacagtggcgtgatcaaagctcactgcagcctcgaaatgctgggctcaagcgatcctcctgcatcagcctcctgagtaactgggactatagttgtgcaccagcatgcccacctaattttttaatttttggtaaagatgaaggttttgctgtgttgcccaggctggtcttgaactcctgggctcaagcgatcctcctgcctcagcctcccaaaatgctggagttgcagatgtgagccactgtgcccagctctatgatagtttttcagcaagaaggttggaatcaaatgggcattaaagaagaatagcaaaggttggaacttctggtagcagattttgctgagaactctcccctagaatttaacctcaagaacacagatcctgatttctctctttttttttttttttttaagagacagagtctcactctgttgccaggctagagtgtgcagtggcgcgatctggggtcactgcaacctccgcctcccgggttcaagtgattctcctgcctcagcctcctgagtagctgggactacaggtgcgcaccaccacgcccagcatttttgtatttgtagtagagacagggtttcaccatgttggccaggatggtctcaatctcttgacctcgtgatccacctgcctcgacctcccgaagtgctgggattacaggcatgagccactgtgcccagcccagatcctgatttctttgaattcagtttaatgcctggaagatgacagtattcttgaaaatttacttcaaacttagactttcggcagagaatacatcaaaaaaatttttccctacagatgaaatatgaaatcaatatatatatatgtgtgtgtgtgtatatatatatttttatatatatatatatatatatatatattttacaaaagagaatcacagaaaatgagaatcatcaaatggtacacagtgagggttagtttatctattccagtgtattagaaacaatggcttctgtcctatttaggattttagtgacagcggttacatcaaaggaaacttagtttcttgagacatgaaggcttataaaatttttttatactcgactatttgctacaagtagaataattttggctttctattaaaaccactataggtatatttgttagttctctgcttacagccctagcttggaaactagtcgaggatggatgctaaggcttactggtcgaagaaaatgttggagtaaaaatatatatgagtgggaggagctattgacccataaaagtgttatcttgaaaagctgctgaaagatggggcttgttctcatctcctcagttgctttgcccccacaaatgctggtgtactgctgtattcaatgtgtataactttaaatacagtttctgttgtctaaaaagcattgaatcatcttttattttgaaatggtattgattgcatgtttaaatgataatactttggaggtattggattaaataaactgtgtgtgtgtatatgtgtgttttctgcagtgaaaacacttattttacaacagtaatctttattttaggtcaacattcaaacatacaagaaatgtgttgttacaattaaaatttttttaaaaagtagtggagcatcatcttcatcccatccctcttaagccctgacttgaacaccctaagaaacttcttgaattattctgggctggccgcacacctgtaattccagcactttgggaggccaaggcagggggatcacttgaggccaagaattcgataccagcctgggcaacatagcaagacccccgtctctacaaaagtaagaaattagctgggcatggtggcacatggctgtagtgctagctactcaggaggctgaggcaggaggattgcttgggctcaggaattcaaggttactgtgagctatgtttgtgccactgcactccagcctgaacaacagagtgagagcctatctctaaaaaataaaaaattgggggaaactattgaattatttcatagctttgtattttaaattgttttatcttttaattttgacataattttagacttgcaaaatagtacaaataatttgtatataccctttactcagattctccaaatgttaacttcctacataaacacaatgcaatgatcaaaatcaggaaataacatcgatatagtactgttacccaacctacagaccttatttcagtttcaccagttgtctcaatgatgtcctttttctggttcaggatcaaatccagaatgcaatgttgtatttattgtcatgtctcttaagtctcctttaatctgaaatagttcctcagtctttgttgttcatgcccttgatgcttttgaagaacactgtcagttattttataaaatatttcttaatttgggtttgtctgatattttctcatggttaaatccaggtcatgcctttttggcaagagtaccacagaaatgattttgtgcccccagtgcatcatatcaggagacacttattattgacttattccattactggtgataattaattttgatcatttaagttggtgcctgcaaggtttctctgctataatgttataggttatacaaatatcctgtttctttatacttttgccacctaattttagcacccactgttgattcttgcctgaaacagttactaccatagtatttgctaaatggcaatttttaattttcatatagatttatttcatgtataataatcagggtccatataggaaattaagagagattactaaaattatattgctggtttgaaatctcactgggcattcatgtgctacttcactaaagccattttatattcttctgtttttaaatcaaacattgtcgctcatctcacaccattcagggatcagtcttcttttttcttcctattctaccaaaaaggaaactatagtaagattgtgactttaatttcacaagtttggccatcttgtctcctggaagtttggtgtctggctatctgttggcaggagaaaaatctgtcctgaagggggataggtctttcctgtctgttccataatgagctctggtaataaaatgctcatatccttgccttaaaacccaaacattggccttcttacttaagattgatgtctggggaagtctttaagtttcctcattagaaacttactggaaatgctgacacggattttatgccttttattttcagcctgccacagtgactcaggtcactcaaggaactatccgaccagctgccaacttcgatgctataagagatgcagaaattcttcgtaaggcaatgaagggttttggtaaggaaaacaaatttttgtcttttttaataagttaaagtaatcagttctaaagtaaaaataaaccttatctcataaacccaagtttatgtgtcagcctgggtgcgcatacctggatttaatctgatgtctagtgccttgtaagcattctaagagatgacctcaggctgggtgtggtggcttacacctgtagtcccagcactttaggaggccgaggtgggcagatcacctgagttcaagaccagcctggccaacatggcgaaactccatctgtactaaaaataaaaagtaaaatagttgggcatggtgatgcatgcctgtaatcccagcttcacgggaagctgaggcaggagaattgcttgaacctgggaggtggagattgcagtcagcctagatcacaccattgcacttgcacccccagtctgggtgacaaactccgtctcaaaaaaaaaaaaaaaaaaaaaagatgacctcaagcagcacctagcatgtactttgtccttacttaaacatgtgtggttcttccagggacagatgagcaggcaattgtggatgtggtggccaaccgttccaatgatcagaggcaaaaaattaaagcagcatttaagacctcctatggcaaggtatgtttttctttcctggaatgagcaccagcagtggctggtagactctgcattcatgtcagattggatactatattttgattagtacctgtggtgcaaaagagggacaactagactttagagacctcaagggtactgtattccctatttctgttttttgttttgttttgttttgagatgaagtctcgcaccaacatccaggctggagtgcaatggtgcgatctcagctcactgccgtctttgcttcccgagttcaagcaattctcctgcctcagcctcctgagtagctgggactacaggtgcacagcatcatgcctggctaatttttgtatttttagtagagacagagtttcaccatgttggccaggctggtctctaactcctgacctcaagtgatccgcctgcctcagcctcccaaagtgctgggattacaggcgtgagccaccatgcctggcctatttctcttaaaaggctttttcattctagagtagtccttgatctcataatcataccttaccccagtcacatatgtgatagacattcagtagaaagtagatcacaactacaatcatgatcaagaggatggttctcagtcttctgcctgttacagtgggattcaaggcttattacatagcccttgtttattcttggtcctgggcatcgccttctgcttctctccctttctctaaacgtgtcctatgttaaaattatatggactgagcgtggtggcttacgcctgtaatcccagcactttgggaggccaaagcaggagaatttcttgaggccaggagttcaggaccagcctgggcaacatagggagacttcatttccaacaacgatgacaacaaattatattagctgggcgtggtggcgtgtgtccatagtcccagctgcttgggaggctgaggtagaaagattgcttgagcccaggaagtcaggctgttagtgagctgtgattgtgttactgcactgtagcctaggtgacagaacaagacgctgtctcaaaaaaaaataatatggaaatgcttgccattctctgtacacgccatgatcttttatgcttctgtgttgtgtacatgccattctcctggccttgaataccttttctttttttcatggcaaacttctttaagatttggcttaaatatcagctactctgaagtttctttcattagtctggacagaatttagctgcttcttaatactgtagtcccatagcactttgtaaaacctctgttattactaatctcacggcccacccccaaaaactgagctcccataggacaaaccatggtcatagtcatctttgtattacagtaccaagtatataatggcaagtagccacttagtacttgttgaatggatgatcagtttctaaatccaacaagattctatggctaaaaaatgccattgttcctcagatgtaatgggaaaacatggatagcactgctttgctttttttttttttttttttacttttttttgagacagagtctcaaaaggctggagtgcagtggcatgatctccgctcactgcagcctccactttccaggcaagagcgattttcgtgcctcagcctctcgagtagctggaattataggtgtctgccaccacacccagctaatttttgtacttttagtagagacgggattttgccatgttagcaagtgtggtctcaaactcttggcctcatgtgatctgcctgccttggcctcccaaagtgctgggattacaggcatgagccaccacgcctgacctgctttgccatttagataggaatcctaaaaatatcctaatgttctctgcatctagtttatatttctcagaatggggtagtggtccattgattggtcccaccttgcttattctattttgcctttccctgtctgcccagcccagtgactgattatgcaacacaaaccctagatctccttaagcttcaacatcagactcactattctcacaaagatattttccatgttatgaattttttatctagtctgcacaatgctgtctcaagtttttttatatattgctttagaattaaaactaacaatctaatttccgtaccactagccacctcttttcttaacttcctaattagtaaaacactgtttttctagcctgctatagtcatctttgagtccatgtttttcttttatcatagggagtattctgtatgctttgtcctagcagttggttatttactagtttttattgatctaatctataaaatggccctttaaaatgtttcttttgtctactttgttccttctcatttccattgttaccattcaagtccaagactttattacctcttaactaaatattccagtagcctaaatgttttcatctatagcttctttgtcaccatcatccattctgaatattgttgctacatcagtgccattttcttgcatgaaaagtttccagtggttcctcccagcaaacagaatcaagtccatattctttagcttggcattcagtgtaataatccaagatttagttacaactttgttttaactcatctattatgaaaaccttcctctgtagcaaaaccggttgtcttattgttccattgaacaagctttgctcattcttggctctatacgagtaattctcaaccttaactgaacatcgtaatttcctttaaaacttaaaaatacacagaatctctgagtcttagtcctggacatcaatgtttttctttttttttttaaagctccacaatgaatgtaatgaagagtcaaggctgggaaccccttctctgttccttggtggtgttccttcttacctgaaatacctttctccttcgtctttgcatgctaatttttacatttttctctgagctctccagctgactttgaactttttctgtttcaactttctctattacttatttctatgctacttacccagtgctagagtacaggttaccttacattattttttttttagatgtgtatctttccaaataagaacaatatcggctgggcacagtggttcatgtgtgtaatgccagcacttcgggaggccaaggcgggtgtatcacttggggtcaggcattcaagaccagcctggccaacatgtgaaaccccatctctactaaaaatacaaaaattagcctggcgtggtgggatgtgcctgtagtcccagctactcagggggctgaggaaggagaagcgcttgaacccaggaggcagaggttgcagttagccgagatcacaccactgcattccagcctgggccacagagcgagactctgtctcaaaaaaaataacaacaaaaaacaaataagaacaagatgataatggtttctacttcctcatagaaccaagaacagttccttttactaagtaaatatctgtttatcattttgtcagtttgaataattctttgtttcatatatcccttgtttttgtacctggtagagtggaataagattttattaaatgtttattgatagaatgaataaaatagatctgcttgagtgtaataaatgtgtaagtgtaacagactttaaatttatttannnnnnnnnnnnnnnnnnnnaattaatgtaagtttcactagttttcctcttttttgtacctggtattagcggaataagatcttattaaatgtggattgattgaatgaataaaatagatctgcttgagtgtaataaatgtgtaagtgtaacagactttaaatttatttacttcttttttatttctatttatttatttttttttttgagacggagtcttgctctgtcgcccaggctggagtgcagtggtgcgatctcagctcactgcaagctctgcctcccaggttcacgctgttctcttgtgtcagcctcccgaggacctgggactacaggtgcctgccaccactcccggttaattttttgtgtttttagtagagacagggtttcaccgtgttaaccaggatggtcttgatctcctgacctcatgatcctcctgccttgacctcccaaagtgctgggattacaggcatgagccaccgcgcctggcctttatttacttcttagtatattaacattcagctttcaaatttaggtttttataaagcaattccatttctttttttgtattttccttaaaagatttaagtgacaaaatttggagaacacatatacttagcttgtatttgtgattaaataggatttaatcaaagatctcaaatcagagttaagtggaaatatggaagaactgatcctggccctcttcatgcctcctacgtattacgatgcctggagcttacggaaagcaatgcaggtactactatatgtcatttattatgaatattttgtcctatttcatatgtaaaaccgtacaaattatgacagttctgaatttacagtggtaattaaagcaattctttatttcacatcatccatctgaatatatagtttttagttctacagaacaaagaaatatttgacgaagatttaattacttgcagaaatttcatttttctttgtataatcttcccttcatttcatgtagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccaggtgagtatagtatgaatgcttgtgcgttgatagagggaacatactttaaaagccttttgccagtgagcattctttattccttttaatatttagccaccttgcaatattgccatctttaagagggacaacacagaaaccagtgtacagatttctttgtagttactattgagatttattcctgtaaatctggcttttgtaaggaattagagatttaacctctaaggttgtatggaatcagaaaccaattcgaggctctgtggctgggatggggatgaaactgtacatttgagcttatcactatcctgcccattatgccccaccatcaagtgaagatgtgcaggactgccatagaggtgctacaggaagtgaggactatgtgaggagacccagaaatgcagaaaaatgttttagggttcccagtaataactgtgattagcaccttctttattttgattccccaggtgtgctggagaattgacagaaaatactccaaatagggtatttggaatggcattagaaacacacttagggccagacattgtgcctcacacctgtaattccagcacttttggaggccaaggcaggaggattgcttgaggccaggagtttgaagccagcttgggtaccatagcaagaaaccatctctataaaaaatatttttaaaaattagccgaacatggtggtatgtgcctgtagtgccagctattcaggaagttcagtgggaggatcacttgagcccaggagattgaggctgcagtgaactgtgatcgcaccactgcattccagcctgggcaatagagtgagatcctgtccttaaaaaaaagaaaagaaaaaaagaaaagaagcacacttagatgatgaaggtgtatttgaaagagattatgtaaatgactagcatgctgattcaatatcaagagttattgcctattgtgctagtgcacaagattggaccatctggagggatctaaaggagaggaggggctcttaagagccaagggaggggctgggtgtggtggttcatgtctgtaatcccagtactttgggaggctgaggcgggtggatcacctgaggtcaggagtttgagaccagcctgaccaacatggtgaaactccatctctactaaatacaaaaaattagccaggagtggtggcacctgtaatcccagctacctgggaggctgaggcagcagaatcgcttgaacccgggaggcagaggttgcagtgagctgagattgtgccattgcactccagcctgggtaacaagagcaaaactccatctaaaaaaaaaaaaagggaggtagctgtggaaaggatagtggatatggaaatgagaaagcaaagtaaatgggttgaaggaaattgaatttacctaaatcagagtaacaggagggcagtaggttaggatttaaaagaaacaagaaggaaaacagacaatgctaaaaaatggctattaagattttacatgaggtgctgagtctctctttatgcagagttcaaggcccagccctaccttttccagggcatgagtagaggagtaacttcctgagaaagtgtgtgtgaatccaaaggcaataatctgggaaattttttgtgagtaccttttcctgtgttatattcagtcgcccatgtagaatgtgcctctacgtattccttgtgccagttgctcagaagacagttcttcagcttcaaggaggatttttccatcttattccaaagatggtccctgagactctaaaaggcagccttttcttgtttgggtttgtctttctgtttttgagagaaaccaactgctcattaagcttaaactcttccttcctccttcctttcttcctattccagggaagagtgtggtatacaaataggcacagtctaacagaacatgagttatttgtagctgcttctgtaaagcttatgtgtcatttttatgcgtgtatttatggtaaatacttacatattaagattataattcgatggctgagtgtggtggtgtgagcttatagtcccagctactctggaggctgaggtaggaggatcacttgaacccaggagtttgaggctatgatcatgtctgcaaatagccattgcaccccagcctgggcaacatagtgaaatcgtgtctcttaaaaaaaaatattatactcagatgaagaaaagaaagtttatgaagcctccatattatatcctccctccctcctgccctagagttaaatttcttgagggcagagaccctgtctctcctgtgtccctaccgcttaacacagtgcctgacacaaagaaagtgcttaatgtctcttagtcgcatgaatgaataaaaagtagaactcagtacagtgcatattgatcttaaattccagctaagagagctgtttcttcatttgagtggtagttaatatctcctagtagagatatttttgtttaaacattttgggtttaatttagctcccaaaagccctcatttttaacataacctcattaaaccgtgatcttatattataaaatccagttgacagtataataaattactagttatatttccatgcatagaaatgaagcatatgcatgacagacattatggattaatctttaataaattatctctttaggccaggcccagtggcttacatctataatcccagcactttaggaggctaaggcaggaggatcacttaagcccaggagttagagaccagcacctgggcaacatagtgagacatgctgtctctacaaaaaataaaaaaattaaccaggcatggtcgtttgtgcctgtagtcccagctatctgggaggctgaggtggaaggatcacttgagcctaggaggttgatactgcactccagcctgagtgacagagcaagaccctatctcaaaaaaaaaagaaatagtctctttaaatccaaaagtgaactagattggaaaaaaaaaatttagtagaactattatttatttcttccaattcctgcctttctcttttgcagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctagggtatgagcttttcttttgaagatttggcttctgctgtaagatacaaaaatatttaaccctttaattttgtttgcagatggctaatcgagacttgttaagcagtgtgagccgtgagttttccggatatgtagaaagtggtttgaagaccatctgtaagatatttttgtgctttgctttattttctttttaaatgagtgggagctttgaatagttgttcccattaaatgttgataatatagtccacgtggaatctgcttaggcagtagctgatctaatcctttggggtttgttttttgttgtttgttttctttattggataagcccccagaaacagtcctgtgtttttacatacaatttcctatgaatggtagttctgtgatcaaacagggctgtttggggattatttggccttcatctgtaggcctgtcttgataactgtgccagaatacctgatagttgtagcacttcctttaaagagaaagggaaagtcctgaggaactcacagtgtcaccacgaagcagtttgagtcctcaaaacagatatttcaggtactcagcccagtgagactcatttcctttttgaagttaaccagtttctggtggtctaatacacagatgtctaacaaagtgaaagtttcattctcatggatattaggactaaggggagtattagtaacactttggtattaacaatggaatgttgggccaggggcagtagctcacacttgtagtcccagctactcagaaggctgaggtgggaggatcacctgagtctgggaggctacagtcagccatgattgcaccactgcactctaggctggatgacagagtgagaacctgtctcaaaaaaaatcaaggagagcatctgaacactcttaactcaccccatgtttctgtgatgattacagagaaaataatcaaaggcaggctataagtgataaatgaagctggaggggtacacttcttgtgagatcatgattccatgtctcaaccatctctaacttgcagtgcagtgtgccctgaaccgccctgccttctttgctgagaggctctactatgctatgaaaggtgctggcacagatgactccaccctggtccggattgtggtcactcgaagtgaggtgaggcaggcctctctctttttgtcgggtcttacttgatgttcaatgttgatttcttaaaagttccccagttggttgtcagtccctcaaaaatgataagaaagagctctctttgccacctaaaagaggtggtataaagaacagaaaattcactttcctcatgctgtgggagaagcttgcattagtgaaataggccactctaccctaatgaagataatactaacagattttacaacttgagaacgtcaatggagaatacaaatttatgggaagttagacatttgtctttcgattttcattttgcttatataaaaattagatgaaaggcctatgtagattaatcctagtggatatcaacattatttaaatttagcatcctttattaataataaaacaatttttaaaatattcataattgtctcaagtatagcctcatttttaaaaattgtactttatatatttactccacttacaaaaaattttttttctcagaagaaatgacatttgaattttttttttttttttttttttttgagacatggtctcactctgtcacccagactggagtgcagtggcacgatctcagctcactgcaacctccacttcctgggttcaagcaattctgtcacctcagcctctcgagtagctgggactacaggtgtgcgccaccatgcccagctaagtttttgtatttttttggtannnnnnnnnnnnnnnnnnnnnnnnnnnnnnnnnnnnnnnnnnnnnnnnnnnnnnnnnnnnnnnnnnnnnnnnnnnnnnnnnnntttgagaccagcctgggcaacatggtgaaacctatttctacaaaaaacacacgcgcgcgcacacacacacacacacacacacacacacgccggggcgtggtagcctgggcaacatggtgaaacctatttatacaaaaaatacacacacacacacacacacacacacggtgaaacctatttatacaaaaaatacacacacacacacacacacacacacacccacacccaccccccggcatggtagtcccagctacccagaatgttgaggtggaaggatcacctgagcctggaaggtcaaggctgcagtgagccgtgatcgcaccactacactccagccttggtgacagagaccctgtgtcaaaaaaataccctaaattattattattattgcggggttttttttttttttttttttttttttttgagatggagtctcgctctgtcacccaggctgaaatacagtggcataatctcggcttactgcaacctctgcctcccgggttcaagtgattctcctgcctcagcctcctgagtagctgggattacaggtgcgtgccaccatgcctggctaatttttttgtgtttttagtagagactgggtttcaccatgttggtcaggctggtctcgaactcctgacctgatgatccgtctgcctcggcctcccaaagtgctgggattataggcatgagccaccacacccggccaaaaaccctaaattatactaaagaaggtagattatttttaaagaaaacaaccagaatatggtattttgaaaaaaactttgttctttaacttaaattttcaaagcaggatgttttaagttgtgataaaatatacataacataaaaatttaccatttttaagtagcagtaagtacattcacattgttatgcaaccatcattaccattcaccttcagatgttttttcaacttgcaaaactgaaaatccatactccttaaacagtaactccccattctcctttctcccaactgctggcaacaaaccatgtgactttctgtgcctgtgtttgactactctaggtacgtcatattggtggaatcatacaatatttgtctttttgtgagtgttgtcttttacttagcatagcgtcctcaaggtttattcatgttatagcatgtcagaatttccttccttttgagactgagtaattaaatagtctattgtacgtgtatcccaccttttggttttttttttaattcatctgtgacacttggtttgtttctgcctgaataatgctgctatgaacatggatgtacaaatatctgttcaagtctactttcacttattttgaatatacccagaagtggaatttctaggtcatattgtaattctttggaagtgtttttgttttgctttgaggaattaaccatattagtttccacagcagctgcacccttttacttttccatcaacctgtgtacaagtgttcccatttcatggcatccttgccaatacttactatttttttggttttgataatagccatcctatcaaatgtttttaaatgactaatatctttggaataatagatgaaactagtactaccctgaccaagtattttacagagctgtgaatcagaccttcattgggtagtgctagcattggtatgagtgccagccataaaatgtcagtcacttggtgttttcccccccaagttttgattattattaagatcttattatttaaaaagaattttaagaaatgtcagttgtcacagatgtttttctgacagaaatattatttcttatgcagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatatatttaaggtgtacaatatggtgttttgatatcagcattccttgtgtaatgattccacaattaaggtcaggctaattacgtatctgtcaccttgacatagttaccattttttcatgtgtggtgaaaacacttaagatctactaccttagcaaattttaagtgttcagtacattattaactatagatactgtgctctacattaaacctctagcatttattcgttttataactgaaagtttataccctttgaccaacatctccccattttccccacctctcacctggacaaccaccactgtgtttaagttcagctattttagattccacgtataaatggtatacaatattctctttctgtgtctggcttatttcacttagcataatgatctctaagtttataattcacattgtcacaaatggcagaatttcctccttttttttttttttttttttttgagatggagtttcgctcttgttccccaggctggagttcagtggcacaatctcagctcactgcaacctccgccttccgggctcaagcgattctcttgcctcagcctcccgagtagctgggattataggcatctgccaccactcctggctaattttttgtttagtagagatggggtttcaccagattggccaggctggtcttgaactcgtgacctcaggtgatccacacgccttggcctcccaaagtgcttggattacaggcaagagccaccacacccggccagagtttcctcctttaaggctgaataatattccattgtgtatatatactataattcctttatccattcatccatcaatggacacttgagtagtttccatatcttggttattgtgaataatgctgcagtgaacatgggagtaaagatacctctttactgatttcatttccttcagatacatacccagaggtggtattgctgggtcatattatttttaattttttgagaaacctccatactgttttctataatggctataccaatttaccttcccaccaacagtgtacagtggttccctttgctccacattcttgccaacacttgctatgtcttacctttttgataatacccaacctaataggtgaaaattccatgtgtacttgagaagaatgtatatgctgccattgttaggtatagagtgttccgtatgtgtccattagatctagtttattgttctatttaagtcctctttttccttacatctgattcttctatccattattgagaatggggtattgaagtccccagttactgttgtaaaactgtttctccctttaattctatcagtttttgcttcatatatttaggtggtctgttattaggtgtgtagatgttcataattgtcatatcttcttgcagtattggattttttattatataatgttctttgtcccctgtaactttttttttttttttgagaatggagtcttgctctgctgcccaggctggagtgcagtggcctgatctcagctcactgcaacctccgcctctcgggttcaagcaattctcctgcctcaacctcccgagtagtggggattacaggtgtccgccagtcagcacgcctggctaatttttgtatttttagtagagacaggtttttgccatgttggccaggttggtcttgaactcctgacctcaggtgatctgcccgcctcagcttcccaaagtgctgggattacaggcctgagccaccatgcccggcccctataaccttttttgatttaaagtctatctcgtctgatattactgtagcctcccctgctctcttttggttactgtttgcatggagtatctttttccattcttttaacttttaatactgtttgtgtctttggatcaaatgtgagtgtttggtagacagcataaagttggatttttgtttgtttgtttgtttgttttgagatggagtgctcactactgttgccaggctagagtgcagtagagnnnnnnnnnnnnnnnnnnnnnnnnnnnnnnnnnnnnnnnnnnn

SEQ ID NO: 12940 - DNA, 29453 bp, Human; identical to SEQ ID NO: 12939
  misc_feature (1)...(29453): n = A,T,C or G

SEQ ID NO: 12941 - DNA, 29453 bp, Human; identical to SEQ ID NO: 12939
  misc_feature (1)...(29453): n = A,T,C or G

SEQ ID NO: 12942 - DNA, 29453 bp, Human; identical to SEQ ID NO: 12939
  misc_feature (1)...(29453): n = A,T,C or G

SEQ ID NO: 12943 - DNA, 68436 bp, Human
  misc_feature (1)...(68436): n = A,T,C or G
agtgttgatttgcaatttaaaaatacatttgtagatataaagacaatttgctagcacagtctaaagcttgcaaaatcaagtggcttaaaaattagaactggaacagttgattagaaaagtttttggctttattttggtttatctggtaaaaaggaagaaaagatagtctccagcatatctgattcatgccagttaaattgtctcatagaatgaaacagtctcaatcattcttattcttaacatacttgtgttgaaggatatgagtatttgataaccttcttccccttctaggtcagatgactgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatggttccattgtagagatttatagtgatggtagcgttagtgttatttaattgatacagtttttctcaaatatgaatttatttttaatttgactcatgttcatagttaatcctgacctgagaattcctgtcttttatttaatgagtagctaagtgttcagtttttcattttaagatacagtttctagaaactggatgtaaaaatttagtataagttgatttaaatgaacatgtaattgaatttgggttgggctaatttgtagtttgtaataatcagttatttggccctgggacctaagtctaaaatttttagacttttactggagggattcattcacaacttttactaagacagggaggttccatttactgtaaccatttgggagaaacaaaattaaaacaaaaagtcctatagttgtattgattctgccaagaggatgtcgctttttaaagagaccgagaccgtatacttttactttaaaaagaaactacagatatagttgaactcaaaaacttctagtcattttttttctgagcgtttcattaaattgtgtttttccctatgaaatataaatattcagtttttatgttttacatctgtagatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggtaagtctgaagagattcctgagtaaggtaatattgccaccatatgtagaaataataaaattaatgataaattcagttcccaggaaaccagttcagttcagtgttgtaactggattatgcctgggtgcatttggtttgaatagagttaatttagtcaaaatcctgaattctttgattaaaaaagaagtaatttctttttttgttgacttgttttgaaatctgcaaaagtgaatagattatttggcatatagcttcatttctgagggtaatcatttttattttaggattaccttcaaactttaaaaatttatgtctttatctgcaatcaatttaaaaaaatgttgggagtgttactataaagagaagtattagctgtgttctatctagtattttgaagtttagaattagtttgctcaatgtggacaatcaaactgaggctgcaaacagtaaaaatgagtaagtgatacaatacaatttgtagttggagcattgaaatgttttagatactttaataacagatgtagaagactaaatctggactttattaaggaggtaaagggattatgcctcgccccccgccgcccctgccctgccccgccaagaaaagaagaagagagagacggaaaagagctgagctagttgtgtagataaaatactccaagggtacttaccagtgtttgtaagcagtgaagtaaacttattatgcacagggatcaggaagccttgaaaagaaaaatatggcaagtacttgtgaatacttctttactgtgagagggaaatgcctgtgattattttctgtactgtataacaccttgggaacttttttttttttttttggagacagggtctcactgtctaactgttgcccaggctggagtacagtggcacaatggtggctcactgcagctttgaactcctgggctcaagcaatcctcccacctcagcctcctcagtagctagcactacaagcatagaccaccacgccaggccaatttaaaaatttttctttcttagaaacaaggtcttgctatgttgcccaggctgatctcaaattcttggcctcatgtgatccttccacctcagcctcccacagcgctagggattacacgcgtgagccatggttcctggcccctgaaccattttttaaaggaaatcgatatatttattctcaagtaatgaactaagttgttttataatgtgaaccttggcactttgttgttttaatctgtagtagtcattctataatgctatgagagagtatatatattttaatttttcttagaattttgtttgtagcataagagatattatagccttctataaaacttataaaacttgcttgtaaaattccatatagagattgcaactgagagttggtcgtaaaactaaaaatattgttgggaacagagcaggtcaaaactcccatgattgatctaataatggaattatactggtaaaaagccactgcacttcagcctgggcaacatggcaagactctgtctctaaaaagagacaaaacagcataaaaatatgcttgatataaactctagccctcttctagttatttgttcatttgtacattttcatttcacgcctgtaatcctagtagtttgggaggctgaggctggcagatcacttgaggtcaggagttcgagaggagcttagtcaacatggtgaaaacccgtctctactaaaaatataaaagttagccgggcctggtggtgggcacctttaatcccagctagtcgggaggctgaggcaggagaattgcttgaaccgggagttggaggttgccatgagccaagattgcactgctgcattccagcctgggtgacagagcgagactccatctcaaaaaaaaaaaaaaaaaaaaaaaaaaaaaaaaaggcctggtctcttgctgttcaaaatacgtagctggctggacacagttgctcatgcctgtaatcccagcactttgggagaccaaggcaggtggatcgtttgagaccaggagttggagaccagcctgggccaacacggggtgaaaccccgtctctaactagaaatacaaaaattagccaggtgtggtggcacatgcctgtaatcccagctactgggaggctgaggcaagataattgcttgaacctgggaggtggaggttgcagtaagctgagatcatgccactgccactgctctccagcctggatgacagagtgagactgtctcaaaaaaaaaaaaacaaaacagttgattataagttaatgagaagagagggaagtctcatacctaacttttattcacaagtaatgatactgatattaaaattttaaaccaattttttatttcttaaggagtgtttagcattcattcttcttggggttatatagttatcagtaattggtttgtttgatttttgcatactttatataaatcctctaagattaggtttatatattgtaaattttggttgatcaacgtcatgtttgataattaaactgatttaaatatattttagtaaactagctttgctgttgatcttaaatatatagttaatatctcttccttctccttgaagaattccaccaaactttatatatttacatatttatataatgtgtaatacatggaagaaaaaaacaactttaagagcacatattttacttaccatctgttatctggaagtataattgattgtcaatgaatgtcatttcagacccataaatgtgttcatttctcaaacttagtggatgcactttgttttcttgctgtgttatataactaaaaactcataactattatgttaggtgatctttacctgctaatacagatacaatttatataacagcgtcacagtccttaagcaacactaggcttttggaagattgaacaagttagaagtatgccaagtcttattcagtgtatttaattttttcttgttgagtatgtagaacttttcatggtgtggtagaaaataataaaatagattttgaacaatccttattaagtctctttatgggaagtttatgaggttctacagtttttttttctttgatttatctatttcaaggctttatctctaacctaaccattcagagacagtactttcctaatgatgaagatcaggttggggcagccaaagctctgttacgtctccaggatacctacaatttggatacagataccatctcaaagggtaatcttccaggtaagatcattcttccattctataaaatacctatcacctagcttctctgttgagtccattaacacaatgttagtataaaaaagacttgcattttaagattttaaattgtagtttgtttcatagccttcgaagactaaagaatcaccttccctttctcttagggcttaatagttacgggtatgcttctagcttctagcttgttactctgaaagcttgtattgatagagactaacttaagtagggaattttagtgtgtaaggaaaagaaactatcatttcaccaaatgtttttattcagaacacctaatactatttgaaagctttgtatgtaaagctataagggattgatagtcaaagtttatatgttaaataattaaaagccaagatgttttgggtatccacatatgtttaaagtgttccatagtatggaacatcctactttctgacctatttttggcaaagtcctctttttaagttacagttgctttcatgataatttacttttgccgtccctcactttttcaaagtttgtgactcattaccactactatctcctgttattgtcagctgcagaaataaaatatgttgtctgtgtcttcacattgaaattgattttctccgtaagaaaaaatcactgggatgagttgttaatcaaaatgttttcttgctcatctccctttatttgaggtgaaggtatccgttggtaaaaactaaacatggtataatagtaaataaaatttctgttaagctggaatataattccattaatttgaacttccaaaaatgtacaaatttgcaaattttcagtttctactaatattatacattataacgcttttgataagattataaccttatttttaaaattggtttcaggttttcatagatattaaatacttaatatgtgccagctattatgttaggtactggggacacataatgaacaagacatacactaccctcgccattagggtatttaacattcttacagtatagtaagatgagtgcttggatgggagaaattcaggataccatatgagcacatcaaaagaaacctattgctggacctcataagggatgtaaaggaagaattcctggaagatacacattaaaaaaattgagatctaatggaccaggaattagccagaaaaatgggggagagggagacaggagtgggtgtgggaaaagtgtttcagacagagggaacatgtagaaaggtcaaaaggagagagcatatcatattcagataactaacatgtagtttgtatggcttaatgtagagttcaagaggtgaacgcaccaggtggatatgggggtttggctttgtgagagtagtgagagctgagactagagaggtaagcagaagccatctcttggagagctttgtaagccatgtggaagagattgaactgtcctgagtgcagtgcggagctattaaaaagtttgtaagggaaatttatgatttttccttttagaaaaccattctggctgccgaatggagattgggttggggccaagggacgaagaaccagggaggaggctgttgcaaatatttaagtaagaggtggtagtggatagattatcaagctacttattagagtagaatagtagaatttgatgatgtacttgataggaatttctggcttcatcaactggatagattccatttaacaaaatagggctggcatggtggctcatgcctgtaatcccagcactttgggaggctaaggtggaaaggatcccttgagggtaggagttcaagaccagcctgggcagcatagcaattccctgactctacaaaaaaatgaaaacttagctgggtgttgtggtgcttgcttgtagtcctagctatttgggaggctgaggtgggatgtattcacactgctatgaagaaatacccaagactgggtaagttattttaaaaaagaggtttaattgactcacagttccgcatggctacggatgtcttaggaaactcacaatcatggcagaaggcacttcttcacagggtggcaggaaagagaatgagggccagcaggggaaatgccaggtgcttataaaaccatcctatctcatgagaactcactgtcacaagaacagcatgggggaactgcccccatgatgcagttatctccaccttgtcccgcccttgataggtggggattattaaaattcaaggtgatatttgggtgtgaacacagagccaaaccatatcacgggaggatcacttgagcccaggagttcaaggctgcagtgagctgtgatcacgccactacactccaacctgggcaacagagtgagacccctatctcaaaaaacaaaaagcaaaaaagaaaacatcccacctcagcctcccaaatgtgtggtggtgggtaataaatgttatttagattactatatgtgttttgtttaaaaaatgattatattcccatcaaaatggtcctgaatattatttaaccctgatttcactgtgtttagtcttaggggcaatattcattctttctcaggtgctttttatctccttgttgacttttttcctcttttatcacagttttgggctagttcttattgacttttctttcaggcaaattccttataagtagaataactgaaatttcctaatcacattataccctataagtggtaaaaataatagcatgaatactagcataagagtttttaggctcccccaacccagattattttctgttgttaatagtcaaatatcacaaatgtgttcgaaggcttcttgtgcaccttcccttgtttagaggtaatgactattctgaacttggtgcgtatcctgtcatctttttatactttatcatatatattttccattgtattgtgtttttaaattttatgtcaatagtacatcatactctatgtatctttctacaacctttttttaacctaatattttcagtaaatttatctgtgttgatcagattcatctaactgctaatgtggtattgtataacattatttattcattcttctgtggatggatgtacatttagattttgtccaattttttgctttatcaaatgaagtttgatacatctttgttgatttctttttgtggccatgtactcacgtgcaaggctttctcttagggtataagaaatcatagggtatttggtttttcatcatacttaccagatgtggccagattgctttccagagcatgtatttatactgtcaccagcattgtatgagagttcccatttcttcatatccttgccagctcttggttttgtcagactttaaaaattttagcaatctgggtgtgaaatggtgggggtgagggaggaaggatgcatgtattttaaattttcttcaaacaaaaaagtcagagaaatgcttagtgaatttatattgatgccacatcactccttgattagtttcatctgtttcttttgcctctttgggcctatcttttgaaatgctttgttggtattttaatgaaaaatctgataggttacatgcattttgacatcagtgttgtccttatagttcttaaggacttccttcagttttcagattgtttgttcccaaccctgatttgttgaatagatccatatctgccaaagatatcatgcttttttttaagctgtgattttttttagggggtgggggtcagtaatagaaaatgtcatatgtacaaaattcaatttgcttcatgtggaagttgaatgttcacccttctggtcacttgcatcactgtcttggtaagttaataaggtaactatagcaaacagtagattctccagacatctctggagctcactcagctatcagtgtaccacactgcctcagaggtgggacattaacttctaagtgtgtgcattttaaacataattatcccttacaaattaagttttgatccattaagtgttcttgtgaagtgcaagaatttttggattacgtgtctctctcagtttaacggatgatgtctctctcagtttaacggatgaaccataaaaatcgatttctttttcttttttgacatggagtctcactctgttacccaggctggagtgcagtggcgcagctcggctcactgcaacctctgcctcctgggttcaagcgattctcttgcctcagcctcccaagtagctgggattacaggtgcccaccaccatgtccagctaattttgttatttttagtagagatgaggtttcaccgtgtcagccaggctggttttcagctcttgacctcaagtgttccgtccacctcagcctcccgaactgctggaattaaaggcatgagccactatgtctagctaaaaatgtatttctaaataatgtttttcctatagtgcctatgatattatagtttattttctttattttctttatttttttgagacaggatctcactctgctatcaacccaggctggagtgcagtggcacaatcacagctcactacagcctcaacctcccaagctaaggtgatcctcctacctcagtctcccaagtagccaggactacaggcatgtgccaccacaagcagctaatttttgtattttttgtagagacagggttttgccatgttatccaggctggtttcgaactcctgagctcaagcaatccacccccccgcaccccgcagcctcccaaagtggtggggttacaggcaagagccactgtacctggcctgatattatagtttctattgtgacaataaattaaaagactctttagtgttagtttactttcaatttggtttattatattcaatttggtatgttcatgtcagtcatccatgcctcttcctttgaaccaaaggaatttacaacttattcttgtttctcatcaaactcggtttgctttttatatgaagctttttacagtctttttctgcccataccactttccttatttcattttcttctttgttttcttgcctactttttcttctcatgttctctactttggaaacagccttccttttcaaatgctgcattacttttgatttattttaaaatcagattcccaggcagtctgcctttaatattgttaatagatcagtaagtaagacaagcagaaatactttaccaaagcagaatagctaaaaatcttctactatctctgccatgcatgttcaaataatgttgccagaatatcaagtcatgtaaaaaaaattattggtgctatctgcgtggattaatggcatactgtcatcttatgtgttttgcatgtccctaagagaaacatttataattgctgcattatgagctcatcttctcagtttactagttctcgtaaccgaaaaaataatagcattgtcaaaatttaatatgcatctttagtttctggaactaactcatgttaaactattaagaagttagtttcttagcatctgctgttgttggactatgtccatccaaaatttaggtggtgaaacttcatggccagtgtgatggtattaagaggtggggcctacaggaatgggatttaaggcccttatgaaagaggctttatgcagccactagctctcttgcccttcagccttcaccatgtgaggacatagcattcttcccctctggaggatgcagcaacaaggtgccatcttggaagtggagagcagccctcactagacaattgaacccgctggtgctttgaatcttggactacccagcctctagaactgtgagaaaataaatttgtttttttataaattatccagtccttggtattttgttatgggagcataaatgcactaagatagtatcctttcctagagtggaaggcgggatagagaattatttaagggaaaaacatcaaaacgtgggtcttcatcttcattttaggagtatactgataatcagttactgcctgtaagtgactaatggggccagaaaaaaaaagtgaatggagatgattgtatgatttgaatatttgattatattgggtcatgtgatcctccagtgcatacacctccaagcttggactctgtttgatactggaattcaacagctcattgtcagaccagggcatgcttttctgtagtctgcaaatgtctgatcactagcaaaacgtgcccataactttacttccttttgatttatttctcataaatgccttttctgttagcatctttttaaaaacatatgtgaccaccattggataggttatagctaagtccggttctgggcattttagtgactctttgaagtgtattcaatcaaaatttattaaagaaaccactgttgtgtttgtttctctaccagttttctttgtgatgttatcggacacttaataaatatatacagttttatgtgttttatcagagaaaatgtaagctagtctgtctttgaccagtagtttctggtcaaatacaatattatactagtataatattgacttagtctcagaactgtatattctgagagaaatgttgttggagaagtcatattttcttgtgtaggcttgttgttgttttttcacatacctgtcattttttttttatagtgtcagaaagggaactatgtgattttctgtgtaacagcataaaaagagccctgtaggacatgactttctcctttttccattatttataaaatttcttttattatggaaaatatcaaatgtcacacatacacaaaaataaaggtaataacataatgaacctatgccatcaccaagctccagacgttttaaacattttgtcattcttggtttatctactccttccaccctttctttctgtcatttttgttggagtattttaagagcaaatcctagacatcatgtcattttatccataaataattcaacatgcatatctaactgatcaggtctttattaaaatttatttttttgaggcaagatttcactctatcagccaggctggagtgcattggcatgatcatagctcactgcagccttgaacttttggactcaagccatcctgctgccttagcctcctgaacagctgggactataggtgcgtgccaccacacctggctgatttttaaattttttgcagagatgtgctattgctgtgttgcccagtctggtcttgaattcctggcctcaagtaggtctttgtaatttatttttaatttttttttagagacagggtctcactttattgctcaggctagagtgcagtggtaccattatagctcactgcagccttgaactcttgggctcaagtgttcctcctgccttagcctcccaagtagctgggactataggtataagtcacctgcgcccagctggtctttttaaaaaagtaacataaccacttactatctccctgcttaacaaatcgacagtatttccttaatataatttaatacccagtcaatattatttctctggtgatctcaaagttgttgttttacagttgtatttttttaaattatgtctgttaagtcccttttattcccttttccttttttttctttctctttatgacattggttagctggggaaacctagtcatatgttatgtggaatgttccacattctggagttgactactttggtggttaacatgttcctttaatgcctatgtttcctacacactggttagagcttgtggcttgattagattcgagttaaattttaaaattaactccataggtggcgctatgaactttcttttgaactgcgtgaaccaacacctaatgtcctgtcccactttttatgatgctgattgatgagtgaggttcaggtgatgagagcctgatccctccatataaagttctccttaagttttatctactggttttggcagcctttgatgatcattgcctagaaccactatttcattaggggttacaaaatgatgatttttttcattccattattccttttacttttattaactggaattctataaacaggaacatccttcatgaaccatttggttaccctgaactatatataggaaaggcagggtaagtctataattagtcttctttatcagttttcagagtaatgagttggtgtcctaaccatttttagtagtgatctgtaattttcatgacatatcatgaatatggatattattattttttttttgtatttcagcctattcagtattactttgatctcagattatcccattttaggccagtggggagcatctttagataggcttgtttttttgaattgactgtgttattattctttgatagagaggaaacttccttgctttctggcacagttttttttccaggtttctattccagagtaggaactaggcatttcttcaatgagccttggcccttctttttccccccttaagagataggttcttgccatgttgctcaggctggagtgcagtggctattcacagatgcgatcatggtgcactacagcctggaactcctgggctcaagtgatcttcctgcttcagccttctgagtagctgggactacaggttttccactccttgcctggcaaggcttgattgctttgaacagggatgacatttaagcagcagagtctagctaggttctaggggtgattattgctatatagtttgtcataaacagagacaggaaatatgtaagttcatattgttcaaattgaaaaccacagggtttatatttatatctcttttcttctgaaaatttggttcctaaggatattaacatgattattcttttattcatactattaactcatactattttattcatactattaataacattaagactactgaatacaggtttttttgtactttatatccttaaaatatatcactctagatatgatcagtcaaaatcttgttttaaagacatctgaggtaattcatttctctttgtggctatgcccttaacatgttatacagttgagttcatttatttcatttcctcagatttttagggattgtcctcgttttttcttttgattcattgttttcatttgtttgttttagaaacaatatcttgttctgttgcccggcctggagtgcagtggcatgatcatagctcagtgcagccttgaactcctgggctcaagggatcctcctgtcacagcctcccaaatagttaggcctacaggcatgcaagtaccaccatacctggctatttttttttattttttattttatttatttttattttattattatttttttcagatggagtcttgctctgtcgcccaggctggagtgcagtggcgtgatctcagctcactgcaagctctgcctcccgggttcacgccattctcctgtctcagcctcctgagtagctggcactataggcgcccgccaccatgcccggctaattttttgtatttttagtagagatggggtttcaccatgttagccaggttggtctcgatctcctgacctcatgatccacctgccttggcctcccaaagtgctgggattacaggcgtgagccactgcgcccagcctttttttttttttttttttttttttttttttttttttaaatatattgtctcattattttgcccggggttgtcttgaactccctggctcaggagatcttcctgccttggcctcccgaagtgtcaggattacaggctctagccgccatgcccagccaatttattgtttttaattatgtaaaacttttaaattctttgacagtccaaactagactaataaggtacattaatagaagtctcactttcattcttatacttttcaacctattcccttcctttttctatgtgaccattttgttagttttactatttccagttttttaaaatacaagcaaatatatatctactcctatattctctcaacataaacacaaaagatagcgtactggctgggcgtggtggctcacacctgtaatcccagcactctgagaggccaaggtgggtggatcacctgaggtcaggagtttgagaccagcctggccaatatggtgaaacaccatccctactaaaaatacaaaaattagctgagcgtggtggtgggcacctgtaatcccagctactcaggagggtgaggcacgagaatttcttgaacccggcggggcacggaggttgcagtgagccatcgcaccactgcatttttagcctgggcaacagagtgagacttcgtctcaaaaaaaaaaaaaaaaaaaagcatactataaatactgttatgtactttggtgctttaatttattgatataccccagtcattacttcatgtatagaaatcctcatttctttttatagctacgtgttattactctattttgtggaggttctacagttttttttacttattgtcagtagaggatgatttattgggaaacttagagatggaagcatggtcttgggcagtagcaagacaggtagatctctgcaccgttagtccccagacccatgacttaagtgtcatagggaaaggatgtacatgctctgtagggacaaaggcaagctccagaacaggcaagaatgctatgcgtgtcatagcctgtaatttttgtgataacatcaaggttgctttgctctaaaggcaggatttatagtgggtacatgttcctacactaaggacagcaagtaaagtagaaatcagcaggcattcgtgggactgaggttaatcaaaagtgaacatggtagattagcatgcaagatggagtcactgttgtcttcacacccatcagtttctacttttttcatcccatttcttaataaccatctaaagattgccaccctgctagagcgcgtcccatgaccatcccctttcttttttcccttagtttcacccctatcaatgttgtctttattcacctttttttttttttttttttttttttttttctggacggagtcttgctctgtcacccagactggagtgcagtggtgcaatcttggcccactgcaacctcgcttcccgggttcaagcgattctcgtgcctcagcctccccagtagttggaattacaggcgtgtgctaccatgcccggctaattttttgtatttttagtaaagacggcctttcgccatgttgcccaggctggtctcgatctcctgagctcaagtagtccgtctgcctcccaaagtgctcaaattaccggtgtgagccactgtgcccagcccttttctttaatttagactggcatttatgtataccattttcatttttcatcattctttattgtacctcagactttccttttggaattttcctccttgaaacacattgttaagaagccctcaaatgtgctttgtttggcttggaattctttgtttcctgaatctgaacttccatgcattttaattttggaaatttttctaccattatctctttaaatactatcttatctatattctttctgttctcttcttctagaattccaagtagacagactttagtttttttgtctttgtgtgtgttttgtttttgtttttgttttttttaagagatggagtctcgctccgtcgcccaggctggagtgcagtagcgccatcttggcttactgtaagctctacctcccaggttcatgccattctcctgcctcagcttcccaagtagctgggactacaagcacccaccaccacgcccggctaattttttgtatttttagtagagacggggtttcaccatgttagccaggatgatcgcgatctcctgacctcatgatctgcctgcttcggcctcccaaagtgctgggattacaggcgtgagccaccgcgcccggccttgtctttgtgttttaactagcatttcatgtttttatctctctctactgcattctgggtagtttatgccatgataatttattcagctctctctgctggatttattattttctttttagttgtgtttaatctattttttttttttttttcgagacagcgtcttgctctgtcactcaggctggagtgcagtggcgtgatcttggctcactgcaagctctgtctcctgggttcacaccattctcctgccacagcctcctgagtagctgggactacaggcatccgccaccacgcccggcgaagtttttgtatttttagtagagacaggctttcaccgtgttagccaggatggtctcaatctcctgacctcatgatccgcctgcctcagcctcccaaactgctgggattacaggcgtgagccacgcactcggccttaatctacattttaaccagcctaatgagttttgaactgtcgttggttatctttatgatttnnnnnnnnnnnnnnnnnnnngggtattttttatttttatttattaatttatttattttttgatggagtttcattgttgttgcccaggctggaccgcaatggcgtgatcttggctcactgctacctctgcctctcaggttcaagtgattctcctgcctcagcctcctgagtagctgggattacaggcacccgccaccatgcctggctgatttttatatttttagtagagacagggtttcaccatgttggccaggctggtctcgaatttccgacctcaggtgatccgcctgcctcggcctcccaaagtgctgggattgcaggcgtgagccaccacgcctggcctaggatatcttatttgttcatattttctatttttaaatttattataattttctctatagcattgaaattatctttcttaatgaaaaatgctattccattaaattgatatatctgcctatatattccttatttcctcgcttttagcttattacagtttttagctataatatgtttcagccacaaaaatcttttatacaggaaggtccccaacccctagtactaaatctcaatgaaataactgaaaaatagtagtattaagtcatagagtttaaattcttcttttctcttattgctgaatttcttaaaagcaaagttaccagtttacattgctgcttcctcccactattaggttttgccatttaatgttataacatcaggagcacaaacttctggaggtgtatggaacagattccatttcttacttttaaacatgtgaccttggacatattagttaacctctattttagttcctcatctgtaataagatggctttgaggattaaataagtgacaaatacttggcagatagtaagacctcaataaatctaggccattattttaaaatatttttatttgtggtggttttaatttcttcagtgatgaatgagactaagtattttctgaagtgttttctatttatattttatctcatgtgaactatcaaatacctccttttcttaaaatagaagtttcactgcagaagcgagttgacataataacaccaaaagcacaagtgctgaaagattaataagttggacttcatcacagtttcaaaagtgcaccatcaagagagtgaaaagacaacacacagaatgggaaaaatattttaaaatcatgtagccgagccaggcacctgcagtggctcacacctgtaatcccagcagtttgggaggctgaagtgggtggatcacgtgaggtcaggagttcaagaccagcctggccaacatggtgaaaccccgtcttgactaaaaatacaaaaattagccagcatggtagcacacgcctgtaatcccagctacgtgggaggctgaggcaggagaatcgcttgaacctgggagatggagattgcagtgagctgagatcgtgtcactgcactctagcctgggtgacagagtgagactctgtctcaataaagaactctaacagagtgcaagcagtggtgcagtcatagctcactgtaaccttgaactcttgggcttaagcattcttcttgccttagcctctcagctagccaggactacaggtatgcaccacaatgtctggctaatttctaaaaattttttttttgttagatatgagggtctcattacgttgtccaggttcgtctcaaactcctggccttaagcagttctccttccttggcctcccaaacactggattacaggtgtgaaaccaccgtgcctagccaccaaattttttaaatgggcaaaagctttgaaaaggtattttttccaaagaagatacacaaatggaaataagcacacgataataggcccaacataactagtcaccagggaaatgcaaatcaaaaccacaatgaaatgcctcttcatactcaccagaatgtctacaataaaaaaggacaataacaagcattagcaaggatgtggagaaattggaatttcataccttgttggtgggaatgtaaaatgatgtagccactttggaaaacagtttggcagttcctcaaaacgttaagcgtagagttgctataggaccagtcagttccattcatatgtatatactcaagaaatgaaaacatgttcacatagaaacttacacacaaatgttcacagtagcattatgtccagaataggcaaatttgtagagacagaaagtagattagtggttgtctagggctggggcaaggtggggaagttaatgggtagtgactgttaatggttacagggtttctttttggagtgatgaaaatgttctaaaattagattgtggtgatggttgctctactctgtaaatatactaagaactactgtaatctttcaatgagtgaatttatggtatttaaatgacatattaatgctgtttaaaagaaagaatccagttgacgtatttacctctcctcctgtacattcatctcttgcccagattgttggttagggatgagatagatatatctcatatggtggccgggcgcggtggcttatgcctgtaatcccagcaccttgggaggccaaggcgggtggatcacctgagatcaggagttcgagaccagcctgatcaactccatctctactaaaaatacaaaattagctgggcatggtggcacatgcctataatcccagctactcaggaggctgagacaggagaatcacttgaacctgggaggcggaggttgtggtgagctgagattgtgccattgcattccagcctgggcaacagagcaagactctgtctcaaaagaaaaaaaaaaaaagagatgtatctcatatggtaattcctactgttaggaaatagtatatttcaacttaatggatgtttcattttggtatgatggctgataatttcagtcttgggttctctaggttctgtgtcccctaataccagctgtgtgattcttgtttatctacattatattatagattgttccattgtttataaaattagggtaatttttgctcatccagaggattattgtgaacttcaaatagaagtgagacagcattttgaaagctgtgtagtcctaaataaatacacagtagtgttaagattcctaaagttctctgtattttcttttcataggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactaggtatgttatctgggcctaatttaaggttatagttatattgagggatatatattctctatttttctgtctttccctcatttatatatggtattttcttactttttagaagtcaggagctttacttgttaaatatacattattctcttctttattctcaaagtaaatgatggctgatttttctcacctaatagtgctataacagtggttgtgtttctttgctctatattctccaggaatttcaaaattgaagctaacgtaactaagtcaaaaatgtttgtttaccatgttgccattttaatcagtttcctttgaagggtgttatgttttattgcatttcatattttaaaataaagtgatttaaaatagatgggctgaaaatatatttatcatattcaaatgttggaaaaatacaccttaggagaattttatcagtagtactttgaacagagatgtagtgtttcttcaagtatggcccaagcaccacgtgcatcagaattacttggatacttgttagaaatgaaaatttcttgatctctaccctagatctgctaaattgtaatctctggagatggagtccagaatttgtatgataataagtttaggtggcctttggtatataacgaagctttaaaactttaaaaattatttttacaaaataggaaaatatgtgcatgttagaatcaaacagctcaaaaggattgatctgctgaaaatgaactttggataattgggttatttcttagttgggtaataataaatcaagatattggttcaagtaatcttttttcctttcagtattttccagtggtatttcctcttgacttaaaatatactttgtactcattatagaaaatttattaaaacagagaaagatacagaagagtcatctataagccagtcactcaaagacacctacacatttgtttccttttagtgtatacgcctcttccctgcacacacttttcctttgcttttacaaaattaggttaatattggatatcgtaacatttattgtgagcagtttctgaaggacaagaaatattttacaatctaagcctaggtatcctaaacacttagttactgtcacaagtgaagtctctatatattcttctgcctttttatttttatgtgtgtgtggttctttagttttttttttttttcctctcagatgggtagcgtagtcatcttttcttctactaaaaggtagttcaaaattatgactagcaattctgaggcagttagtggattccagcttattcgaaaattatatctttagtttcccttttccttcttacttagaaatttgggactgaacttcactcagcccttagaagtaggctacatttataatgtatctgtggtaaaggttgcttttgaattgcttatcccctgtcttcctcatgtgattgtttttctgtcttggaaaaatctttttcatttcttaaaataagtaggatgagtaagattttaaacttcatttgacatcaaattgaacttagttcctttagctgattagtaaattctcaaagtaaaagcaccagttgccacctttaaataaatagctgtttctgtctccagaactgtcttttttgagacagggtttcactccttttgcccaggctggagtgcaatggcatgatctcggctcactgcaacccccgcctcccgggttcaagtgattctcctgcctcagcctcctgagtagctgggattgcaagcacccaccaccacgcccagctaattttgtatttttagtagagacgaggtttcactatgttggtcaggctggtctcgaactcctgacctgaggtgatccacccacctcagtctcccaaaatgctgggattacaggtgtgagccaccaggcctggcccagaactgtttttatataggtgactatatgtcctgatttacttgggggcagtagtaacttatacctattattttggtataataatttttattagtgcctcctttcactcacaacagcaacctggtttggaagataaattataatgtctcctatttttatattactatattctgatgcttgaacaagcatgaacttacccatggacatgctttgtttctcttctaatagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatggtaaagtggaaaagccaattgtgtgtatgtgaatgtgtgtgtgtatgtgtttgtacacagttctggagagaatcagttattttatatttaagcctatgtgataaaaatcagaatgactgcataaaatattacagtatgtcagcttaggcaacatagaccccattacaaaaaaatttaaaaattagctgggcatgctggtgtacacttgtagtcttagctactcaggagtctgaggtgggaggatcacttgaaccaggagttcaggggcacagtgagttatgattacaccactgcactccagcctgggctacagaataagaccctgtctctaaaaaacttttttttttttttttgagatggagtctcaccctgccacccaggctagagtgcagtggcatgatctcggctcactgcaaattccgcctcttgggttcaagcgattcacctgcctcagcctcctgagtagctgggattacaggtgcccgccaccatacccggctaatttttgtatttttagtagagatggggtttcaccatgttggccaggctggtctcaaactcctgaccttgtgatccacctgccttggtctcccaaagtggtgggattacaggcgtgagctgctgtgcccagcctaaaaaactttaaaaaaaaaattacagtataccattctctctctgtgggtgccacatttaatatgttccaattattagtaaaatagctttaaaataaagcttgtgaatcatatactattacatatgtttggggcaatattacctttttcatttgatccttccagggtgaaggatcaaataagtttaaaggaagtgatagttttttttatatttaatgcaagagagatttcagcagtatttttttttttttttttgagacagaaacccaccctatcacccaggctggaatgcggtagcgcagtctcggctcactgcaacctccgcctcctgggttcaagcaattcttgtgcttcagcctcccaagtagctgggactacaggcattcgccaccatgcccggctaacttttttgtatttttagtaaagacggggtttccttatgttggccaggctggtctcaaactcctgacctcaggtgatcctcccgcctcggcctcctaaagtgctgggattacaggcgtcagccaccacactcatctgttcagcagccttaattagagacaataacactactctgtgcatcttatgagatacaacagattcatctatacaataatcccttgtagttttgctcctagttaatcttcacaagattgcttagtgaaatgctttagtctgtttaatactgaaaatgcagaaagttttcaacagattttgtctttaatatttctttaaaatatatctataaatattactttgtttattgtatatgtatttataactcagaattccagttctatagatgttaatagatactaggccaaaagcaaaaagaacaaagtctggggaacatttgttaaacaaagttgaacataggtttttgtttagcctcaaaacttctcagaacctttttatgataatgtgcattgtgatatgatatacattctttctcaatattaattgattatggaaccttttgaaaaggaatttcatgtggtattagttttcagttgaacacaggcttgcatagaaggagttagtgaatttttggagtaagtacttttaggtgtaaacatttgaaaagtgtttaacattttctttactactggtaaactcaagctgggctttgcatttcgatattgatgactgttgacagcttaaccactaacagcaaagtatacaatacgtatggtgacactttcaatagataggttcatggagtcctaggaggacatgcttgagctaatgagtaaatacaaagatggtgacactgttagactcattattttcttttttttttctctgagacggagtctcgctctgttgctcaggctagagtgcagtggcgccatttcggcccctgggttcacgccattctcctgcctcagcctcctgagtagctgggactacgggcgcctgccaccacgcccagctaattttttgtatttttagtagagatggggtttcaccttgttagccaggatggtcttgatctcctgacctcgtgatccgcctgcctcggcctcccaaagtgctgggattacaggcgtgagccactgcacctgttccctcattaaacattttcttttctgtttcattactaaatattttagtatgtatcttttaaagatacaaattcaaaataactacaataccattatcacctaaaaattcacaagttttgtaatatcaaatatctagtgttcaaatttccgcagtaagcagaaatttttattgctcttaataactcttaaggaacaaaataaaactgtagatataaaacaaagagtctgctaatttcccggtttgttaatgtaacacatactcaactttgcctaagatcaaaagaacattcttgccaggcacgatggctcatgcctgtaatctcagcactttgggaggccaaggtgggtggatcacctgaggtcaggagttcaagaccagcctggccaacatggtgaaaccccatctctactaaaaatacaaaaagttagccgagcatggtggcaggggcctgtaatctcagctacttgggaggctgaggcaggagaattgcttgaacccaggaggcagaggctgcagtgagccgagatcaaggcattgcagtgcagcctgggtaacagagcaagacttcgtctaaacaaaaacaaaaacaaaaaattctttttctcagaatagctacattcatctcatcattatataaaagacttactaaaaattaaagccttggatttgactctaggtaaagtgcatggagaataaacatgaatcattatttgttttagtatactattagtataataattgaaacagactactcatattcctgcttatgtgacatacttgtttttgttttgttttgtttttttgagacagcttcttgctctgtcacccaggctggagtgtagtggcatgatcatggctcactgcaacctctacctcctgggcttaagcagtcctcccatttcagcccctcaagtatgtgggactacaggcaagtgccctcatgtccggctaattttttaaattttttgtagagacgagatttcgctgtgtgacctaggctgatcttggtctccttgggctcaagtgatcctcctacctcagcatcccaaagtgctggggttataggcatgagccaccatgccaggcctgacatacttgtttaattaagagaagtaggcaacaaaataacttattaatataatacatagatgattgaagggaatttgttttgttgactgctctatttttatactgcctaataaaagcatctgggatctttgtttaataacttattttttctttttcagagctatccattttttattttgcccttaaaaaaattcctttttttttttttttttttttgccacaagcatttaactgtgaggtatttaggaaaacctagttttttttttcttctagaaactttttgtctctgggtgctttccagttactttgtgccatttagagcaatgccaggcattcatttaatattttcataaacatggcttttttttcatatttaaacatttgaactttattttgatgagtgaagggttaaaagagatacactacctttctccttatttaagacctcgcctctctcacccagaaaataatcattaatactgtatttaaaattctgaacatcctgtttgaggcaaaatatttgcagagtactgcttcttttgtatgtttttccagagatactctgtatatgcaagcatgattattgtctcttatctgcataggaatagatattaaaagtattattactgtaatatattcatcatattcttaactttatgtttagacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaagggtaaataatgttttctttctttctcctcaatttactgtacctttgtatcaatttttctttgtaaaaaaataggataattgatatacgaataatgccacagattttttaaagatattttgcctcagcataatggagttactaatgatgctgtgtttatgccagtttttccatttgttatcaacacaagtaatgtacccttaactgggttttaagcactgaattatgaaaattattgtgagatttttattcaccattaacaaatttgtgtttcactgtcttcctgataaacttttctctgtattttggagtcttttaatctcagaggctactcaaagcccagctttttcacttctgtatttttactgaaagaataccgtggaagtatttttattcccttttaggcacattgttactattataaaaagatataattgggcacaagtattatgttaatttgaaatggtgatagttttctgactttaacccacagaatttatcttaaaaagaaaaagaatctaacgtaaacccaatctataagcttagtgttgagcataaaaactctttagtgagaatgtggaaaagactaccctttatgctcttgccttttcccccatcagcttgttcttaaaacatatttggtcttcttgatagtaaaatacaagctgccatcactttcataaagagattgttgaataaattctaggcatgctttgctgtcttacacaggagttggcagattttttccataaaggtcaatattagatattttttaggctttggaggccatatgatctctgtcatgactatttagttctgccattatagtgcaaaagcagccaaagaaaatatgtaaatgaaagagtgtggctatattacagtaaaattttatttccagtggcaggtagcaggctgaatttggtctgtggccatagtttgttgacccttattatatcaaaggtttgaattatctggatatctatactacaaaatgaagttagaatttcttttagagtttttctgcttctccaaattggtggttttttttttttttggccaaagattacattataaatgcaaaagactggtctaacattaatatatattattggtgccatccaaggtaattaattcatttcaacttggagatcaagttatattctggagattcctcaatttggattgtttttgatcaataaatttaatggcaataaaatttcatgctctcacaacctcagaatcatcgttccattaaaaaaaattgaaattattatctaggcggtcacctctttcttgctgtttttaacatttatgagctcttttcctctgcctttgttctcagtccaagattatttcactgtatatgttaatgagagtggctatcttgaagggacaaaagattgaccttaaaatgaattttaaacattaacctgtgcaaacagttccatcactaaaaaaaattaaagtcaaaggttttggaatggatcattaattgcaaataggcattcttctttttttccccttctctccccacccccagatggctattttaactgtaaattagacttcaaattttagatatgtctctttttcttactgtcatgtcctttcaccattgaaagaaatttaatttccaatctcttttgtttgtatgtcctccatctatgcaaaacaaaaaattgaagaaaaaaaaaaaaccccaaaaacctaaaaaactaactggctttcaaggctcagcacaaggtgactggaaagtgtatggagttattttctctttttagcctcctttgtaaaaaccctggaattctgactggttgggtaaatgtgattcagttttttgttttgtaatgcaactattttgatggttggcttcacagctgaggcgagccaccatttcaaacccaataacaggagacttggagacggtacattacagaattagcaaaaggtaagagatgtgtatgctgcatattttgccctctaatgagtgttttatacatcttacaggaattattcatttaaggaaagtgggtcattttcagtcaccagctcaagtcaccaccctgtatataaacaggataacgcatggataaactgctttgtgtttcacaggtctttctccttcactagaagttctgtttttaacctttaattggtatgttatttttagggaattaatatgctttttatctttcttcagatcaggtgtcaaatatccaggaagtggcctgatacttgttttctttttcccttttgttgccaaagggggaaataaagcagcagcctcctgaatctgggagtagtagtcttcacctatgcagttttctcatattcataaatgctgcggtgattcatatcctccttcatggtgattacgttggcatttgttcatacatcttgtaaaataacattgtcattatgtagtaatctgtattcctcctgtttgagttttttatttaaaaaaattcgctgactcaaaagttggcagtaggaagaacagagttacgcttctgagctctgtcttccaaaaattagttgtaaacttagttgccttttactttgccagagagatttaaaaacagttttatctcagtgagaggtttgaaaaatgaatttaaggagtctactattttttttcaaaatatttaaataacttctagatctgagaaagtttctgtgaaacccagtgctataaatcatttacatacagcttcaaatgattttttgtttaaaaaaagtgaaaggacaataaatctacaacaaaaatctgtcaactcattttctcttgatttggaagtggctgttcttactgccacttttctaaatgtttttgtggattcgagaccattacccaccatccagaccaatctgaacccttccaatcacctgtggcttggcaaaacaaaacaaacaaaaagcccaaaattgcctgctactggagtaagtccttgtcctttctctttttttgtagctgagccgagctacagtacatgaccctgagactggaaaattgaccacagcacagtacagagtatctaagaggtaagggagtaatggagagaactttagtcatatttggaccatttctttcttgggaatctaattttctgaaaactcatgatatagtttctaagacctaggtggttaggcatagatgtttgataatatctgtgctggagttttcatgacggactaataaacatggttatggggcagttaataggggttttccaaagtaacattaacttacataatgtctgttgaggctccccaaactttgataagtgaaatgtgttctcatattgaactaagagaagttcccaaattcccttcattaaacaaggcctcttttggactctgcagtaaagcaggggtttaaaaatctcagggtcacctagtagctgcaggtattgcgtaagtaagtgcctttataacaaagcctttgcaagttccttgcttttaacagtgtttaaagataatcttattaggttattagttgattgatcactaaaatgttttttaaaaagagctcactgtgtaacttagagctcacagaattgggtgacagtattacaatagaactccttttccatctacttgtgaaggtttctcggctctcatgaaaatagaaatatctttgtgctgaatttttattctaacaagtagaatatttatccacagacacaataactaatgaaatataacaaacataagccccatccatctcattaggaacatcttaatacattttcacttgtttatacttgataatgattgtttagtcatgttatttagattaacaaatgtgaataataattatagtaacaatccagaagatactatctttaacacagcctttttataggtctttaacacaggctttttgttttaggaaattcatatttttgttaattgtataaatatttttaatatagataagtataatgtgataaataaaagattttcaggcataaaaatgtgtcactgtaggacaaggtttcttaaccttatcaatagcactattgacattttgagtcagataattcttgttcttgggggctatcttcagctttgtaggatgtttaatagcatctgtggttcactggatgccagtagcacccttccttaagttgtgacaatcaaaaatgtctccagacattgtcaaatgtcccctgataggtaaaatccccaccactacctctagtgactccacccctgttgagaattaactgttctaggataagaatggaatgaaactataacatcaagaaaaaaaaaaaagatgtaaaatgtccaagtattaaaaaatattttgttcacatattttaagtggatgatggtggatatcaaatcattatggtatttagattccagtggatacatttaaagtaatcattttttagaaattaccaacgttttcaatatgacaattcaatcattcgaaactaaattatgaaaaaatttagttgtcaactaaaaaatttatgcaaaggcaaacatagattttaacaggcattttaggaggtactcagagaaattttgaagattactgctgtcttcaaaaagaaaaagattaggctggaccgaatgcgttgattcagcatttcctttttcttttttgggcaggaccatatgccttttatatattaaccttaaacgttactatacacgtcttggtttcttgtctctgctgtataacaccacctgcccttttgccccagtaagagagaaaaattttttttcttgcctatcactagcttcatagctgagacccctataacaaaagacagattaacaagagaaaatcatacaaatttatttaatacaaaatttacttgacaagaagcctttagaaatgaagaccgcagcctgagcaacatgttaaaaccccaactctacaaaaaatacaaaaaaaattagccaggtgtggtggcatgtacctgtagacccagttacttgggaggctgaggtgggaggatcacctgagcctgaggaggttgaggctacagagagccacagtgagccatgagcatgccactgcactccagccagggtgacagagtaagatcctgtctcaaaaaaaaaaagagaaaagaaatagaaaaaaatgagaacccaaagaaacagggaaacctgtgtatttttatgctaggtttgatgagtggatagtcatacagaagtatgatgaacaaaggggatatgatctaatggtaataaactgggggaaacttagcaaagcctgtttgttcacatacctcttggtatctctgtgtctcaggataaggatgttcatttcttccaggtagagagaggatacttctggattgaaagtcttatactactttagaggaaggtcagagaattctttttttttttttttgggggggggatggagtcttgctctgtcgcccccaggctggagtgcagtggcgcaatcttggctcactgcaagctccgcctcctgggttcatgccattcttctgcctcagcctcctgagtacctgggactacaggcgcccgctgctgcccggctaattttttgtatttttagtagagatgggtttcaccgtgttagccaggatggtctcgatctcctgacctcgtgacccgcctgcctcggcctcccaaagtgctgggattacaagcatgagcccgtgcctggcctagacaattcttttatagcctgcttaaggggaaaagagtgggagaaggtcagagagacctgcttctgctcaaatgctacagtgccatattttggggttgagtgtcctgaaccccattagaagacatgaagaaaatttaaatttgccataatatgattttcattttaatcacaggagcaattatccttaaggaacactaatagatagtaaggatttgcagaaactaatttgcatagacatgttttgagatatgatttacagtgcttctgaacattgcaattaacccgatttttacattaagctaattttcccattctattacagaacctaattcatatctacaaaaaaccccttctttaaaaaaaataaaaattaaactgttaacagattttatcagattattgcatggttttacacattttttgtcataaagtttgtaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtagattgcttgagctcaggagtttgagaccagcctgggcaacatggtgaaacctcatctctacaaaaaaatacaaaaattagccgggcgtggtggtgcatgcttgtagttccagttactccggaggctgaggtgggaggattgcttgagcccgggaggtagaagttgcagtgagtcgagatagcgtcattgcactctagcctgggtgacagaaccagactccatctcaaaaaaaaagggagtgttactatattttggaggggattttacatgaaagtcaaattaaatgaaataacttcccatgcatcagtagaattcattttcctctgtagtgactacaacagaactacaattaagatgacagtttgacagttattttttttttaacctacaatcaacattggttttaactgctaagcctcaaacccttcatcaagattttttttttttttttttgagacggagttttgctcttgttgcccagactcgagtgcaatggcgtgatctcggctcactgcaacctctgcctcctggttcaagagattcttctgcctcagcctcccaagtagctgaagttacaggtgtgcaccttcacacctggctaattttgtatttttagtggaggcggggtttcaccacgttggtcaggctggtctcgaactcctgacctcaagagatccacccgcctcagtctcccaaagtgctgggattacaggcgtgagccactgcgcctggccgagatatgttatgatataacaagaaatgcaaataaaaacttaaaaaatttaaaccattaaaatatttttgccttgctaagattgacaaagaataaaaggattgaaactggcaagggttttatgaaatgggtaggtgtaaatcattgcaactgttttggagggaaatttgacatttatcaaaatgtaaaagtcatttagcaattccacatctaggaatttatcgtacagagatactcccacaagtgtgcaaagatatagcattttgttacaatattgtttataacagagaaaaattagaaataacctattatttaaccagtacttaattggtagactttcatggccattcctggaattaaaagtttgtggtggtgttctgttgtttttttaagagatgaggtctcattctgttgccaaggctggagtgtagtggtgtgggcatagcaacctcgaactcctgggctcaagcaatcctcctgcctcagcctctaagtagctgaaactataaacctgtgccaccacaccttgctcattaatttattttaattttttttgtaaagacggggtcttgctatgtttcccagactggtcttcaactcctatccccaaacgatcctcccaccttggcttcccaaagtgctgggaggttattagattttttttttttttctaaaagcagtagtttaaaaggcagtgagggatgggaatataaagtggtgtcactgctgtggaatatagtctgccagctcctcaaaaagtttagggttaccatgtgatctagcaattctacttctaggtacatacccaaaataatttaaagcaaggagtcatatacttgcacacctatgttcataacagcatttattcactatagcccaaggttagaagcaacccaaatgtccatcaacaaatgaatggataaacatgtggtatatatagataatagaatattattcagccttaaaaaaggaaatgaatttctgataccctgcttataacatggatgaaccttgaaaacattattttggctgggtgtggtggctcacacctgtaatctcagcactttgggaggctgaggcaggcagattgcctgagtccaggagtttgacaccagcctggtcaccatgatgaaaccccgtctctactaaaaatacaaaaaactatggtggtgcatgcctgtagtcccagctacttgggaggctgaggtggaagagtcacctgagcccggaaggttgaggctgcagtgagccaagattgcatcactgcactccagcctgggcaactggagttgagaccctgtctccaaaaaaaaaaaaaaaaaccacacacacatgttaagtgaaataagctagaattgacaaatattatatgattcttcttacaggagatacctagaataggcaaatccatacagacagaacgtagaatagaggattaccaggggttgtgaggagggagagatgggagttgttgttcagtgggtacagttttctgtttggttttgatgaaaaagttctggaaatggatagtgctgatggttgtaaggtattgtaaatgtacttaacaccagtgaattgtacacttaattaaaatggtaaaattgctgttatatatattttaccataatttaaaaaatagtctaaatggctaattttatgttacatgtattttaccacaaatttttatttttttagagataggttctcattctggggcccaggctggagtgcagtggtgtgattgtagctccctgcatccttgaactcctgggcttaagtaatccttccgcttcagccttatgagtagctaggactacacaggcacacgctaccatgcctggctaatttttaaactttttttgtggagacagggtcttgctaggttgccgagactggtcttgaactcaagtgattttcctgccttggcttcccaaagtgctgggattacagatttgagacactgtgcccatcctgtttaactttcctgatgttattctttgaagcataaaaggtttttatttggataatgtcccatttatttattccttttgttgcctgtacttttgatgtcatagctaaaccattgcttcgtccaacgtcacaaagatttgctcctgtgttttcttcccacagtttttataattttagcttttacatttaggtctttgatccatcttgagtaattcgttttaatataatgtgaagcagaggtccagcttctttctttgcatgtagataaccagtgtcccatgaccatttgtggaatgtaacaagcatttcttacttttgcagttttaaaggagtaaagtgaaagactggagtggtaatttgctagaatggctaaagtgaaggtatttttcttggtagcaggagacttcaataagcaagcattgacaaggaggagattaaagataaaagggaggcaataactgctggagtaaggcatctagagttagaaagcatagaatcaaaagcatagatagaaagtctgcctctataaggctgaaggacgatgattctaccaaagtacaagaggaaaagataagactagatatttaaaagttgttggtagcagggagggaagttgaagatatcagaagacacgttctctgtgggtgataggttccaggatggaataggaacagtttgttcatgaggcatttagttcgaagctttattagaatgctttccaatttagcattgcaattacctgtaaaaatcaagtcagtagttggttggttgcttataaagttcagacatccatcaaattgtgctaggcaggaaagacaggtacattgacatataccagattagttctaccaggaacttgggcagaattagaagaaaaaaattcttaatatacttaatcagctatattctttacaacaataacactttgattcttcccatttttgctacactgaggaattctgtaatactcagccagtcccaaaaaatttgcaagatatcaccaagcaaataattttagtaatataggataaatctaagaatccaccctgtttgtcatgttagtttcatgttggtaatgattagtaaaaacttctttcttctccatgtctttctcttgttaaagaaaaacccacacactctctcttgctctctctcttacgcttgctcgcttcctttgtctgtctgtggaagctttggcttcgtctggcagcgggagaggtaaaggaaagcttctctaaagaagtggtaactaaggtgatatccagagtcttaattttgcaaagtgaaaaagaatattctgggcagagagaagagcatacgcactagccttaggcctagaggaaatacgttcttgaggaaatgttgctgctgtcctgagagggaggcagaatatagtgttggaggctgtaaattaggagaccaagaaaaagcagcctgagatactagaggaattcctggagaatgagtgtttgagagagtttccaaaaggatgagtattgtcacaaatgttaccaaaggaacaaatacaatgagaattgaaaaatgtcattagatttagaagcacaatagggctgtgggtaagattagcaagagcaattttgagggagtgatataagtgactaaagctagattacagtgggttcagagattaggaatctgacaaagttagcttgaagagggaaaagaaagattggtaactggagggatgtacagatttggggaaatcatttttaattgtaaaggcgtttatttgctctatgaagtaggaaatacattatctactgagtgaagggagaggctgaagtgagttagggtacagagtggaagaggaagtaaagtgaagagcccatttgaagttggtattcatgaatttttagtggaacatatctgccctatttcatgactttctccagtagggtttggtgacagagatatacgcttagataaaagagattgatccaggattgtttttgccagacagttgagtttaggcgtttagaaagaatgttaaaatgatgaactatggaatcaaagctcagtgagaggagaagtgaagaaagcgaaggactgattgactgcttaaaagcatatgtgaaaaagggatatagctgaatttgggagtaccatttaaaattgagatatagttcccgtatcataaaattcacgcttttaaagtatgcatttcagtggtttttagccttgtgcaactataaccaatgtctagttccagaacatttttgtcactcaaaaaaaatcctgtacccattaggagtcatttcccattccccccagccccatccccatcccctggcaaccactaatctattttctattatctattgatttgtctattctgtatatttcatagaagtggcattatataacatgtggcctttgtatctggcttctttgacttaatatgatgttccatccatgttgtagcatgtatgtagagacagggtctcactctgtcacccaggttggagtgcagtggtgtgatcataattcactgcagcctcaaactcccatgctcaagcggctctcttgcttcagctgccagagtagctggaattacaggtgcatgccaccatgcccagctaattttttaaatgttttgtagagttggggtctcactgtattgcccaggctggtctcaaactcctggcctcaagagacctttccacctcagcctcccaaagtgctgggattacaggcatgagccactgtgcctggccagtactttattcctttttgtgacacaataatattccagtttatagatctatcacgttttatgtatccattgataaattgatggatatttgggtagtttctactttttggctattatatgtaatgatgccataaaaaattctgtacaagttattgtatggacataagatttaatttctcttggatatatacctagaagtaaattgctgggtcatttgataactgtgtttagcattttgagcaactaccaaactgttttccaaagtggctgccccttttacattcccattagcaatgtatgagggctccagtttcttcacatccttaccaacacctgttattgtccatccttcagtaggtgtgtttgggtaacttttcaaaacttaagcagtaagcagaatttttttcttataaaatattagcattatgtagctcagactaaagaccccatgacttccaccatagtcagttcctataccttacctggaaagaacgttgttttgtttggtatggttttttaaagaattttttgaagttctcaatgtaggtggctttcaatatagcctccttacattaatccaactgttttcatataagcattataataaatatgattagttttttacttcccaacctataacagtagaatgtgacatttaaaaaaaattacaatatccattaataaagatgatactaagcaagaaaatgaactaaatgccttcagtaaaggtttattgtcctatatattaaatattatggctttaaaaataacagctattagtctccatgtaatgaaacattatcaataaaactaatattcctcttattcttagtgcctggctctctggctatgaaaatcctgtggtgtctcgaattaatatgagaatacaagatctaacaggactagatgtttccacagcagaggaattacaggtaggtaatcacattatccttaagtcatttttacacttcaggagatgcttgagaggagatttcctgacactgaacaggcagtcctcaatttgcatgatagtttgggaccttaaaaagtgaccctgtaagctgcaaccatgcaaagtgattttaataatgggaaaaattgtgattgttctgtgacttttaaatttcttgtcaaaacatgaaaactcttatctagggaaatgaaaaatatagatcactaatacttactaagtacactgtaattttttttctatcccccaggcctcactttgcctgtcaagtggccagggtgggttttaaaaaatagtgggtttttttcctttttatttatttatttttaagcaaacagttttcctttatttgtaatagtgaaacataggacttttttcatcacttctctttttctgttacttttatgtctataaatcatttgtcatcaaaagtagctgtcccaaaataattcttcttcactccgtcataatcacaacttgactcaaaatatctgtagtaaacaggtatatataggaatgttagttatagggaataaacataaaatccatgtataataatctcacttggtttcaatagtaaaaaaaaaaaactaagcataggcctataaaccagagaaaagaaacagcttagtcttcccctttgtcagcgttatttactattccttagtcttttcctgtagaaaaatactttttaaaatatttgagttcccttttctgtattagattttttttttgaagttatcaaaatgtgcactaaaaaaaccaatgcctttattttagcctttctggttgcaattttttttttttttttttttttgagatggagtctgagtctggctctgtggcccaagctggagtgcagtgacatgatctcgactcactacaacccctgtctcctggttcaagcgattctcctgcctcagcctcccaagtagctgggattacaggcatgcgccaccacactgagctaattttgtatttttagtagagacggggtttcaccatgttggccaggctgctcttgaactcctgacctcaagtgatccacctgccttggcctcccaaagtgctgggattacacaggcgtgaggcactgtgcctggcctggttgcaaaattctaagacagatgcagtcaatatgcagctcataaattcattagaaaggtgatacttttgcttcttttcaacctttctttttctttttgagacagtctcactggagtgcagtggtgcaatcttggatcagtgcgacctctgcttcctgggctcaagtgattctcctgcctcagcctcccaggtagctgggaccacaggcacatgccgccacggctagctaatttttgtatttttagtagagatggggtttcaccatgttggccaggctggtccttgaactcctggcctcaagtgatctgcctgccttggcctcccaaagtgttgggattacaggcatgagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacactatgttgaataggagtggtgagggagggtatccttgtcttgtgccggatttcaaacagtgcttccagtttttgcccattcagtatgatattggctgtgggtttgtcataaatagctcttattattttgagatatgttccatcaatacctagtttaccgcattttcagcatgaagggctgttgaattttgtcaaaggccttttctgcatctattgagataatcatgtggtttttgtcattggttctgtttatgtgatggattacgtttattgatttgtgtatgttgaaccagccttgcatcccagggatgaagctgacttgattgtggtggataagctttttgatgtgctgctggattcggttggatttttgcgtcgatgttcatcagcgatattggcctaaaattctctttttttgttgtgtctctgccaggctttggtatcaggatgatactggcctcataaaatgagttagggaggattccctctttttctgttgattggaatagtttcagaaggaatggtaccagctcctcttagtacctctgatagaattcggctgtgaatccatctggtcctgaactttttttagttggtaggctgttattgcctcaatttcagagtctgttatttttctattcagagattcaacttcttcctggtttggtcttgggtgtatgtgtccaggaatttatccatttcttctagattttctagtttatttgcatagaggtgtttatagtattctctgatggtagtttgtatttcctgtgggatctgtggtgatatcccctttatcattttttactgtgtctatttgattattctctcttttcttctttattagtcttgctagctgtctatcaattttgttgatcttttcaaaaaaccagctcctggattcattgattttttgaagggttttttatgtctgtatctctttcagttctgctttgatctgagttatttcttgccttctgctagcttttgaatttgtttgctcttgcttctcttgttcttttaattgtgatgttagggtgtcgattttaggtctttcttgctttctcttgtgggcatttagtgctataaattttcctctacactgctttaaatgtgtcccagagattctggtacgttgtgtctttgttctcattggtttcaaagaacatgtttatttctgccttcatttcgttatttacccagtagtcattcaggagcaggttgttcagtttccatgtagttgtgtggttttgagtgagtttcttaatcctgagttctaatttgattgcactgtggtctgagagacagtttgttgtgatttctgttcttttacatttgctgaggagtgctttacttccaattatgtggtcagttttagaataagtgtgatgtggtgctgagaagaatgtatattctgttgatttggggtggacagagttctgtagatgtctattataatggtctgcttagtgcagagctgagttccagtcctggatattcttgttaaccttctgtcttgttgatctcatattgacagtggagtgttaaagtctctcattattattgtgtgagagtctaagtctctttttaggactctaaggacttgccttatgaatctgggtgcccctgtattgggtgcatatatatttagaatagttagcacttcttgttgaattgatccctataccattacgtaatggccttctttgtctcttttgatctgtgttggtttaaagtctgtttgatcagagactaggattgcagccgctgcttttttttttttttttctttccatttgcttcgtagatcttcctccatccctttattttgagcctatgtgtgtctctgcacatgagatgtgtctcctgatgggtcttgactctttatccaatttgccagtctgtgccttttcattgggacatttagcccatttacatttaaggctaatattgttatatgtgaatttgatcctgtcattatgatgttcgctggttattttgctcgttaattgatgcggtttcttcatagcatcgatggtctttataatttggcatgtttttgcagtggctggtaccagttgttcctttccatgtttagtgcttccttcaggagctcttgtaagacaggcctggtggtgacaaaatctctcagcatttgcttgtctgcaaaggattttatttctcctttatttagaaagcttagtttggctggatatgaaattctgggttgaaaattcttttttttaagaatgttgaatattggcccccactctcttcttgcttgtagggtttctgcagagagatccactgttagtctgatgggcctccctttgtgggtaacccgacctttctctctggctgcccttaagattttttccttcatttcagccttggtgaatctgacaattacgtgtcttgtggttgctcttctcgagaagtatctttgtggtgttctctgtatttctgaatttgactgttggcctgccttgctaggttggggaaattctcctggataatttcctgaatagtgtttttcagcctgtttccattctccccgtcactttcaggtgtacaccaatcaaacatagatttggtctttttagatagtcccatatttcttggaggctttatttgtttctttctactcatttttctctaaacttgtcttcttgctttatttcattaattccatcttcaatcactgataccctttgttccacttgatcaaatcggctaccgaagcttgtgcatgcaccatgacgttcttatgccatggttttcagctccatcaggtcattcaaggtcttctctacactgtttgttctagttagccattcgtctaaccttttttcaagggttttagcttccttgcgatggcttagaacatgcttctttagctgggaggtttgttattaccgaccttctgaagcctacttctgtcagctcatcaaagtcattctctgtccagctttgttctgttgcttgtgaggagctgcagtcctttggaggagaggaggtgctctgatctttagaagtttcagcttttctgctctggtttctccccatctttgtggttttgtctacctttggccttcgatgttggtgacctacagatggggttttggtgtagatgacctttttgttgatgttgatgctattcctttctgttagttttccttctaacagtcaggtccctcagctgcaggtctgttggagtttgctggaggtccattccagacgctgtttgcctgggtatcaccagcagaggatgcagaacagcaaatattgctgcctgatccttcctctggaagcttcatcccagaggggcacccgcctgtatgaggtgtctgtcggcccctactgggaggtttcccccagttaggctacacgggggtcagggaccctcttgaggaggcagtctttggttctcagagctcaaatgccatcctgggagaaccactgctctcttcagagctgtcagacagggacgtttaagtctgcagaagttgtctgctggcttttgttcagctatgccctgcccacagaggtggagtctacagaggcagtaggccttgctgagctgtggtgggctccgcccagtttgagctttctggccattttgtttacctaatcaagcctcagcaatggtggacacccctcctccagccaggctgcaacctctcaggtccatctcagactgctgcactagcagtgagcaaggctccatgggcatgggacccactgagccaggcacaggaaagaatctcctggtctgccagttgctaagactgtgggaaaagcgcagtatgtgggcaggattgtccggtttttccaggtacagtctgtcatggcttccctttgctaggaaagggaaattccctgactccttgtgcttcctgggtgaggcgatgccccgccctgctttggctcattctctatggtctgcacccactgtccaaccagtcccaatgagatgaaccaggtacctcagttggaaatgcagaaatcccacatgtgagtgagaacatgtgatatttgtctatgctgggcttattttactaatataatgaactccagttccatccatgtgataagattacattcttcttatggctgaatagtgtttcattatatataagcaccacattttctttatccattcatctgttgatggacacttaggttgattccatatgttagctgttgtgaatagtcctgcaataaacatgggaatgcggatatctcttcatcatgctaatttcctttcttttggatatatacttggcactgggattgctggatcatatggtagatctatttttagtttttaagggaacctctgtactgttctccatagtgattgtactaatttacattcccaccagcagtgtatgagcatgcccctttctcttcatccttgccagtgtctgttatttttgggtttttttgtttgttttttcttgagatgtagtcttactctcttgcccaggctggagtgcagtggtgtgatcttggctcactgcaacctccacctcctgggttaatgcagttctcctgcctcagcctcctgtgtaactgggattacaggcccctgccaccatgcccagctaatttttatatttttagtagagacagggttttaccatgttggccaggctggtctcgtactcctgacctcaggtgatccatccactttggcctcccaaagtgctggaattacaggtgtgagccactgtgcctggccaggatgctgaatttttttgaaagctttttctgcatttgcagagatgatcatatggtttttaattctgtttatgtggtgaattacatttattgaaccaaccttgcaccccacaaataaagcctaattgattatagtaaattaactttttgatgtgctgctaggttttgttttctagtatttttttgagtattttgtgtctgtgttcatcaggaatatcagcctgaagttttcttttttcattatgtctgtgatgagttttggtatcagaatgatgatgctggcttcataaaatgagttaaggaaagattcgttctcaatcttttggaataatttcagtaggattgatactagctctttgtatgtctggtaaaattcagctgtgaatccatccagtccagagctttttttggttagtaggttgtttttttgtttttttgtttttaattaaaattgaatttcaatttcagaattccttattggtctgttcagggtttcagtttttttctgtttcagtcttgggaggttgtgtgtttccaggaatttatccatttcttctaggttttttataaaagtttgtgtgcatagaggtgttcataataatctctgaggactttttatatttctttggggtcagttgtaatgtcacctttgttatttctgattgtgcttatttggatcttttttctttgttaatctagctatcttgctgtttctagaattctttatttgtctttgatgtttgacaatctgactgaaatgtgcttcagaggggactttttttggttgaatctatttggggacttttgaacttcctggagttggatacccttatctcttccccagacttgggtagttttcagctattattaaataggttttctgtgccttttacctttcttctccttttggaactcctgtaatacaaatgtttaatggtgtcccagaagtcttgtaggctctctttatcctttttcattattgtttcctttttttttcccctctgagtaatattaaataatgtatcttcaggttcagagattgttttgcttaatcaagtgtgctggtgcagctttgtattgtatttttaatttcattcattgaattctttttttttttttttttctgagacagagtctcgctctgtcgccacgctggagtgcagtggcaagatcttggctcactgcaacctccgcctcccaggttcaagcgattctcctgcctcagcctcctgcattcattgaattcttcagctgcaagtgttttgtttggttcttttttatgatatctttctttgttgaaattctgattcatatcatgaattgttttcctgatttcattgaattatctatctgtattttcttttatctgtttgagtttccttaagatcattatttgaatttttttctagctaggtgttgatttcctttacatttgggcctgtaactagagagttacattctcagcagtgtcatatttcattgctttttaatgtttcttgtttcctgcattgatgtctgtgcatctagtggaacaattggctcttttaaactttccgcttctgttgggctgtttgggaagggtgtggtgactctgtttccaggtaggttcagtactgtagtctcttatagcctattcagctgcattcattgtcagaataactgtgggtgcctcaacagcctaggctggagaagtttgcagtggtggtagctgtggagtagattgttaatatcttcagtggcaagagcttttggaatccttccattcttgttttccccacaatagggagttttagccagtgggagtcttcttggtggcaggtcttacatatcctacaagcagctgccatggtgctgcaatccaggtgcaagcgtttggagtggctatggggctaggatcctgggctcagggtcttgcatactattgtaacacctgggtgttagggtacagggtcactattggcagggttggatgtaggttgcctatagtgccaggatctgtgactctgaggcaccctctagctgcttgggaaaagagtgtcaggttgtagctgtgagtctacccctggtggacagggcacagccctggcccaactccagggaagagaggatgctctggaggtttgagtctgggatgcagggtttggctctattaggagcctgagccaatagggcttagtggcaactcctatccctggggatgaggcaccatgatgaggtgccctggatgaggcaccaggttctagtagtcactctagaacctggattggtggagctcagatggatcccagactctgaggccaggtacagcaggaacaggcacccctgaatggccaagcatgcctgttgtttgggccctgtggggcagagagcagcacagcaatgacttcactccctagaaagagaagtgtctcagcagcgcagactctccagggaagcagggtactagagttatttgccctgcagggcacatttctcagcttagccactgctctgtttccctgggtctctgggtactacttcagccctgggatgtgcagctgctcagcttggccagtgcaacaattccccaagggtgatgtgctgtttcagctcaggctcaggggacgtgactgttctgggtggcccagacatctcatgggatgcagggttctgccaaagtactattttcttgggagggagtacatggctgcagctcctgcctcagggagttgggggaggggtgggtagagcagttccacctctcttgaccccaccaggaagggtgtaacagctgctggcagctctgcttgggaatgtcaggccttcaagtaggccttcattcctggcttagcttcagggatgaaggggtgctgtggctactggccccagagcaagacacactccagcagttccagttccaccagtattctccttctggtttcatcagcagcactcttaattatgttctcctttgattttgtcagcattttattgtgttgtgtgattgagggaaagagttaagtatcattctcttcactttaacaaataagaaaactgagatgatatccaaagttacattgtaattaagagagctggaacttgaactcagaccaaatatttttcttaaattttggtgcgtcacactgggacattgtcgtaagcaactgaagttgttagggcccttcgacaggaataattaaattggtgttaatttctttccttttttagcagggaaaaaatatgtaagaaaagatattttattaaagtggattgcgagttcagcatttggggctttggaaaacattttttgatttaagttccaaaggaaagtgtttagtgaaacaaaataatagaaatctcaaattttagcttatgtattaaatttttaaaaattagctgggtgtggtagcatgcacctgtagtcccagctactcaggaggctgaagtgggaggatcacttgtgccccaaaggttgaggctgcagtgtgctctgattgcatcactgcactccagcctgtctctggtggggggtggggaggggtacatatgtagatatagatctatatatatagatatctatatatgtagatctgtatagagatatagatatctatatatacatctgtagatatagatatctatatatacatctgtagatatagatatctatatatacatctgtagatatagatatctatatatacatctgtagatatagatatctatatatacatctgtagatatagatatctatatatacatctgtagatatagatctgtacatagatatatagtagctgtcctttgtttttcatccctgttttcataggaactcttgttgattttaaatatttttcatttctctgtaaatacctgaccatgatctataaaagtccaaaaaatgaggttcatagattttttttgaatagtaatctttatagttcttttctttcatgctttgtgtctttccttcaggtagcaaattatggagttggaggacagtatgaaccccattttgactttgcacgggtaagtgaaaaagaaatggagaaattcactgaggcttatgcattacattgtttgtctcaaaacaaaacaaaaaaacagtctcactctgtcacccaggctggagtgcagtagcacgatcttggctcactgcaacctctgcctcctgggttggagcaattctcctacctcagcctcccgagtagctgggatcacaggcatgcgccaccatgcccagctaatttttgtatttttagtagcgacagggtttcgccattttggccaggctggtcttgaacttctgacctcaggtgatccacccacctcagcctcccagagtgctgggattacaggcgtgagccactgtgcccggccgcattacattgttaaagaaaaagttattcttgacacttgttaaagatggtaaggcagacttcattcaaggggggaccattgcgataggtatagggaccactgcaaatgcagtgggattttgcagtaagggagagaggttaagcccaattccaaatacaacaaggaaaagtgggaatttatagccaatgagcaagggtgggtgttagtagatggaaaattactaagaggtaagggaagattctggctaaactgacctaacaggattcttgctgaagtcagggaagagtgatcatcatccaggggatagtggaagatgaagaacccagttaggttttgagggtgatcacatggcaaggacggggaattctggctaacctgacttagcagggttcttgcttaaattggacaatgcagaggtaaataccagaagcccaaagtcagggcctacttgagaagaaagttcagaggagcctgagtagttgggtcaaggagagattctttgtcaacatgttaattctgttattttaacattaaaaattcatagcctatttggaatttatggaaatacggtgtggcagatattctgtgaaacctttttaccagttaaaaaaaaaaaaccaaacacctagatacccaataaaatcacttaagatactttaaatgcattggcaagcctggaagaaagtaaagggtgttccaaaaggcaaactgaacaatgatcccaaacttagagaattaaagaggggacaaaacacagaggctggaggtatgtgcctccaggaactagagctttgggaataacagctctgtaagaggaggatctgccacagtgtaggctgctgaatttgagaccctggcataaactctaaatctccacaaggattacaccttcagtaaagaaagaatgggtttgaaaataaatctcttgtgatacaggagccttatggggaactgtctgtttccatcctggctggggcatagtgtgtatgataggggagctacttcagggagtactatgtatggaattttccacttgtgtcatgttagcactaaaagttttgaacttcagagcattttgcattttggacttttggtatgctcaacctgtattccatgttacggatataccacagtttagccattcacccatcgaaggacatttggatagtttttagtttttggctattacaaataaagatgtgtttacatttctatgtgaaaaatgcattttcatttttctgggagaaatgccaagaggttgtattgtattttaatttagatataaatatttagatattaattctttagcttgattatagtgctgaaagtcactttactagcattattagaaaaataatactaggggccaggcgtggtggctcatgcctgtaatcccagcactttgggaggccaaggtgggtggatcacttgaggtcaggagttcaagaccagtctggccaacatggtgaaactccatctctactaaaaatacaaaaaaattagccaggcatggtggtacacgcctgtagccccagccacttgggaggctgaggcagaagaattgcttaaacccgggaggtggaggttgcaatgagctgagatcatggcactgcactccagcctgggcgacagggcaagactctgtctcaaaaaaaaaaaaaaagaaaaaagaaaataatactaggaaatatttcagtaggtcgtgagttcaaagtaagtctcaaggtaaattaagcttcaggagtatagctaagagatggctgtcaagtcatattttttagaagctaaaattgtgggtatttgtttttaaaataatatgtagcttgcagataatggctgtcgtttaggctaataagtctgctttttatccagtaatcttgtctaaagtatccagtatacaagttcagtcatcacgtatttgaggccaggtacagtggctcacacctgtgatcctagcattttgggaggctaaggcaggaggatcgcttgaggccaggagttcaagatcaccctggtccacatagcaagactccatcttacaaaaagattgcctgatgtttatagtgcactggacattacaagggaaacttttgcggttgttgttggcatattcttcaggatattactactgatgtttagttgccactagagtatttgtattactgaatttttacaccattgaatttactgtgtttttattcacagaaagatgagccagatgctttcaaagagctggggacaggaaatagaattgctacatggctgttttatgtaagtcgtcactaaaatttttagattaagttgggatttgatgacaagattcattttaatgttttaagtttgttctgtgtagctctgattcagcatcctagtttaacatttttacaactgaataaagtgagttaagaattattttgcacttgcaactttttcaggctataagatagatgttcattatagaaacttctggacaaacttagaatttatagtgccactacctgcagataatcattaatattttaacatatagtctctctgtttagtaatatataatatgtgtatataaaaatctctatatatttgaatttctatacatacacatacacattatttcagtaaacttctgaattacatttttttattgaagtatatcagaagagtgcgcaaattaagtattataacttaattttcacaaagtgaacacttctggtgtattcagtactaagatgaagaaatagcatattacaacccccagaaaccctatctcagagttttaaaacagtatgatcataattcaatttttaaaattgtttatatatttttatatatggaaaaaagttttgattgtagtgtttgttctagttaccccaaataaagcactccaaaactctcctttctgagtggtttaaaataacaacgattttcttaatgtatctctaacagttatgaggttgactgggctcaactcatggttcctgctccaaatctgacatgtatttgccgtcaaatgcctggcactggggtatcttgaaggctaaggttgaggctggctgtcagccagaatgcctaaagtctggccaatacatgtggctgagcttcttcacagcatagtgactggattgcaagaggaagcatcccaaaagaacaatgcaaaagtacatggtattgttatgacctaccctcagaagtcacagatgttaattttgctgtattctgttacagcaattacaaaggtctgcccagcttcaaggagagggcacacagaccctaccactgcagacgaatgtcagcgtcacataaaaagagcatgtaggatgggacatattgggatgtattatatttggaaaatgcaatctgccataatgtcataacctttgttaacttaaaaaagatattttaggccaggcacagtgacacacgcctgtaatcccaacactttgagaggccgaggcgggcagatcacttgaggtcaggagttcgagaccagcctggccaacgtggtgaaaccccttctccactataaatacaaaaattagctgggtgtggtggcacacacctgtagtaccagctactcaggaggctgaggcacgagaatcacttgaacctgggaggcagaggttgcagtgagccgagatcgcgccactgcactctccagcctggataacggagcgtggctccatctcaaaaaataaaaataaaaaaaatatatatattttatatgtagacttaattttggttatttcatcactttttccattccttagccctatttgaattacatctttttgttgtctgtagtatctcactccctaccaaaatctgtctgttcagtctatttcctttttctcttgctaccttccctgtttgttttctttcccttcttccctatctccttcctctccgtatgcctccttttctccccaattcccaatttgtatttctctcacaactccatcttgtttccaaaaggaggtaaggtacattacaaagattcatataaaaaaagagaaataccacaaagggaaaaccaggagagggttagtacggtatacaaattcatgctgcaaaggcttgcatattttctagaggtgagtcttagaggttgtaccagtttatatcccaattttaagtgggatatgtttgtgaagtatgtttgtcagactttttgatctatgtatatttcacttattaaattagcagttattgtggctttaatttgcatttctcttattagagaggttgagcatcttttcagatgtttaaaagccattagtgtttatgtgttcctggttctgcttatatttctttgttttatgaatattgatgctgtattatttggcccactatctgtttctccctcttaatgtaaacacccttcctgtttttctaaaatagttgtatagcattttaattgattatcattttttccgttatttaaataccattcccagaggggcacatagaatatctcaaattacttttcctctcatgcacaactttttaatttcctcagagtttaattttttcattggttaagtgttcttagttctttactattagttatgtatttatcattgtaaaataccttctatctcatttaatgctttttaccttgatttaaactgtatctcatactaagatcatatcctgttttccttggatagcatttgcccaaaatcttacatttttgtgttctgtgtttgtaagtcacttgttttagatgcagctctgatataatatgtagctgggttttgctctgtgatctaatcagtctatacattctacttatgttgctttaaaaaaatctttatgatccatgtttcctttgccttgttttttgtgattctttggttaatttaaaaggtttccatttttattctaggttatctttatgactataactttatataatcctttaactttctcacttttatttaatatgtttgattcccttccatgagaaatggcaaaactgagtatttttattttacatttatttaaatatttcttgagcacctactgttcttgaggtactattgttctagacattaatgatcagcaatgaacaaaacagatgaaaattcctgcctccatggagattacattctaatacaataaaatacatatttatatctgtgtattgactcattagttttaagtcattactttttccctctggctataaataagttcctatctcaaattatatccccagtcttccatcctgatagttttttgttattcattcctttgctttttgtagtttttttacttatgtatataaacctaaatggcattttatttttgaaaaactgagtagcatgtaccaaccatgctatataagaacaagtccatatgttcccaatattctagtatccaatatcaagtctatataatggcatgttttactttattctaccagcacttttgataacaccctcttgtttcttatagatgagtgatgtgtctgcaggaggagccactgtttttcctgaagttggagctagtgtttggcccaaaaaagtaagcctgtttgttttgtttttggtttattaattttttccctaaggaagagatgcacttgtattcatggtctaattaatgaattacatttttttttctttttcattttttgagacctgttctcgctctgttgcccaggctggagcccagcagtataaacatggctcactgcagctttgacctcctgggttcaagcctcagcctcccaaatagtggggactacaggtgcatgtcaccatgcccagctaatgtttaaattttttgtagagacagtgtctccctgtattgcccaggctggtcttgaactcttgggctcaagtgatcctcccacctcagcttcccaaaatgttgggattacaggcatgaacccctgtgcctgaccaaattacatttttaaaggtatttttatggtccttgccacgagtacttagaggtaatgaatgaccaggaattagtatttaaaatttttcatttctaaaatgggttctgcattgtgttttcccctccatcttgctatgtaagatatgttagctttcttttggcaaatacttttgttgtcaaacatttttatggtatttttcatatgatcaaaaacggttcttaaagtgatataaccatattttcagaattatattagaggaaaataaaatactgctatagagttcttccgcaggaacaaagggaaaattactgctgaaaacggccgggcacggtggctcacgtctgtaatcccagcactttgggaggccaagatgggcggatcatctgaggttaggagttcgagaccagcctgaccaacatggtgaaagcccgtctctactaaaaatacaaaattagccaggcctggtgttgcacgcctgtaatcccagctatttgagacgctgaggcaggagaatcacttcaacctgggaggtggaggttgcagtgagctgagatcgtgccattgcactccagcctgggcgatagagcaagactctgtctcaaaaaaaaaaaaaaagtaataactaccgaaagcaattacctggcattgtatacttggggataattgtgaattgttctccatagggaactgctgttttctggtataatctgtttgccagtggagaaggagattatagtacacggcatgcagcctgtccagtgctagttggcaacaaatggggtaaatatttcatatattctgcgaagataatgtaatttttgtttcttattttggaactattatctgtgtcttaaaaacaaaagcccccatgtttgcttaatatgattttaacattgtacaggattcagccaaacaagtgcctaatcataatacaaatttgaaatcagaattttgatgacagattttatttttaactatttttacttattccaagaaacaatgactgactcaaaattgaataagacaatatcttcccctcaaagggttaataatctgattgagacatactaatggattataatgtagtacatattaatacaaaaatgtaaacagaagatggtgactgcctaagtttggggagtcttcttcaaagctttttctttaaatttggtcctgaagatagaacagcagttttccaaacatgttagataccaggttctaatgtgaggctcgagtagcacctaatgtgcaaaatttaaagaggcactcactctcagtcagggacatgcaagtgcaggaccacatttttaaaaagtaaaaagaaacaggtaaaattagttttaatatctattaattagccccatgtatccatttcaatctgtgttactagccacatgttgagtggttacatacaggacattacaaggttaaggagtgaggcctgatcaggattttaaaatctccccttatgattatagtgtttaagaaccactggactagaatgaggagaggctagttggtgagagagagtttagaaagctgttttctgttgtctaagtgggagatgataatggcctggattaaagcatcagtgaaagggttggagagcaaatagatttgagagagatgtaaggaaaattgtcagggtttgatgaataaagtgtagatacaagggttgaagaaggaaaaagagttaagaattaaggttcctgctttagatattttgactgggttctatggtaccagagacaaaaaaaaaatagaaaattaactgcttttgggatacatttttacatggtatacattttttaaaggtattttggaaacttgatgagcatacaatagcaatggttgataagagagttgttcctttagagtgcaaagtttgtgttcattattgtctttgtattttggaggctgtactttgaaaacaatacataaagcaatattctactcttacctgtacctgtatcttaggtccatttgtgtctcatttcaagcctcacattgaacattggaaactgtaagaaatgcacatagactggcaaatatacatgtgtatacatacatgtatgtacatacacgcacacaagtgtgtacacatatgtatataggtatataaaatctgtgttttcagcatttagccaagtttttaagtagcatctgcctttatccggttttggtgttgaacttttatcccatgatgaaactttgttatagacctagcttttagaaactaattaaatactgattagattaagggggaaaattaatatattacttttctctcacagtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaatgtttgttttctgtgtggtgtttttcgtatttaaatccgaatgtatgatgtggcagtaacaggttaacttatgtaatttctttagtacatagggcttaggtttatactcttggtttccactcacactaatgtcacatggttaagaaaaacttaggctctctgaagtttcagatatttcatgaatcaagatgtgcttccttcaaagagagctctaaaatactttactgtggttatgaagttattatgggccaggcatggtggctcacgccttcaatcccagcactttgggaggccgaggcaggcggatcacctgaggctaggagttcgagaccagcctggccaacatggtgaaaccccatccctactaaaattaccaaaattagccgggtgtggtggtgcatgcctgtagtcccagctacttgggaggctgaggcaggaaaatcgcttgaacctgggaggcagaggttgcagtgagctgagattgcaccactgcactctagcttgagtgacagagtgactctgtctcaaaaaagaaaaaaattattacaatagtggtacttaagactttctcctattaagaaatatgatgctctttcctaagtggcctgaggtaatctgaaaatggttcgctattcacttgacccggagaaccccacaaaatcatgcaaatcaagaggttccaatcttcgtgttcactttaagaacactcgtgaaactgctcaggccatcaagggtatgtatatacaaaaaggcacgaagtatctgaaagatgtcactttacagaaacagtgcataccattccgacattacaatggtggagttggcaggtgtgcgcaggcaaagcagtggggctggatcttctaagttgatttttttcctcccaagtcctttttaaagaaagtatactgtattttaccaaccccctcttttctcttagctcttctgtggtgaattaaacctacttgagttaaaatatttcgggttttttttttttttttttttttttttttttaacaaagtcctgcataacaacactgggccttcttaactaaaatgctcaccacttagcctgtttgggccacaaggtcggtggcccaaaaagagtgctgaatttttgctgcacgtgcttaaaaacacagagagtaatgctgaacttaagggtagattctctggtcattgagcatatccaagtgaacaaagcacctaagatgcaccaacggacttacagagctcatggattaacccatacatgagctcttcctgccacattgagatgatctttactgaaaaggaacagattgttcctaaaccagaagaggaggttgcccagaagaaaaagatatcccagaagaaactgaagaaacaaaaacttatggcacgggaataaattcagcattaaaataaatgtaattaaaaggaaaaaaaaagaaatatggtgtggtaatagctgtgagcttaatgaagtaagttaattgatgctttagactatttacattacttatggtgaatcctagttcacacaagagttctttatactttatgcagtatttaaatactgaaggaagaatttggtttgattctctgggaaagtaggtatttttacccacttttaagtgaactctgaagctcctttcttctgactagcctttgttccaatataagtgttttagaaatatggagaattaagttcagcactttgatccactcagattttgtgaccattgatgatttttaaaaaaattttttagtaaagtggatggaagcagaaaattcaaaaatgtagacataatataggggttcaaagaatggaaaatactgtttattgccatgtgtgttatagaaagtagaatacaagtgtctttcagaaggaaattacgtattccataatcttacaaatttcattatattcaacttggaaccccacgtgggaattattaaactctttcagaattagatcatacagaaccctttaaagttttataattaccaatga

SEQ ID NO: 12944 - DNA, 56131 bp, Human
ccagagaatgcaagggagtgggggaagtgagggaaaagagaaagccaataagggtatattaatgagcaaatccccatggtgggcaactggggctcagtcctgctggggacctctgggaaactgtagatcacacctcagaatattccgaccacaggatgaggaagtggggacatctatcactcaacttccattcccattggttgaggcttatccctaggggtgttgtttcccggcacttatgagttatgtctcctgcttttggatgatgtgcagagtcccagtgtagagaaaaagagagaggtgtgaagctgacagtatactggaagctgcctacaactacagaactcaggtggacagaagtgatactgagaaaggcattgactgtctgccacacccctcttggcttaaactggttccctttgggttactgtgacttatgaccaacagagccctggttatgcagctcactttagtttttcccacagaggcagccacactcatattgggccagccctgtgtacaaggcatttctgccaggagcagtttcctcaacatatacaccatcagtggctactgaggggccaccggggcaaaaggactgtggcagaaagtgtggtctaacttcaggacaaggggccaaaaatggctcattgttggtccatggagtgatgccatcatttgtctggtgaagagctctgaacacacagaagtagccaaaaacctggagaaatattaaggtgctcactatattctcttctccagtgtataaataactcacttttggcaccatgtgatctcaaaggatgatgtctaaactgaattttaaagatacaattcttttgaacaacacctaaacagaagttaatggtgaaccccaatctaaaatgaaccacaattatctgttgacctcctaaactcccagaaagttggttttccttctacagttctgaaaaaagcccaactacttccatctggaatgcattcagctacagggaacagaagcctgatgtctagggctcctacaaattggagctgcttcttttcctcatgtaacaagaagactggtaagcgatggttgctggtaatatagttcagtggcttgaccatgctgtcaagaactcagacatggagctcacttccacagtggatggattttaagtctctccactctgtttaatacttctactgaagtacagctctgggtaaaggtaatttcagagagtggagaggttaaaaaaattaaaagtggtgttaaaaatagtgagcatgtatcttaggatttggaagttttctgtttaaaaaatgttttgccttgtacctgctcctgacccttgccatatttaaaatagacatttcttctttgttctgttgtctcacgtactctaaggtcaaaatctttgtcaccagtagaggcagtagagcagagtgggcagggctgtaggccctggaacctcaccagcctgtcaatcttggaccatttttgacctacaaaaagggcaatgtcatatagttcaacttactaggataattatcatcatttggtgactatttgttgagtacttattattaagtaactttaacagctcccaagtgaccaagctaggattcaaaccctgtttaatgtcagtacccctgctgagaggcatggtaccatgctgacaccccccaatttttattgaatactcatcttctggcatccaggtaataaagctaaagatagactttccttacttttcgaactttgctatacccactcagaatatatgagaaaatgcagccagcatcttctggaagattaggagggcaagtaagataccatagccacctcccggctgacatttgagcctgctttccgcacggtcaagcctttcggaggcagccagcgtatggcttgtatcaaactctatatttaggaagaacaactgtgagctatgacaggaattctctttaacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcaggtaagcagaaggacgcagctccggcgactgggttttctaaaggaaatttccttgatacctaactcgaagtgactacttttaactttgtaggcttgtaaccagtgggtgtagcttccttgtaaattcatttttcattggtggtattgctgattctgtttataaattgtgaggggtgagggtgctgaaagaatattgaactaggcaaatactgaaaggcagttttcatcgatagtggcaacaataaaatgtccacagtctagaaatgataactgtgaccttgaagctgtgctggccaggattacagtcggtcagctgcagattgattgaagccctaagccaagaaatcatcagaatttgggccagagagaagctataatgctagttcctttatttaccaaaatgcaaattattgccagagtttttatacagtacaagtttaaaatgattttctcctctccctaagcaccaggcttggtctcaatgataacgttctatcaatgatagaaccatctttttaaatcttcactttggtcacagtattcccatactcagcagggtagagggcagcactcactgtccctttctatgtgggcaccaggttctgaagtatgagaacgctaagagtacctctttcctctcagcatatttaaagcagagtgaataaggagttagtcagttcagacagctgaacatctttctacacccttctcaggaattatttttagctgcaggacagaagataattccctttgcgatggagctttacccacttattcgacctttaaaaagaacaaacaaagctcttatctctgaatagtgattgattttcctctgaatcccttcttattaaatgagtgatattactattgacaaatttttagtaagtcaaagagttctatttagaagtcagatattaggtgctgcccaatcaaagacaagcagggatatatcataggtgactcagcatacagaccattaatggtccccactgacttacagaactgccaggaaaactcagcggtgcttagctggcaagcattttcattatactataggctttgtaaaagtcaatatatgccttgtcaaactttccatgtttcaaaactgtagccagaaccaggagacgtagtaattgagtgctgtaaagagtacctctttggacgaaaagcagtggccctggtgggagtggagtgtgtatctaaggtgtagttttcttttcttggtcccgggatgaagcattcagatgaagaaggaaggtgtgttccgcactctacatccctgatagaggtgactgcaggggcagggaaacagggaacactgtctatttttattcatcagtatgctttgccctgatttctctgaaaataatgaggacagcaggaaccgctgctgaactgatttacacaaatgttatccagcctgtttgtgaggaatgagagttgggatctgaccagctttctatagatctctctttcaaagattgacatgcatgttaagagatttgtatgcaaatcagaatctaccaaaaatacaggagacgaggcccatccattcttgaggctcagaggttcacacaaaaacagcaatccagtagtaagttaaatcagtccattgaaaatataaaattggtttttaaaaaaatacagtataacaatcattcattgactaattttaaaaaacatttcaacttgctattgtcataacataaagaaattttctaatccctgtttcaaattgatgtacaataatttttttaacaagttcccaagtgatattaaactttagttgtacacacacagagaataccatatgctgagatatttaaagttctgtgaaaattattgctttgtatgacttctaacagcttttgaagaataaaaacgttaaaaattaagccacgaagcttttctttttggaattaagctgtatgtcctagatccacaaattaaaaatccttcatttctttatgacactgcaggaaagacagcaatctatttgaaacatatcacagagaaaaatgtatccttgactgttccatttgttattgctttttaattttgtaaccgtattaaaaataattctacctagacccttatgcatggaggctaaatctatatgttacaaagacattcaagtgaaactctttaaaaagagtcctattgttttcatgtatgtggctccaaaaactatatatttggataccctgagtatagaggtttttaaaaaatatggaattgtttaacttcacataatagagcctaagactttagagatttcaaaagacttatttttcacagagttcttttcagatcttttatctctacaggtgttggggaacatacctatataaattattactctgaacttaaagctggagatgagtacagcactccaaggtcattagctatggacgatggtagtaaacaatgaatatttgcatcatgctttacagttcacaaggccttttcaggagcatgtatgtaatatggattcttaccacaacctgtgaagcaggtaaaatttaaagaagaggaaatgggcttagaaatattgagtgacattgcccaggttacacaagatgtgtggcaaatgccaacactgctttttgcattcttttactcaccagtggacacaccacttacaccagtcaatagacctcaatcaacctgttgtacagtttgggtttaaaacacagcatgttttgaattcaatgaatttttaatttttcaattggtcctgctgacatttaataggcctagctacaaaaacaggccagagctagaccattctcttctcccctatccccagtaaattgcatcccgcatcccctaatgtgctctagtcactgtgttctaagtcaggtctcacatgcttaaagaaagcaaaagtcttttgggaaggaagcacttctacatctcgaggatttgttatggtcatgtgtaaatcttccttgcctccttgaaagaaaagtatacaggcgagacttgctgtctgcccgtgtttacagagcctgggctctgtatgaggcaacttatcaaaagcattgggtaggggcacacagagcaggagatgggacctacgtcctcagagcatctcccaggttgctgggcagaacagacactgcacagcaagtagagagcatcgcagccgttaaggaagtggtacaggccatttctttttgggtgttcaacaaagaggaggcactcccaatggactatagcaaccctggcaattatgaattcagatcaaaagttcagtttcaagccaagaacttcagaggcccggaacaaaggtgttttattcccacaacctctttgctttgctgctcttggcagaaggtcaggagggcaggaaaggagatgatagcacctttcaagtttctgattgtatatcattagcatcaggggcgaggcgtctcaccatttctcctcctgaatgatttatcctggtgctctagtgttccctcacccgaggcattaggaaggagagtgtcttcgtaactttggaaactgagactgaaagaatatatggccagtgaaaggggtgactgcccagttgaatcatgagttaaattctaatttatcaagactgaggatctgaatgctgccacctctaacagtttcttacttgtttttttagggataagactgcatgaatatgtcgaaacagccagtttccaatgttagagccatccaggtaagtagccctgcaacttcttgcctggttgcttaataagtcatatttctggcgattgttcactcctagctgatggtgaacttcaagaagaaaattaagttcttcataagatttgtaaggtacaattgagaaaggatataaaaccagttaggtacaactgagacaggagaagcaagctatttttgtttaattgttctgaattataagacaatcagtttataagtgagaattaaattatcttctaaaaaatttagtgtgtatgttttttgatatgttttggatgtgttcattgatagaggatatattcaattttatttttaatttccaattgatatgtgcacaaacagatgaatcacagtttgttgactcacgtgtttgaaatacatctttctttaaataatatccttttgtagttaagtgttcttcccagggcttgggtattcatctttgaaaattcatatgttattagttgtccatgtgccctcccagcaaacaaattccttggttgtttaaactgacttaagtgtcacccacaaaaagggaaggaggaagcaggcatttggaaacaaaaatacaattatgaaaataacttgcagtatttgtttttactcaatatttaatttgttatttctcttaagggccctgtatttgactctcaaatggcttccaccctgaaactctgggcacagtgctttattgtaaaattccatctttccatcaacatggaggctgtctgtgctttctccaaagggacttttttcttggacttttctgaatactgcaggtcatgtggcagttcctgaatattttaggcctgatgcaccatcacaacagaaacacaatcataaatggttgactgtgttgtggaggggtgtgcttgtggccaggttgcaaacacatcatcaaggggtttagaaatcctagcacacaccgctggtggaggtaggtggagggacagatctttacctgtcacgactaatacagatccttaaactgaaggggttcttaagtggcaggatgtagagcaacctctggaaacatgtcattgaacaaaccaccaaggaagggcctatgaatttggcaaggattccactctgcattgtcacatccagccttctggtgtctacctagtgagcctctgatttccctgacagtgttagcagaattatattttgtcttccagacctgtggacatccttgagcctttgaatcttctcttttacccagtgtagaagcagttagtagcatgggctctgaaactatattactagggtccttaatccatcctgtactggtgtaggatcatgggaaaattactctccctacttgacctctctgtgcctccatttccacatctgtaaaatggagataaaataatagtattcacttcctagggctacatgtataaaatgcttaaaacagcatagtaggccgggcgcggtggttcatgcctgtaatcccagcactttgggaggctgagatgggcagatcacgaggttgggagatcgagaccatcctggctaacacggtgaaaccctgtctctactaaaaatataaaaaattagccaggcattgtggcacacacctgtagtcccagctactcaggaggctgaggcaggagaatcgcttgaacctgggaggcggaggttgctgtgagccaagattgcgtcactgcactccagcctggacaacagagtgagtgagactctgtcttaaaaaaaaccaaaaaacaaacaaacaaacaaaaaaacagcatagcaagcacgcattgagtgtcaaccattattagaattattatcattcaggaatactttatgttaaagttgtgagaagtaatatcatttaatcactgcatttgaacctccagaagtgctaaacataaaaattcttttatttttgcaggatgcaaaaacagtcttctctcgggttgtcttttttccctcttccttttaaaactgaaagtgtgttggtttttcttccttaatggtccctggcctccctcaaatctacactgaaaattcactagtattttatttactaattttgaccttgatatatttttagatttgtaatattttaaaagctgctactgactgttctcagtagccgttattataccgcattacaaaaaatccatccattctgccgacaaaggcaatacagcggttccttatggatgtggtattgcctctttcgatctattttatgccacacaaaaggcccaatttaatgcaccttcaaatgaaatattatttcttgtgggtaaataggatcagcactatccgatattttcgtattatctttgcattaaccttaagtagggtacatgaaataaaatatgaacgtggttacaccgtacacaatggtttatagtagggacattatctaggttagtcttgtctggaacaaatagaagccctgattaataagggactctcctcattgtgtaaataccatttaaagctctgaaatgttctactccataccctctagtcacttatttttattaggattttatctccaattcagttcatttgttatttcctgagtgcataatatgtgccaggcactgtgctaagtgtagggtatatacaaagatgaattgatccctgatccctgagatgaattgatccctgatccctgtgtttgaggcactcaaggtctccagtacttgctagctgcatgactttgagaaagttatttagcctctttgtgcctcagtttcctcatctatcaagagaagaattagtaacagtctttatctcataggattactatgaaggttaaatgaatttaatgcgtgacaatactcagctcagtgcctggctcactgtaattgcttaataaatattagctattatcatcattcaccaccatcatcatctacttcaacagcttccaaagtgtgttccttggaatactagttttatgggatgttgttaattagattagaggctaatatagtttaatgtttgaaaatttttctcagagtccacaacttgctaatggcatcaagttatttccaagagggcagaaacatatgcaatgttttctaaacatattggacctattcagttactgtcttacaagatagtgttttgcagtgcgaacttctagaaacagtgacttagatttctagtttgtctggcttgggtgaatttaagttacttttgaccatagctctaacagtcaggcatttcaggagtcgagttaatgcacctccagacaacatggagtcaaatagttacaaatctctgcaatgttagttcacctttagtccacctttctgtaaaatggggacaatcatactatttaattgggttgttataatgaatagacaaaataatctatagtatacaaattccttaagagatgggccttctaagtatccaagtaatgcatggaatggccttggctttgtcttcaactggttccatctcctctgtgcaccagagtaagagggaggccagaactagaaccacccttaaaggaggtagacagtagtctttcacatccacactgaagaagagatggcttttgaattgtaaagggattctaatcctacacttctctttagttgtattagttaaatctctgccaggggcataaaaacatcctgaaagaatcagttgattctttcttagcccggggagggcctttgtcccctaagcagctgataaagttctatgccagaggttggcaaaccttttctataaaggaccagataataaatattttaggctttgcgtgtcgtttggtctgttcccactactcagctctgctgttgtaccacaaaagcagccataggcagtacataaatgaatgaatgtggctatgtcccaatgaaactttatttacaaaatcaggtggtggactggatttggcccgcggactatagattgccaactccggttctggtctctccaggctgcttcttacaaccccactgttggtgggaattgagctgcaatgaaggtaacatcagcactctctgcatattggatcctctccctcaaatgaaagaatttgacatgacaggtggtggggaaagctagaactgctgggaatctaatcccatcaatgatctgtttggtgactctctctaatgagaccaagtgacaccagccactggcagcatctgcctgtccttctttctcctgaacacacccactttgggaaccaccacaggcctccttagggccccaattcacacagagccaatcttctctggattgtcactgatcctttctctccaccgttaatgaaagtaagctgagtattatttgtcctctcccatgagatctgagaacttcatggctgaccaaaaaagagtcctgtgccccagtcttagctctacgacgtaaattcacccccctggtccttgtgatcttcaaagggaggggcttcagttaaatgacttctaagtctctgtccagcttgtaagtctgtgaacttcttgagaatatcttgtaaggtttattatcaggatgacaataatagtttcagtttattcaaggtttaccatatacctggcccagtgcagtgggatttccatggatcctaatgttaggtttggaaaagtgaagtaactcccccaggattatacaatttgtaagtaggatagtcaagccctaaaatcaattattcagtctgatccccaagcccatgtttggaagcactctgcaatgctgtctttacttactgttcccaccattggcacagagagtaaggctggaggagtgggtgtggaccatctcaaggataatcataagcaccaaggctacttgagaggcaattaccgttttatggatgctgcgtgcctcccttttaaagaactcaacctttagaaacagtgtcagcatttcagtgaagaagctgatagtctacactgattaaagtcaccttaagagtaagttggcttcgagttaaaagtacaaagtaaagagactcaatgataaacatggtcttgaaattcaaacaaccatggctagatcaacttaagccgtttgtaaaactaaatctaacttatcatacatttgaaaaaaattatatgaatcctgcatcattagtgagtatgtggcttcttagcatgggaagttttccattgctacccaatctatgtgtagaagagaatattctgatgctccatgtttcagtacttctttcccttccccactagttgtcattgttcttccactctccattatctagggcacaatgtggaagaagaaagcagtctccacggaagatgaaaatatttacagataggcattagagactcttaagtatttcctgtgtaggatttccagtttaaaaatgattccaaatatatgacaatcattggtatagaggaatagactatcaccatccattgttaatctgatagattgattaaagctaaaaatcataatgatcacacatgccttccttcaacattttatttaaatttaaaacattaaaaattaactttcatttgccatttgttttaatgtagatgcaaggccttttcgttgatcatggatctactgtttcttacataaaccactataatacattgtttatgatttccaatgctggtttcttttaagtgtattaagaactggaatgtaggagtcttactctcaagtgggttcagtattacctccagctaatgatcattgcggctctgcctagctctatatttgtgacacgaggcaaagcagacacatacttgcaaaaagatgtcattttttttatgttgacatccaaaagcacttcaggaatacaacctgcccccgactgattgtgcacattatcttaatagctgtacagtacattcttgaaatctgcttttccctggatgatgagattacaattgagtcattcaggaaattattgaagggaacaaaaaagtgttgagaacagagcaaaaataaaaacattttcaatatgaaacatcatgggtgaagaacagtggcaaagtagaagtttctcaaaattgtgttgtgtgggaaagttttccgtgttttgaatccactccatatttcaacaacccctaagcagttatgcattccagtgatatagaattttattttaaaataagttgactatattgtagtaggtagatatgtgtgtgtctctcattttacgttaatatatcaaacaagaatctcattttctaatccgttatgaaaaaacaaacctctttctgaagtcttctgtaaagatgctataaatctcaaaatgtcatatcttgctccgttcagagaatgactaagactatgagaataggaaagagcagaaagaaataatgcaaaatgcaaccctgtagaatttcctctgcccgtgctacagaagaatggcatgggggaggctatagattctggcaggagctgctggggtcctttgaaaagtaaagattgaatcagtagggggtcatctgaaacaaataatgcaatgggaggaaactccagaagcctctgaacttcagaaaactcacagtgggttcagaaaaggagagacagagtgcggacgaaaagggagggggagataagagaacaatggctgtggaaagcaaagttcaataggaattgtcagtacccagccggctggcagctctcagaatccaacccactggggaaagaagatgtcattccattgtaagccacacagaaaggggtgtggaggaaatattgtttccagaatcctctgggctcaaagcccggagccaagcaaagagaacaatacaaataattaagggagcagtggaattaatttacagggaattctttctacttttcttcacctagtgagatcaagtgtagtattaatttcacatcagataggtcttctatcagggaactgtatcctattccggcaaaagatgatctagtagattttttttccattcccaacttggaggatgtaacaaattatatatagcttaggaaagtgatgcaccaggtctgctgcatcagggacatatttttaaatctctaaaatgaataaacctcagggagggaaaagaaatacaaaggattgcattacaaaaggaaaaaaaagagactgcttcctttgcatttatatagaatctatagagagaaggaagcctatcctaatatcaactctaggtcattggtgttaaacattttctgtttgtttattatttcataaaagtttagcttgtattttaagcctattttgtgtagcaaatacactcaatttgtaggtagaaaaattagtcgctgagaaagtatttcatttgtgtttaaacacagagtaagtcagcgaaagagacaaaatatgacccaattttctggccaatggaataaaaaccaagaggtacaggtctacatatttttatcaaattcaaattataaggaatttttcttatggctataatttagcctatgacttgtcactcaaagattactgtcctacaattatgctaatgaaacatctctaatcgtcttgttaatagtataatgcatgccacaactgacaaagcacgcctcttatactcccttattggtgcacattatgatcgaatgttcgacatattttcaggctgctttggttcctgtcaatatctgctgtcaaaaaaaaaaaaaaaaaaaacccatttaagtttttctgatttcttgagtgatgcttttaaagaagaaaaagtgtcaagtcagtgagttaatggctcatttttcaatgtggcttttctttggtatctattatgaaattatccattttatctgctcgttttcaaagaccactctcaaagtgtaagtctccaatatcagagctgctttagagaattttagagctggttagagctatttttggccacgtgaaaagagctctttagagacgggtttgagagagtgagaaggtctgtccctgaagtcaggcagcttcaatttggaatcttgccttttcctggaactatatgtatgaccttgagagaattaacctctctgaggattcatttcttcatcagtaaaatgaagatgataatactaacctcaaaagtttgttgtgaggatgcaggtatttaaaccctccacctctgcctgctttgcattgtagatattcttacagtacttcatttgaaggaaggaagagttccctggttaagaggtttgaaaaccattgacacagcctaatattcatattacaaatggggacaatgagacccagagcaattgttactttttcaagcacagagaacttgtagcaactgctagcattaggctcttttcactattgttaagccacccgtgaaacatggagaggccacatgggggcgcatcactaaaattaatctccgaacaggaaaagtagtcatcttgtaacatgcccttcacaatattatattattctggatgacctttgcatgtccccttactaaaaactacaatctaccatagagcatatatacttgattaaatgagttaatttagcaatcaagtctttcagaaacaatatgataacttgagctcaccgttaggaagatgccccctgtagatgcttaataaatgggttggggtagggacaatttaactaaacttttaactggttaactttttcccaaatagtccgtatattgatttttcccctcttttatccaaactgtagtgatggaaatagtctattggtccaatatggattatcttctgtgagtattatttacactgtcttgatcttctttattcaggcccctatgatatttcatccaatctaagacactgtcaattgtaaaataccattattttacatcctgccaaaataaagcaaatgtgccaactaaaattgtaggacactattggttgtaagacacactctgaccagagatattaaaagagatgcatcttggaattcatgaagtatggctccatatttgccaccatataagacaaatctttctcctctcttatgccccctcctcctcccactcgatgccacctggtatttccattacacataaaaatagcatagaaagctcagccttaggtttttaaaatgcttttctctaaagttgtgctggatttatattttaacatatgcggtacatactgattaaaaatactccttggcttgttggtactaggaatggctccacaatgatgtacctctccggttacttcccacaaatactttggatctatttctttctgtggtatcagcattattctagtaaggatggggtgttttaaagcccctgggtaggaaaagtcacctcctgctcctgaagggagtacaacacagacctgccatgttgcatgaacatggacactggatgcttcctgtttcatagggttaagcattcccctggcaacagagcttgtacaaggcagttccaaatgggacttaccacacttcctaataacttcctttggtgtggtgccaaaatcatacaatccatgtcataagataaaaaaatattttgctccctttgttcaggcatcatttacatgcataacatcaaaacgaaatttcaacttttcaagcccacatatccaattactcataaggcaacactttatcttcaatggaaaaatattgtattctactttaaaatagtatttgatggttgttttatgtgagtgataatactggttgaggacatttttgatctgcattacatatattcaccttttgacatcaaataagtatgggcaaaattcaaatttatatattatctctccaagttcaaattacagtgtcaatatatccttacctaatttaatgtttagaggatgtcatgaaggtattttatgtttaccactgatggagattagtattttatcatcataagggagaagagtcaatggtggtgatacgaagggaacttggctttccaagcaccctctttactccttactgacccacacaagtacatgttgggaagaaggtagaagagtgtcaatttcagagactatggcaataaagtgcaggacattatggaaaggaggaagtagcttagggcgtgtaaatgtctcccctcccatgtggtaaatttgaagggaccggaaggagggctaaggtgtgggatgacttatgcagatgctctttcctccttgcctgtcattatgtgttccctccttatcccagagagagaaaaataatatgcacctcaggagggcaacagccagaacaaactgtcttcaaattctgccatccaacaggaaattgtaaaatcactgcacagacctaaggatgtgtaataaatgaaatctgtaataaatgtaatctgtaataaatggaagtcaaattttcctttgcatatttttatgctgtcattacagcaattttcctgagataaaaagctttgaagatgtacttttcagacgcatttttcttcacaacgattactgtctcagaatgtcattgcaatttcttactttttttgagctaaacctaccctgttttctcttttaggcaaatatcaatattccaatgggagcctttcggccaggagcaggtcaaccccccagaagaaaagaatgtactcctgaagtggaggaggtgaggaaaactcagctctcagaacacagcaatgtttttcccttctaaaatcctcaccagagggggcagaggctaggcaagggctggctatccaggacaagggagggggcaaatggctgtgtgtcaaggaataacatacagtatgtacatttttttagttgtcttgctcagtcagccctgaaacgcactgccttctcccttcccttcagccaaatttaagtactgtacctggcaccattacttgaaggtactgagtttaacttccagtctgttgattgactgattaactgattgtttgattgattgattgtgtgtatgcgtgtgtgtgtgtgcacgtgtgtgtggtggggaggataaagcctctgagaagtttttcgtctagcagtagtcactagattggtaagttttcacttgggatcttttatccaactcagcaggttgtaataatacttagtacagcttctgataagtgagaatgcagaaagtaagcacattaaattatttggggattcaaataaacaacaaacaaacaaaaactcaatctctaaatgtttcctttgaaaaggggactttgcaagggagtctatcaagcctccatttctgtattttttcctctttctaattctttacttctcccccaaattcaagtacccgatctgctaaattggaggctaaaattaataatgaatgccataaatagggaagagtttcttcctcagatgtttatatttcttacccaattgtaacttttctgctgaaacctggaaggtctgattctcaaaaaagatagtgaaggttttggaacattttattagcacaagacatggaaaatggaatcaaataaagccacaaggcatagcaaactgtatttcatctttttaaaagggtaaaaaggctttttaagtttaccaagtgacatttttggtatttgtcccaaaagaatatctattaccatttcaaaggttcctaatacaactttgtcctgcttgtaacctttttttcctgtgaatattcctgatgtcgtcctaaattagtggttccagtctcctatcagtagaaagataatttttgaaaggaggagatggggagtatttgagtgatatcatcaagtgctggaattgcagccactaagtcactcttgatgaatacaaattttgaacatacaagttggaaaaacctggccctaccctgcttttatggttacataatctcaagttctgttgctgttaactttgccatcgagttaactcatgatcatgaggtctccatctgggacttgggccaagtatttcagagtctgtgtctgcaaaataggatcacctccattcctcagagggtcactgcgagggcatgatataatggacatggcgtagtctagtaggtattccataaactatttttcatcaattgatgtaattatccaattttcatgaagcactcctgggcctattgtttttgcatgttgtaaggaaaaggcatggggaggtaaaagggacggcggtggaattcttctataccttcatttatctgtaattagatttttctttgcttcctgtgcttcctcttaaactgtgtctgtcactaccatggcaatcagtcagaaagtagcttgacccacttttctcactaaattgactgatgtaacagctgttttggaggctcacatttcattttccacctgtggtacagatggcccctggttcttctttgtccaactggtactttcctccacacaagtatctcaggggactggggaagcactttgctctctcttgccttgtatctaatctgttggttgcagtgcattctaaaatagacaagaactgatacagcttggtgtgtgaacacctactttataattagccacgtatacaaatggccaactagtatttttcataggatggaggtagtgatgtatccacaaagacacaaagaccccagggatgtttctgttttttgtctttcttccttttttttttgtaacaacttattgtccaacagatggagtatttcttgaactgtaccatacctttctcatagagctcattgggcagaagggtggagctagtgatggtatttctttaccataaaagcagaaataaactctcaggatttgtgcagtcttagggagggagtgggatctaatgactcagtctctggcctggacctcagattaagtttcttatgaagacaacattgtgaggggagtaattagacagcttggcttggccacagggtgggttaagtaggattttgtcaattagcttcaggccccagccacattttaaggcatagtttgaatgggaaaataaaatttggatttgaaataacatatacatccacatttactatcattatcatctagtttgcaaacttggaattgcttaattttgtagacttaaaattcgttcgttgcctagccttgcatgaggataattactgtatagagatcataacataccatctttgaacaaaacagataacctctatcacattcaggaggttccccatctaaactcagaaggacttttgatcctgacaccctctcagatgtgaagaggatgttccccagcaggaagccagaatgagtctttggctgtctgccaaggcctgtgagcactgaccctgtctttggcccacctatggtttctggtaagacctttgctctgctcacagagctggagtacaccctctatctgcttggcccagccacagatgggcatgtgcccaacactgaggccttacagccaaatgttaataaacagggctggtcttttgcgtaagacaatcagctgcttgcttgatttgaagggtattgacaagcctctactaagcttcccaaatctctcttttgactgaaatactatcattattaagccacaaaatagcaggttgtgattttctgttaattatttccctctccacctggctcctttacaagatgcaaacatttaattctggtctagccacttcccagctgtgtggccttggggcaagtttcttagcccttctgtgcctgagtcttctccactgtaagacagggatgataatagtaccagatttctatggttgaggtgaggattaaatgagttagtacatgtaacttagaacagttaacagtgtgccattattattaagtctttggtgtttgagcatgaatgagcaggccagattgtattgtcccacacaggagagtttagggaaaaactcagtaggatatctggcaataatgagggagatgaaagtgagatcacttgaatatgtttcactgttttgccaagttttacaaataccctgtgacccccaagggaaacatttcccttcacaacagccattcctgaaactgagaatgctgctgtggctgataagccttcttttacactctctttatctaagccaaagaatgtctttcatgtcccttcttcattcaaatatccacttacaaaattaaaaaaggacatatttattagccaaatggggccatctggaaccctgtttgtttatgtcttaacttactataattcttacaattacaaattcataatataaatggaatctgattcctgttatgtttttaaaagatgagagaagtttcatttaagaaaatgcaccattaacccccttcttcctgagtcaatatcatgtctaattactaaatatattgaattataatttcccattatatgtgactttaccaaatcaagtggtgaaagtcttatgttgataaataaaaaaacacaatgcattgaagttttaataagtagagaggaaggtgcctattaaatattgttattaatctgcaaatgctcactgcaaaaatttttgcatataaacatgtaagtacagacattggctttaatgtgttaaatgtgccaatatagaacattttgatgttacaaagtcagtaaatgtgacttatccaggaacttaacagaaggaattggaaacatttttctctttcatgcttctttattaaggtctacccacctaacagccgtggaaacatttataagtgaggaaacatttttcatttcaccactacacatatataaaacacatacacacacacacagcactttatagccttgttaaaaaattctttctgaaagcatagcaaagaacattttggaatatctagtcctccaagtggatgctttacagttttaattattgcttctaaatctacatttataactgataaatgtgtgtgcatgacaaaaaacagctgattctagggctctgtacactgacccagggaaacagtattttccagatatttacagcaggtatagtccacattgaaatactttatcattttgtttgggtgaaacgttagctatttcatcagcactgtaccagatttaaagaaaatgactgtaggaaaagccattagcccttagtagaagaacagcacctcaatattttatgtctactcatcccctccgataaacaatttaaaaacatttctataaaggacgtgactactaagtaatttgttagagtttggggaagcttgaatactttcttcctttaggttctaaccaatttgagaactagacataggatccagacagggattaacacacaccatcagctttaatacccaaatgacagggctgctggtgggggttgagggtaagggtggggtggaggcggggcatagggcatagggcccaccctctctggtgagaggcaaacatgcagttacttatttcttttcccgggaactgtattggttcacccagttgttggccaagcagatggagatctgcgccagtctgtgttagtttgggtccttcaggaaactgacccaaagatacttgctggggaaaacacttgtaaggaaaaatgggagggagttgcccgaggctgggagggagagagggatagagggttgggtggaagcatctcagacttcagtgccgtactgaggcaagttctccaggtgaagtcgctccgcagaggagtcccaagtctcccaggaatgggcccgccttagaattcctgtcgcactcagtcattggctacaagcagccgtgggaagtgtgacctcagcgtggtgatggatggctggatttcaatgtgaagcagctggagccctcattcaattatcctctctgcagtaaactgatccgagaggcgcgttctcaaggctgccacggtgatcaaatgttcctccaacacctttccctggggccacagagaacatatcctcccctacacaccacctctagcaaatagaaggaatgggctaataatcaactttttttttttctgtataaatgagtttctgaagttctcggagccacacacagcaactgatgttgttttatagttaccattgtatgtgtgtttggtgtatgtacatagaggcatagattttcattatggcacattcttgggattgatccaaataaacaacagtcaacaagtatgcgcgtgcacctctgtgacagacactggaaatgccacaagaaaggataggatgtgggtcctgccctaaagttgcaacaaaaatataacattcaatgataggaaatttaaaatacttcccaaagcaggagagagctgggcttcctctgccactctgtcttgtcgtgcccatattcaaacaggttttgcttacgtttgtttcagtttatttatgcatcccatgctctaacattgtacaaatctttgctgtcaggcatattataattgtatgattacaaattaaagtcaatcttgtaagatgcttctcttggaaacacaaatcctttgaactagtagtaatttttgttagttatcagaagttgaacatactctagtgttttctaagttatgtggaaattacttgttttcttcttccaactttattccacacttcacaacaaactttaggagattttattgaaactctaaggctgtctcaacaacacaagggacagtcactctgctagaatcacactttgacatcattgttactttaatttttttttctggttcatgcttatggcccaaagagatcaaatgtgatttttggtgagttggatttcttctccttgctcttcagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaaggtgagtgaaaaactatcttctttgtctcaaaaagtcctctgtaaaatggtttaaggaagccttccacagaagaaatctggaattctacaagagttcattaaataccaggtgccttcaatttaagtcagtatttctggtgcagttttctggttaagccaagtttttgggcctgtcttattccatcaccagtcatagatccattgaagatgttagcctgccattctctttctgatcatccttcttagttgtggaaggatgaagttgggagaggaaagatgcttgggaaaaggccttgaggttttcatcttgaggtccagggagccctccctcactccatgcttcagtttcctcacccaggtatcacaaaaagcaacaaactattcatgagctagaggatcagaggatcaaggaactgaacaagtttgggagtataaagaggcagagacccaggagttcagtcctttaatcaagtaacccaggtgtgtgtaaggcagaccaagaggatgccataacgactctaggtgtggatgaggttaagggtagctcaaaacttgtatgctgccttacaaggcactgcaagcagggcttgtgaccttatttttattttaattgcatctgttcaataatgatcccttggtgagggttcagacaaccctccacctggctcctgtggactggtatgggaattctgccagcaggggagtgtggaattggcccaagtcttcactctttctcctaggagaccctgggagcaaatctacccttttccaacattactaagcccgcaatgtacaatctattccatttcttaagcagaaatttaagtctagaggagaggaatctatattaggaacataaaacaggttttatctggttgattgtccattcattcatttggtcactcacccattcattcaatcgatatttattgagtgttcactacatgctgcacactagaaacatttattcgtcacttaccatgagcaagatactgtgcgaagaacattatgtccattgtttcttttaagcctcatgatactcaattattgttctcatttttgagatgagtcttagagagactgagtttccccatctatcatgtattctaaaaatggagtctgccttcaaagttagtgctatcacctacttgttatattgcttcaatcccttcctcccaccacaccttacagatggattgcatgctttctgttggtgttggggtgaaatcttctgactggatggcagaggcaagcagtggggcggatagggccccgctgtgtcttctcctctagacagaatgaggaacagaatgttctgtcagacagtccagtgcattgtggcagtgttatttgtgttacacttacactgacttactaggatgtttgcaggttagttcagccgaaaatattttatagttagagaaagagaggagccgttttgagttaaaataaaacaatagtatctggtgttttcagcacagttacataaaagaacacaggagtaagagtaaaacagagtggatctatgaccatagactgaatcccaggaacctggatggggacaaattgatgtgagcaggaactaacctgacatgtggctacatgcacttgttgctactgatgacagaatggaacaaattgatgactgagtatcacactcagtcctgcttgtgttgccaagttgagatgaaatctttcaatatggtagggatgaaacttcagaacttccttgttagaaagcctggagaggggaacttaacttttggtaatatttattatcatcacccaaccaaggctgttcagttggacacacgaatttttaatgcaaactttaaaggtttttacttttatgaaaaccatgttgacctaaatttaacctcagttccagttccagaagaatttggttttgaagattcagaggaatgcggttttaaaatgagcttagagaggatctcgcagtgttactcagcagtggggttgattcagtagccttggctgtgtgattacagggaacaaggaagaataacaactcaatcaaatattgaaaatgtaccagaatatccagaacacatttttgttactttattttctcagagaagactttaatgattcttctctccttaacaaattctaatgtaaaaccactcagagagacctatttttccttattcttacagtaatgtgaaaatctaagttgtcagggtaattgatctgaattccaaatgagtacagtcattgttttaagccaaggaatgatctttactttttgtagcaagctgttttgcttttgacttatttttctcctgcagatattttgaaatttcgagacttcagtagtcatagtctgtggtcgcagaaggagaacatttcttaacattgatagattcagtgaactcataagcagtaaataccctggaccagccatcacttaacccttcactggttggattgattttttttcttcttgggtcaccactttgtcacccaccctcaccctgtgttgtccagttatttgatcaaacagatcattgtttgaagattgaataagtccatcatgtccatagtgtcaaacacagtgaaaaccacaaggcgcaaggtccacataatattataactattacagtactttagacacataagacaggttagcatctcattctagccaagatcagtgcctccttttatgtgggatttcagattctttccatgccctgtgtcatggatagaattgttcacagaaatcaattaaaaacattacagaacaagaatcagaaaggccagtgactaccccgttgggcaccagaaatcatggcttatggaaaaggagtgggggcctagacccaaaccggaaccagaccaggcaatatagagacagcacataccaagtcaaagccaaaagacacaggaatgtcccaaatggggccccagtccaggctggaactggcatggtacagggaaggtaggatgttcagccacaaaaattttggaatcctcctggctgtgatttaaggtagccagatggtgacttaagaaagtccaagaaccagatgaagaggcaggaccagtggcaaaatctagaaaccaggtgtcctccaatacttccaatcctgcttgtttgctgcattatcaggaatcctgcagggccactatcagaaaccactgtcagcttgtttgcttacagttgtagcagataccacctcaggcttcatggacaaaggtctggggaacctgcagaaccgctctgggctggtgttcaaacagactttgtgtccatttctgtttgttcccgacccttagatcagagcataggtactcagtaaagaacccttgaaactagcttctataccatgggtactttcttctttctgtagtaaaatgtatagatataaaacttggtccctgctctcaggatacttaagtcttgatggaaagataaaatacttcaaaaggtagctaacaattcaagaattagatagcagcttaattattaaagatatcccaaggctgtttatgacccactaacaactaggcagcagagataatgttatgacttttgaggggctaaggtatgatttggggtcagggataatttcaaagaggcagtgggaatggaatggtttaaacagaggctcagagatcacctctggacaaatggagtgtccagggtattgttaataattagaccagtctagtgagaccaaagagatcctctaggcactacgtcttaaacttttggagcataacaaaataaaaccccacagcctgcctacaccatctcatctctttttccagtggtaaaagaactcagtgatatcaaagaattgaagaggaacaaaataagtatcaaagtggtaatgacgcatcaattacaagaaaaagaaatgattagcaaaggtaaaacctaagaataattctacaatgatgctaataagcaccgagaaagtcgcaattgaaagccttggaactgatgaagctctaaaaagaaattctccttctgaagtttcaagaatcccttctgtctgtgttggacattgcagcatggccacatgtgtggcagtcagacttcatgattgtatactaaactaaggttttagaaaaatgcaaaattttactgattcttgatagctcacttagtaggttttggttgtgtagagacgtgagaatctatggaattaatccccattcatcattaggaactgaagaaagcacttgtgtttttgtatcgagaagtcttttgaggtcaaccagtgggccttggaccatactttgagaaacactgctgtagggcagtaaatgagaatgagttggaataatctgcagttcctttgtacccatacacagcctcataatctcaagttagtctctatctcataccccacatcagctagccagccctgattttggattttgtagatttgaaaagaatctttataatgccctgttgggggaggtgtgcccttatcttagtctgctcggtccgctataacaaaataccatagactgggtagctaaaacagcagacatttatttctcaccattctggagctgaaagtcagagatgaggatgtcagtattgttgggttttggtgagggttctcttcctggcttgcagatggccatattcttgctgtgtcctttgatgtctcttcctcttcttataagggtgctaattctatcatggggaccccacactcatgacctcatctaaacctaattacctctcaaaggccccacctcctaatattatcacattgaggattaaggcttcaacatatgaatttgggggagggacacaaacatgcagtccataagagtcctcttcctccagcactctgccccatccctagcatcttctgtttatcctgtcacaaacttactgaattgtaatgtattggttttcttgtttacatcttccttatgatgctatcgcatagctcctttaaaggctgcaattcacatgatacatattaggcacacagggcaagtctggaggatgttgccggtgccctgaccacagcaagtctgggatcacttagaaatgtagacattccaagtccttgtaatcttagggagcttaccactttaaaagaaagactagcttctctcaaaaggtccatagttaacattgttgaccaaaatcagtaatgggcccagaaatttgactttaattaattgattgtattcctctgggaaactaaaaaattaaggaaaatgtcaagtttgtctcatattcctcaaaagaggagaaagacgtgtaaaccagaagaaaacttagtattcaagaattctttggctttatttttcaaataacatccacgtctagataagacatatttaccaacctgtcatccagagagttgtcatctctgatacgggagaacataaggcgctcattactcttaaatgttaaacatgcatcaccatcattcctactgattcaagggctaattctgagagtgttggaagaagggcaaattgatatacccagacaattgattaaaaagtgcatttagtacataacaacagacccccaaaacacatgaagcaaaaaccaacacaaatgaaggaagaaacagacaatctaatgataataattggggaattcaatatcccattttccataatgtctagaataactagataaatgatcaacaaggaaatataagacaagaacaacaccataaactaactagacctaacatatatatatatatatataatgtgtatatatacattatgtatgtgtacatatacacatatacacacaaatgtgtacatatacacatatacacacaaatgtgtacatatacacatatacacattaatgtgtacatatacacatatacacatttatgtgtacatgtacacattaatgtgtacacatacacatacacacttatgtgtacatgtacacatatacacaaatgtgtacatatacacatatacacattaatgtgtacatatacacatatacacatatacacataatgtgtatatatacacatacacacataatgtgtatgtgtacacatacacacataatgtgtatgtgtacacatacacacataatgtgtatgtgtacacatacacacattatgtgtatgtgtacacatacacacatatatgtgtgtatatatattatatgtatagtgtgtggatatgtatatatacacacatataaaacactgcccaacaacagcagagtacatgtgtacacattcttctcaagtgtacatggaacattgtgcaggacagagcatatgttaggccatgaaataagtctcaaatttaaaaggattgaaatcatacaaagtatgttctatgaccataatggaatgaaattagaaatcaataacagaaggaagtttgggaaattcacaacttgtggaacttaaacaacatgcttctaaataaccaatgagtcaaaggagaaatcacaaggtacatttaaaaatattaatactttgaggcgaatgaaaacaaaaatacagcatacccaaatttataagatgcaatgaaagcagtacttagaggaaagtttacagttataaatgactatattaaaaaagatctcaaatcccataaccaaccaatcaaatcaatattagcacctattccatatttgggaaacatgccctttatcatcttatagtaaacttatgattaaattgatgcatgaatggaaatatcattcctttcaaatggtaaggaataataaatgtaataaatctatttgtataaacactataacaatgtaacagagactgggaaataaaaaatgattgcccagtagatcgccattttagcaaaatactgactttggtatttccccttctagtcttttcctctgggtttacttctgggatgcaatacaaccaagttgctaacaatatgttgatctggggttgtgaagacttggtctcatttccttctacgtttgcaactttgcgctctatgcctctattttcttgtttgataaaagcagaaaatggcacctctctcaatcagtagttgtgaagggttagggagatgtatttttaaaagtatctccaggcacagtacctgggatgggtaattactcagtaaataggaactggttcttatatatttttcttatatagcatcatttgtagcacttgtatagttttgtatcttgctttttccactttacattttatcacaagattagttttcatgttgctttgcagccttcagaattaggatgatttatttctcatagtctttgacttatcatgatttcataaccttttccttttgccagaagacagaggactgatttattgtttcacatagaactagacttaaacacacttctccaaatgtcttctctgtggtttgtggaaattttttgtcctcatttttgaaatgttccctgctttgacccaattacagagctctattcactttctctgaaggaaatggttttatgctgatatttttcattctctagtgaagccacatttcttttgatttgtgatgctctttttaaattcttcctgatcttcacttggttaggataaagacaggttctgcagtgattctgaactgtatcaaggtcttgttcatttgttttcctggctggcaaaactctcgttttagaccctggttacagtctgtgtgggtgtagaggacttgagagtgaacacaagaagactttgagttgattgtggcagttgctttaagagcctctcaacagtaaacacacagaagctacctgtgtagtttctattaaaacagagatttggagggtctagtgtgtgaattatcaggaagaaattggaattggtgcgagagcttttagggagtagacttgagaccagagaagcacatttgcttcagccagcttggtggaaagcagaggtgactccgaacccaattctgttgatcttcctatactggcacacacatctccatgggccaaaagacagttacacctggcacctgttctactctcaatgtaatggaactcattactctatctcatttgttctcaatggggggagggtgtggatttttcctcccaggggacatctggcaatgtctgcacacagtttgaattgtcacaactaggggtgggctgctactgtcctctagtgaggagaggccagggatgctattaaacatcccacaatgccaaggatggcctcctacaacaaagaatgatccagccccaaatgtcaatactgctgagagtgagtaaccctgatttacctgcttgaaaggttgatgttaggtccagcttgctgcggactttgctttccaagcaatcaatgcattgcacgtcacagaaattaagacagtaataaaaagagtaaagtaattaattgccaatatttataatctcttaacagtaattaagacttaggaatgaagcactcttaaatatgattcttgtcaattgccagattaaacatatttatggtatatggtctatgtggaattgcctcaaacccaactatttttataggttattttttcatctcaaatgtatcagaaagcagattatctcagcagctcatcaagtcttctaaagtattaacattaagcattagtagtcaccagcatcaatatcaatgtcatcatttttattgtcatcatgaacattcccatttattatatgcttgtgatatgcctggtaccatattttgcacctcacatgcattatttcattcattccttgtgctgactgcatggggtattactacaatgctcattttgtttatgggagagtgaaggctaagagagcttatgcaacttgaccgaggtcacccagattgtaagtcacagaggtgaggtgcaaaccatcatctgtcacactaaacagccagtccttttaatcactatcacccactgcattcttaaaaaatgttcttttagctatagtctttgcaaataatatttcaccatgttgggtcagtgcaaagcaagcaaaggctaaagagactgcagaaactgtcactgtcacaaagacgaacactgaaacataaccctggcatgttggttgatgtgttcctttgtttgctcatttgtttattcattcacatattcattcttttagctagtcagcatttactaaacacaaaagatgcaccaggtgctgagtatatcaggcattagggattcaaatatgccagagcatctaccctggttcacggtttaatgggcaaaacattgcatggaagcacaaataatttgctctttttaaggattttgacaaaaaggaagagttaatgcccataaacatcagagaaagtatgagagagagagagagagagagagagagagagagagagagagagagagagagaaaggaggggaagggagaggaggggaaaggagaggagaggagacagaaaaactccgattatggcagtgctggggatgacatggactttgcccagtgctgacaaaactgcagcagagcaataccagaccgctgcagagcccacctgcctttgctccggagatgagcaagggcttgtcaggagtctgtgtcattcatggtgcagcagtctccgacccgtgaagccttttcgctcattccctctcacgctgtgtgcagcccacgcagaaaactggggaagtgaattccaggctgtctaatcagggttggctgcatcgtgacaatgctgctcattttaactccctgcacatgctgtggcatttgagaaggagaaggaatcacgaggagcaaatcaagacttgcaaatttaacttgtactcccttaccactgctccctgcctgtgaactgatcattccacaccctctagtctaggactttatgcagatggcaagggggtggctggtttaatccgaggcagggtcagtcaattggcttctcactgagggaaatttctattaagcagtcgacagattggagtctcttttgtccaggcaggtggcacaaaggttgctcagaacaattcatctggactgctggataaacagccgaaagcaagcgtgtcctattgccagaaagtcattggatgccttctataggaaggacagtggcacttccttccaccctagaagatagtggcacttccttccacctgtcaccgatgtaatagaatccttaacaagtaatacatattttactgcctagctcttacctgatcccccaattttggatacagatgataagaatcatggctgcattttagtttcagaggcagcaattaattcctgaaaactaccccaacaggtttattaaattctgagtgttcaatcatccatctattcagactgttttcattgcctgatcattttgtacatgggctagttggaatttaccttggccaaattaaccttcttcttcataatgcaagttgacagcatgaattggatttgagtgggaaggattaaagtgcttggataaattcactcatttatgaaatgaacatctattcactgactgtttcaggcactactatgttagaaataggtgatacaagacaacatccctcaagggactcacagtctagttgggtaaggatgtgagaggggatattagcacatagtggttgcagcaggaatgaagaagaaatgagaaggcacggcctttgaatacaggtgacaaagaaagagtctagacaggatgttggaaaacagttatcccactgaaagaaatgtggaagagaagtgattcaagtataggtttataccctggctttgctattcccttgtcttgtgattttatataattgctctgcctcagtttcttcatctgaaaaatgagaaaaatacctaactcccagaggcaattctgctgtccaccctgaggaatatttagcaatgtttgaagacatttttgattgtcacacctcagggtgggtactcttggcattcaggggcttgagaccagggatggtactaaacaccctacaacacacaggacagttcccacaacaggcaccgatagttccagggctgagaagcactgaatcacatagtgtgtatatctaaagttctgcataccatgggagctattacaaactacaaaatgttaccattagaatgaacttaatttaagatcccctatctattagcagtgagtcccaggagcaatggaatcaaggtcaataccagtctaaaatcccagtgtcctattttccagttttgtgttcctactttataggaaagacaaacagttttcattttgagtgttgtgtctgtttcattggtactgactgctgagaagggttgggaatctgagttctgcgagaagaagtggggcgatcatagcagagtgggctgtggctgtgtcaggtggcatggacaggctttctgcgcacatttgcccaccttacagcagccactggacacttgatgtgctggaaagagtgggacacacccgtcctccacttgcagctctggcacgtagtaattcagtgaccttgggcaacttcctgaccactctgagccacatctataaataggaataataatgtaagtcttgagaaggcaccataaagacagtgaattgactcagatggtgctcctggtacacagcagcttccaggaagtcttcattcccttcgctgtcctcacagtctgcccataccttctgccctctgccccttgcttccaaggctaggagttgattggttggttggtttttaagtgaaatactgtctgaagattagctctgcacatttccccagcgaatatgaagaaagctcactgaaaattaaaatccattaattatcttatctgtgactaatatgagctcattgaagcacttgcaaacatctgggaggatctctttctcaatcacctgaatcctttgagcttgagccagttcatgagatgatttctaacctgcaactgtcctctttctcctggaggaggcattgcagttccagttttcaaaacctgcagcagctcatgtttccaaggcctttgtctcaagacagcaaaattacaaacatttcactttagcattttcattttgttttggagacttcaaggaatttccctcctctcaccctaatttttaactagcaaatgcatctcgtttgtaatttgatttttctctgaagagaatcagcttaagaaatacttggagagttgagctgccattgccctactctcaaagaaaagtcaaacaatggactttatacagcattttcctgagcattttgaatgggctttatggccaaaaatagacatttcacctttctagtaatcttttgtgcataggctatgtactattggagtctggtccagaaaataaaatgagagctatgtcgatctcaatgtccagaagtgccctgggtgtcttctctatgacaccctgtcctgggttatgccccattcacatttaatttccagctatgattaccttgcagaggtgttttctccctctatctgacattatttaatttgataatcaaattatgtctatgttgcaataataggtaggcagtcactagtaaatacaggtgccagagaacatggcagcctggagactttgtgaaatggctgcttaaggggcatcatacaggccaggcaatgaggaaacaggtttatttggaagttttataacatacgcaaaatcacatcttttaactaggggataatagtagcaataatattaacaaacccttgctcttgattttaagaattccgaaatccttccatgtccattctctctttcgaacttcataacagttctgtgagataggtagggcaggcactgactttgcagttcaatctcacatgacttccaacttcacaaagggtggaagattgtgggttgtattgtcttctccctccagagaaggttcattttaagactaattattaattaagcctattgaagtccatctgtagaaaatgggtgtaatccctttcaatcagaaaagtaggatcaccatgtagtctgcaacaggtgcccaggaaggggattagtaacaatccattccatgggccagaattgaacagataatggctctgcttatacccagaaggacttttgtcactgacatggaaagatattcaagattaatctacccacctctatctatagatatatttcaaaggaaatgtattatctcaatttctacctctgtttactattttcttgtttaattttaaaaagtcgtactgtaatctttatacacatacaaacataccacatacacatacacacacacatgcacatacatgcacacacatggtagaggacagatttgatccaggatttggaaattgggttgaaatgtcttaatttcagaaagatcaggtggcaaacaaatgggtctggggaaaacttcacttcaagatgcccccaaaccattgccctaaaggtcaactcttctggaaagctcttggttttcactgacagctaagaaatggtgtcccagacaccctgcgaggtcacatacaaagtttactgcttattatccgtcaggagagagagagcctgggagtcattccgagccaaatccaatccaattatgggccaattatagacctgctttcgctgccaggagcaggccaccccagcaacccagctggtgtcagagcccctggctggcagggattcccagcacataggaagaggagctcatgccccagataagacaaaacagctgataatgctctagaccagcacagatggcaaatgcaactgcattagaatggttcttgatcctcatcaccacccccaatgccatcccttcataactgagtccagattcagttttctctcctgtgtggcaccctttttttactatgtgatcaaattctgaaataccaagaggtggtaggccagactttgctcctgtactcagggccaaccttccattactggttgagttcctgcagcctatgctatggtgcgaactggggtcacagtgcctggatacccacagcaccactgacaacctcactgaacatgtaggagttaaaatgccaagaaacttgagttagaaacttgacctaggtaaaaataaagctatctctattaaaaatcaaaacaattttggctggcacttccaacctacagagatcatttcaggtccacattctagcatcaaatagtgtcattattcctccaggctggctttgcatggatgacctgccaatttgagaagccagctttttctcatctttaactgagaccttgaggacagtggggacagggcagcaccaaggacagcatcctgtgggtgactgcaaaggaaacccttttcagattggcctagagctgtggttctcaaactttcacatgaatcagaatcatctagacagcttgctgaaactgagattgccaggccaaagccctagggttttcaattcagtaggtctgggatgggttccagagtttgcatttctgacaagttcttagggaatgctgctgctgctggtggtagtttgggatcacactttgagaaccactgacctagagccatcaatcagattgtttaggtctggacattcagaagtcccccaactatcccatcaccggctccacagttttcaggctagtctccaaaagtacagtgagaagcttggtcagatttctttgctgaaatttatatatactaagcatcaatgaagcaataatcacaaatgcttgtaatagtgcttccaatggtcaggcactattgcaagccctttaccttgtgagatgtcagtgagttaatacacgtaagagctccattttacaggtgagaaaactgaggcacagagaagttacatgactttccgcaaggtcacacaactagatagtggggcagccaggagtcaaatccaggctgtctgatttttaatcattaccccagtctgactctcaatgtggcagacaggtccatggcggtgaaatgagctgggtaaattatgagggacaatcctaatgtaaaggatgaggaattctacatcaacttaccccccagtcacttaaccttactgatacaatgttcatttctgtagctgtttagtaagtgctgacactgttacagttcaagggttggaaaaccagaaccaacaggccaaatccagcccatcatctgttttttttcttaactttttgagatcgttctagatttacatgcagttgtaagaagtaatacagagagatgcctggatgaaatgactgggaataatgaagtcatttttctaatctctaatgaaagtatttctaaataaggccttgccaagcttcaaatatatgctgagacaaaaaagctgggtttgataattttcattcaagtatacttctgtggctgtccaggtagtggaagtaaaacacaaaaggttttccaaatttgaacacttttcaagtccaagaaacgacaggaccaaaggatcacagctacttggcagactgataagcagctttatcttattttttttagagacagggcctcactctgttgcccagactggagttcagtggtatgatcgtggctcatggcagccttgacctcctgggctcaagcgatcctcccacctcagcctcccaagtagctgggaccacaggtgcacacaccaccatacctggctattttttttttaagcagagatggggtttcaccatgttgcccaggctagtctcaaactcctgagttcaaaagatcctcctgcttcagcctcccaaagtgctggaatgacaggtgtgagccactgcacccagcctgataggcagctttatagcttttctcaaatatcatgacagaagaactgaagctggtttctgaacaactcagttgtccagccttgggctttgggtgagaaccatcgtttgtattctaattttcttagttacagagtcaggcagcagcaaaacgctggatacagttagatctatggtcctcagcagattatgtgcacattagaatcacctggacttgctgagtgccacttgctatcagttaattcttagagggtggcaggataggcctgggaatgggtatgtttcacagaatcttcaggtgatcctgatgtgtgtcttggtctgagaaggactgataaggtgtttctcagagcgtcctttgatgaactagactgaaatctttcttgcttgggaaagtatttctttggttgaatgttgctgagatgaaagtattcaacggtggaaaacagccaagcattcttggaaagtcatgcagcatacatgtgcatttatttatagggtgaaccagtggtgagccatggcttctatttgggataggacatgggaaagagatactaagttcaggactgccatatgagtccaaacaatagccatattaggcccagaaggggctgagaatactctagctcccactaataaatgtgctgtcttgtcagggttgtgactcgtgtctacccagcaatatatagagtcatattcttacaggttaggggactatcaatgtcacttagtccaaccaagacccagcctaatgcagcaatctctctatactcactgctttccagatatgtaccctaccctggagaatcacctgggtttaactatgaactcagcaatttttaacccctatctaattcatctccctctaaaaactgccagggccattattcccttcagataatcccacttgcaccctttgggaatgactcattatagggagaacccaaataagtgcccattccattggcgtttcttttaacaaattcagtctctgcatgtataaacataagtgggttatgtttgtggtatgacatgctaaggactaatcactgggtgctgagcagttgcactgtaaactttggttcaaggtcagccagctgtgttgcccactcccacaaagctgaatccataagttctcaggatgccacctctctagagtctggctacttatctttcttccccatttcataaatgcccaagcaatatggtcctaccctgtagccaggatccagtttttgacatgtcacactaaacacgaacttttcatggtttccatcaattcgcctattccttgatacataaaatacaagagctgaacttgggctaaggcagctgtattagttatctttggctgtgtaacaaattattcaaaatttaaaagaacaataaatattgtctcacagtttccgtggatcaggaatttagcatggcttagctgggtggttctagcctagggtccctcatgaggttgtagtgagttgttgactaagattgaaggatctacttccaggatggctcactcacatcactggctaattggtgatgactgctatcaggaggaggccttggtgccttcccatgtggacccacccattgggctgcttgaatgccctcacaacatggcagtcaactctccctggagtgagtgattcaagaaaaaacagggcagaagcagcaaagtcttttatggcctagccttggaattcatactttgtcatttttgtaacatgctactgattacacaagccagccctattctatgtcgaaggggactatacaaggatatgaataccaggaggcaagaatcattgggagacatcttgaaggctgcctaccatagccacctacccccttcattttttagatgataaaaccgaggtccaaagaagtgagattctcaaagtcacatagctgtgacatttcagtatttgcttttctttcacccctcctgatccttaccacccaggatttcttacatttatttaaaacaccaaaagttgtttatctttggggagattaggaagattatttccaaatgtgaagccagtttctctgatgcttctaacagagaaagccctgacagcacataagcacagtgcatagtgtgagcactgaggaaagtcttttcttcatgtccttgagtcattagtggggaggggttccaaaaggagggagaggaaggcagaacctctacagggaggcaaatccagaagtgaactaaaaatccattgtttgagtgatacatcttagcttttgcacactgttccctctcctcagcttgctcccacattcaatggttttcctgctcttttgctttctttctttctttctttctttcttttcttcttcttcttctttttttttttgatggaatctcactctattgaccaggctggaaagcagtggaacaacctctgctcactgcaaccgccccctcccgggttcaagcgagtctcatgcctcagcctccggaggagctgggattacaggcgtgcgtcaccacatccggctaattttttatttttagtagagatggggtttcaccatgttggccatgctggtctcgaactcctggcctcaggtgatctgcctgccttggatcccaaagtgctgggattacaggcgtgagccactgcgcccggcctctcttttgatttctgaggatcaaacccagaacaacaagaaaaaagcacaggatattacgaacaatccaactaacgggagggaaaactctcctcaggagttggagttccattaatctcagatgaaagtgaatgaatcccaagtaacttcctaggagaagcacataatttttttctgtgaaaacttatgtttctaaaaacacacacacactcaggccaacatacacacacgttttaaagtgcacaactcaaaactgtgctaaatattatcaagttccttttcaggatcctctttgaaatagtcatctatgaaatgaaacaaaaagaaagcaacctcttgtatattcgctatcctttttcaatccgttcaaaaacgacaaggcttgtcatgtctgctcagcttaactagtcaggagatgacaactttctccccgcctgacctattttgtctaatggggcccactcctctgccctctgacaagctaccttctctcctcagttccatttatagcagggctttatttatggttaaatcattaggaatggaactgtctccctcacaaggcttatttcccctgttcaataaattaagccaggggatccgagagactgcccatttctgctttatttaagctcaaattcctcacagcccagaaaatactgcaaattgccagaagagagctcagtatgagttcccactgcttgcccaacagtatgtggtcacttgcaggttgtcttggatttactgctcaaagtaatgtttgtgtaacctgtgggaattttcctcagccctcgatggaagtttgagatctggaactgaaatgcttcagtgaggagcccctgggcctttgctaatggacaagggactcccttctcaatcctcaggcatgagccattggacaagtgctatgatcttctcatatgtttgacccctcttttcaccttgaaataaggtttgcaaacttcattcatccactatgtattcttgttgctgtcacacaggtgacctcgctgaacaattggagcattaatggcccacagctgtcaaagtgacctgtgcacttcactactcaaagccttttctcacttgttttcagttgccagagccctgcaatcagcggatctttcaaaaaatacaaaaccaaaccccacaaaatggatcgggtcactgccctgctgcatatccttcagcggctccccatgacccttcgggcctgtgttaactgtctcagacttggcaggcttttttcatcttgcatttctgcctgtgcaggacattcctcgctccaatcctagtgaacctctgccagctgatggaggcgccatgctgattctaggcctttacacatgctcagaatattattttttgatctttgttccctcccgtattcattatctggctaactcctacccatcattcaagtctcagttaaatactatttttgaaaaacttttctgttgcctcttaaactgggcaaagcatccatggcttcctgtgtttgtcccaggatagcagcacccatcacaatggaggactggattgccattgtttattctgtctgattttccttctagatcttaagttccatgaagggggataacttgtctgacttgtccactagtgtatccacagtgcctaatacattttctagcatataatgtaggccatataaaactaggaattctgctttccacttttaagaccatttaagcatatttaagcacagagctgtgtccaaaagaaacatacattgatttctaaaaatggcccctgtattagtctgttcttacgctgttaataaagacatatttgagactgggtaatttataaaggaaagaggtttgactcacagttcagcatggctgggatggcctcaggaaactttcaattatggtggaagggcaagcaaacacatccttcttcacatgatgcaggaaggagaagtgtcaagcaaaagggggaaaagccccttataaaactatcagatctcatgagaactcactctcacgagaacagcatgaggataaccattcccatgattaaattacctcccaccaggtccctcccacgacatgtggggattatgggaactacaattcaagatgagatttgggtgggggcacagccaaaccatatcagcccccagaaggaatgtaaatcttcacctaagaaagatttatattgtaaacaggtacagcgtacactcttttggtgatggttacactaaaagcacagacttcacttctatgcaatgtatccatgtgacaaaactgcatttgtactccttaaatttatacaaataaaataaaaaagaaaaaaagatttacattgtaaaacacagtaaaactacctaaaaatcttctcattggcccaagattccctcatcctagagacgttttacctcaaatctctcttctttctttccaagaaatcctattttccactgagtccccaagccccttttccatgtaatttagactcagttcacttttttcagttccctctctgcatatttagatctccccgaccatcagcaccacaaagagcttgaagccaagatgacaaagattgaatcttgtttggaagatagaaaaggaggaagggatgttttaatttataagctttttgtggatctttgtccctgaataatagtaatagtatatgttgactatgtcagaggcactctgctaaatgctttaccatgttatcctcccaaccaccctgtgaatttgacaatattatttccctatccttaggaacactggggttcacgttgttgggtaagttgcccaaggtagcataagtggaaagcaggaaagctgggtttgaaggcagagtgggctgtgaaaatgtctccacagtggacactcaggaaacatttgttgattgcagagacagggtcccaccttggaaccagcctggagactggcaaggcaaagggtgtaaaagcaatttctctgatgaattgattggaaacacatgtcaaagctttatttcaaagttgcttaaagaggcttcaaaaatccagttctaaaacttggaataggaaaacatgtggttagataacactgtgagacgaggtataagtgatcagtaaactctgttacaaggtgactttagtgaggcaggtatatcagatctcccagaaggggctcttaatctcattgaagttgattagaaaattactaatatgttttatcagcaatacttcccagaagggaccacttaacacaccagtgcacaaagctctgttctagctcaggtttgagatcattttctttcatcagaaacagctgtctctaaaccagcatttgtttttttccacctcagcactattgacaattgggccaggcaactctgttactggggccgttctgggcattctaggatagttagcagcatccctggcctctactcaccaaatgccagtagtaccctctccttcctgattgtaataaccaaaaaatgtcttcacatagtgccaaatgcccaccacggggtggggggcaaaaatcattctctccctctattgaaaactactagtttagaaacttcattttcaagtggtccatggaccaatagcaacagcatcccctgggtagttactagatatatgtggtctcaggcctctccccagacctcctgagtcagaatctgcagtttaacaggatccccagggattcatatggatgttaaatactgagaagccctcctaggctgtggttctcaatcttgtctgcacatcagagacctggggagctttacaaattactgatcgcacttccagagactctgatgtaattggtttggggcagcctgggctttgggatggttaaaaaaactccctccaggagatttaatgtgcagccacgtttgaacacccattctaggtggtttaaccccccaccagcgcgcgagcgcgcgcgcgtgcgcgcacacacacacacacacacacacacacacacacacacagagcagagtgagttacaacagcctataaacaagatctcaaatctccaaatcaattatgctttcttcctttccataaacatccttctttatttgacctcttatctcttttaacattataaaattaaatcatttgatgatagcttcaaaaggtaagatttggatataagtagcttttaaaataatagttggaatgatttagaggaaaaaatgaaggcattgatttaaacttcccccggcagctttttaaagaagagccatcaaaatcatccctcaaattctcaataattaaaaaaaaggtacttgaaaaaacaaacaaacaaacattaaatagcaaactctatcaagaaaattgttttgcatgaaatgtataattatgtaaagagcccatgtaaattggaaagcaaaatgctaacaccttaatagacaaaggaaatgaactcacaattcacaaaagtggatgtataattggtagagaagcctaagaaaatatgcagcttcagtagaaatcaaaggaatgttcaagaaaacagttactgattttcgtttaagaaaatccacaaagatgaataggaaagtgatcgtgaaaaagacatatgcacaatctcaaaaaatattaagtatcttctgtatagcaggcacacagcagtataaatgatgagggtgggggggttaataaatggagaaattcccagtcactgtggatttgtatctcttccaacccagttgtgtcttgatggaagtccattctaaagaaaatgttcacatggaaaaggttgtgttcatttatggtagcaaaattgattaagaacctaaatgtccaataataggattccaattaagcaaactctggtgcagccacctgatgaaatactatggatactatttgtgatataatgaatgataaataatttatacagtataaaactggaaaaatgcttcaatgattgagtaaattttgaaaatgatacaatggtcctggtccccacacctaacacacacactatatatttgtatatttaaagttccaaggagcccttaaactaagaaggtggtttatctttgcttaacccagtatttctcaacttatctcatgattgatggtttccttttccccccttttcctctccctttcttttcaaaggaaaacttgttttattatctcttgaaactagtatttctcaaatgaacaaaaccctgtggatttgttggtttatacagtagtatttaagagctatgtaaaaataaaggccttacatggatatatacatggtaaaaaaattcatcaagttcacttaagatttgtgcattttactctatataaagtatttttagaaacactgctagattctgagaaggcaagacatatttttaagtgaaattttggtgttcattagaacaaatgcatgaatatttgttaagtaaactttttggtacactacaggtatatttctgtgtatcagttgttaatgtgtgcctctaatgtactgtcaatgtgtacagattacttattgatatggtttggttgtgtccctacccaaatcttgaattgtagctcccataattcacatgtgtcatgggagggacccagtgggagataatcgaatcatgggggcgggtctttctcatgttgttctcgtgatagtgaataagtctcatgagatctcatggtttgataaaggggagttcccctgcacatgctctctcttgcttgcttgatgccatgtaagacatgactttgctcctcctttgccttccaccatgattgtgaggcctccccagccatgtggaactgtgagtccatcaaacctctttttctttataaattacacagtcttgagtatgtctttattagcagtgtgagaacagactaatacatgtatgctaattttacaagttttgcaaaagaatttagtgtagcagaaagagctccaaacctcatcctggatcagccgatagctagctgtgtgatcctggacaagtgactcaacccctctggatctgaatttcctaatttctaaaatgaggagcaataccaaaactctagttccattcgtctttgaaaaagttttactattttaaaagattataaagccttatagtcatatctttgcctcataatacatcaaaggccatccttttatctgactactgagtctttggaccactcattaccatcattgtgactgtgaaaacaatcaatcaatcagctttaaggtgatcactatgacaatgtgctttccaggtatgcattatgggaagaaggcagggaggcctacatttgtttcacatgttctgttagttaaatgccaaaaaaattagttttccatttggttgctccagaacccctggctgccacagatcattgctggacagttgtaggaggattcttggtacttctgatacaatcaccattgtctctatgccttgaatgccaaggcataaacaatatagaaagatgttgtcatctttggaaaagctgagaacctcttggttaagacagcagtctccttgacttatttatcactttgtctacttctagatgttattgaactctgccttggtagggaaatcttgggtcaatatttctccaatgaagtcggtggcccctttagagacagggaggactgggttctgatggatgaagagaaatttcccacaaaatctggagctgcctgtggtgactggtctttgatgatgcccctttccccaccaagatctcaccaaacaaatgtatctcagttgccagcccctaactctgagttgatatccaatataacaaactctcaatacaataggattaataaaaaatattttaatgagattcaacctggatatgcaatttgccttttccttatggtcactcgaattatcccggtcctgcacttaacgctactttaatctggatttcaggtgcaggatttgaccaaggcaaatgttctggtctttatgtcttcctcttcttccgtttttatataattattgttagaaggatttcaattttcattttaaccaccgaaggcttcatgagttgcaaaggcaactttggtggatgtttcacaatttaggaaaaaatgttcctaatttttacttagagttttgtttctctgactttacaagtatctgtttgggaaaaaagaaagagttttgggtttggagttgtttgggtgcaattctaggctgagcgcctctctgagcttgggtgtgtgttgttccttacaagccttagttgtagcttgcaccaccttccttagggtgtggtcctgatgagtaaaagggacaatatgtgtgaatgtgctctgtaaactctagaagactttacaaatgccaggcgtttgtcttatttctgatgccctctaaggaactccagagctttaaccagtttgctctgggtgcatggttggccattgcatatggaaccagaccatgagccactgccttctctcaagtactttcgagtgtcactgtgtttatggctctatgatttagcaccacataggaggaagtaatcattgcactgcccctgagtgtctggttaaaggacaaaatgcagacaagtgttgagtggactccatttcccacatgatgtaagtggggccacggcaactatgagttacacagctataaatgggtcacagcaaggcgtaaacatcacatgttcctcagtctggacttagggtgacacaagggagatatttggtgtatcatccccacaccagccaagatgtgcccttcccaaatgtaaactagaggttttgcttccatgtcatttttggtctgggtataaaagttacgtggggtagctagagaatgacttttcagctggttgccataccttccccatcattctcacaaatgtccccatacaggagaacagggcacaggagaatagctgacagctgttgtctaggcagcaaagcagcgtggccctggagacagcccaatacacttgcattccaacaccctgacaaacaagagtgctttacagagtgggcaattttagctctggatcccttcccattgtttctcatttctaaattcaagccctgacacagagcagggagctcaggtatctggattcccgaatttttgtattctggtatcatgccagcatcccgagcacatgctgagtcccacaaagccaaggatggagactctggccgtctggggactttgtactctgggatggactatatctgacgttatccatcagtgcattcctgtttccaggcatgttgggccttcttgaattctaccgggacccgggagtgggggaagctgagggacagggtgatctgcaggaggacacctgcaatggctcctgcttcatctgccacctcatgcctggctccttctgcaaagaagaatcaggtttattttgtaggctgaacaaggtagctgtgtaatcagttggtggagttcctggcacgtagtaggtgctcaaaactggtactgccaccatcagctgtttctccactcccacatgagcacaggttgatagcactggcccagcttccccctcttcacagttgtattcaggcctcccttggctctcagctgcagtaagtaaagaggaagagcacagttcccctggggctaatgttatgttaagaattccatgcatttattttcctaaatatggtcatctcacagtggtcgtggtggtctgggaaaactggatcaagatttctctgtttttaaaaaaaattttattttcatagcttttggggtacaagtggattttttgtaacacagatgaattgtatagtgatgaattctgagattttagtgcccccgtcacctgagtagtgtccattgtacctaatatgttgtttttatccctagctcctctcccacccttccccttctgaggctctaaagtccattatatcactctgtatacctttgcatactcatagtttagcttcacttatgagaacatacaattttttgttttccactcctgtgttacttcacttagaataatgaccttcagctccatccaagttgctgcaaaagacattatttcattcctttttatagatgagtagtatttcatggggtatatataccacattttctttatccattcattagttctctatgtttataaaactgtctcaaagtcagagaggcctataagctgaacccagtcgtgaaggacatcttatgactctccaatgcaaatggctcatcctatgtttctcagtatagccataatttcacctatctatctgggacagataaaggattatcagagtccatatcaagtctgccatataaatggtacccatttctgggttgcagatggtgcttctcagtctggacacatcttggagagaaatcacacctcataaaacatgcttcagttacaatttcctatggatcatcacccattccatgctgctcagagaagcccaaggaatacctcagcttcaagggaagcttgtcatgggcctcttacttagccagagagactggccatatgtcatccagcacagtgaccatagcagtaaagtggctacagcataccctggccatcatggggctagagctgggacctagggcagaattggcagcatagtggagacatagcacatcaacccaacactcctggatttctgcatctatgagccttcactcattactgctgactcacattgaagaatgtgggtttggctataactgcaactccagttcttttcctattttcatttctccagtagtccaactcatcaatcactggacccctgctatgtgtcaggtgccatgataggcaatgggatgtaaaaatgaataggacatatttatatccttaaaagatcctagcctagtggcagggcagctatagtgggaaacatgaggagtgagatgatgcatataagcaaataatcacaattcagcatgttacatggagaatcatggggaggttggatttaaaagttataaccaaagaggcgaggcccaaaggctcttgtcattacaggagcaaaaagtggtctagtgaactcagaatataggatacttgagggagaatgaccagagatgagcctggatcctgataccccaggatgaagctgtgaaattgctggtcactcagaaaccatgggctgggaaggaagtggtatcttacttccactttgtgactggcatggactgaaaattgataatttcttaaaaaaattagtaaacaacctaaacgtccattggtagatgtatgaataaagaaaatgtggtaacacacacactggaatttttatcctggaataagaaggaaactctgcaatatgtgacaacatggataaactttgaggacagtatgcaaagtaaaataagtcagtcacacaaggacaaatactgcatgattccacttatatgaggtggctaaagtagttaaacacatagaatcaaagagtgaagtggtagttgtacaacattgctgtacaacattgtacttatggtcaacaataatgtattatacacttaaaatgtattaagagagtaaatctcatattgtgttcttttgataataagataaaatgctggggaaatacaagaacctatgctgactgctcttgatagcattttcagttttgcaatcattaataacttcctaccttttcctctggttcacaaaccatccataccttgttagtggagtagaaacagccctaaagtcgggacacctctgttaaaatcccagcttttctatctaccagctatgagactttgagctagctactttgatttttgaacttctatgtatttcatctcaacagtgagtacaacacaacctgcatcacagcaatgctagaaatgttcaatgacactatgggctttgtgatctctaaagaaatatacaagaaagagaagctttcttatagagagatctctgctatatacttctctggattcaatggccagaactgggtcccatggctccccctagctgtaagagagactgagaaatagagtatattatttcactcaccagcctttgtagtagagaaaaacaagggttatggagggtgccaaaccagagtttctgccccagcagggggaatatccttgtgtatgtagttttctttctccagccattggcaatacaaaaggtgagcattccatttttaagaaaagattcagctcactcacataagtaaaacacacaaggaatgacaccaaagactaatggaaaacaaatgtgtaaatagtgttcaagaatccctgcattacaagagctttgaaaagaagtggcaccatatcaattagctattgctgcataccaaatcacaccccaaattcaatgtttaaaacaagatcatttcttattctaactcatgtgttttggcctcagctgatataggttgggctcagctgatcttggctggactcactgatgtgtctgcaggtcatctgggggctctgctctacatggggcctggttagggtgctttagcgggggtggccctgctccacatatttcttgtccttcttctgggatcagaaggctaacctggccacacccttgttatggcaacagcagaaatacaagagtaagcaaaaacgtgataccttttgaggcataggctcaaaactggtacaccatcatttctgcctcattctgttggccaaagcaagatgtgtggccaaactcaggcatgaggaattataccccacccacagtggtagaaaactacaaagttacatggtagtagggagaggtgaagaacaggagccatgaatgcaaatttacctcagggatcactggtcatacaagccataatcataagactaacaatatactctaatccttcaggagaagctatcttaatttagtttagaattacttaaatcactagagccaaagttgatggccacagcatctacccatagttcatttacattcatggaattgagagatgaagttttcaagtgaaaatggggtcttcaatgttgacttattcctatcatattgatttataagctgtccctaacatatctcatgaaaattatactaatgatgaacctggaggacattatgctaagtcaaataagacagtcatagacaaatatggcatgatcttacttatatgtggcatctaaaaacattaaactcatagaggcagagagtcaaatggtggttgccaggggcttggggtggggggtgatgtggatggggcgatgatggttaaagaatagaccgaatttcagatacataagaggaatatattctggagatctcgtattagtccgttctcgtgctgctatgaagaaatgtctgagactgggtaacttataaaggaaagagttttaattgactcacaattctgcagggctgggaaggcctcagaaacttacaatcatggcagaaggggaagcaaacacgtccttctttacatggcagcagcaaagagaagtgcagagcaaaacgggggaaagccattataaaatcatgagatctcatgagaactcactcactatcatgagaatagtatggggggaaccgccctcgtgatgaaattatctccatctggccccacccttgacatgtggggattattacaattcaagatgagattttggatggggacacagccaaaccatatcggatctattgtacagcatcatgactacagttaataatgtatccttgaaaattgctaagagatcttaaatgtcctcatcacaaaaataagtatgtgaggtgatggatatgctaattatgttgacttaatcatttcacaatgtatgtatgcatatatcaaaacattgcattgtatactgtaaatatataccatttttatttgtcaattatgccttaatgacactggaggcaaaaaactcatggttcctttggtttttctttttcaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtgaatctagactaaattaatttttatatttcagatagctacatatccccaaacctggagagaaatgagatatgagtcagctgaaacccatattgcctaagtgggggcctctcattctgaattattgagtaccatgggtaaaatcatggctgactgatcactcatatgaagttaaatatcacctgaggaattggatatcattgatattcttcctccaaggatgaggagttttacagtgagtgcattttacatctacagaggccagatggaatacagttcattataagttagaaactcccctcacccagatggaatagagttcattataaggcacaatgaagtaaagctgagcaaacagaacaagagaggagaagagccatccaaagatgaaacatgtctcctgctgctaaaatggagagtctctatgtcaactgaatcaatgtccaacactatcatagaccaaacagaatcacctgggctcctctagcatcttatgatcttctgaaaggctcgggcaacttcacagtgtgaagatttgagggacaaggttatcaagagcacactgtttgaaaagcaagcatgtcacttacctggtatgcagagacctcacatcgtttctcgggctgagtgactttgatccttgcttcagagccaaccattgtaaaaaatcagatgtactttgaaatatcccaagtgtaaattactctcccgcttttctgtttcatagagatcagcttccaaaagcagggctatcattgcctacacctgtgactggccacagagtcagcagtgcctgatgagtttaagttttcccgaaaaggtgcctgtctggtcataggtcccacgtgtttcaccagactatgatttatctggtcatctacatctaatatatacatatggcatggggaatatcaatcagaacaaaatatgccagcctaataatctgtcagcagacgaggtaaacaggtcctaaataggcgctagattgcctcagactgtctcactctatactgattagagtagttgggtggggttaccaaatttgcttcagtgttcactttgttttaatgtaaattatctatgttcagtttcaaaattaagttctgatataatgttataaaaattgtcttcaaattttaatgtcttccaaggcaaatttgcagcacaatacataccaaagtcattagacaaattcaatggatgttttgaattttaaatttaatatgtattatattttgttgaggctcaaattcactatatataggatttaggaacttccacattctatcattcattagatagcacatatagtataatataggaaaagacagagtctttgctttcaatgaagttataatttttaaaattcacacattacatgctaagtggctctttaaaaacccatatgtctcacggaaacagccttatttatcttataggtttataaacaaccaattattatgcaacttttccatgaaggagaaacaaagtacaaatagatgaagattcgttaggagagaaacaactctggtgtgaataagcataaggtaccatacccagtttttagtgtgcacactgtaaatagtatgataatcatactctactacaaggagagtgtctttgagtgcaatacaactttcactccacccacatttcctggatgcctactatgtgtcagtctataggctaagtgctgggggaacacagaacacattcatccagaaaatcaccttgcttaaaaaaaaaaagacaacccatacctctctgttccccctcccccatgtatgggattttcctatgttgtgcttgaggcatgagtgaaagaaggcccctctgggtccaggacctgcgggacacttggaaagcttctctgtttggagcagaagccattaggaacacataagcctctctagaattatctcaagcactcattttgtatgatctttacatttcaacagcacagactgaaaggtaattagctttgtttccaaggttacttactga

SEQ ID NO: 12945 - DNA, 8597 bp, Human
gacacaactgacaggcattcatgttaaaatagagattataaaactgacaaaacagactctttgtgtcaataagacaccaaactataaacaagatctaaggtaatgcaaggcaagaattaggccattcatcttgccacagagcatccttttgttaatataaaacatttatgtccagcctgggcaacatggcaagaccttgactctactaaaagtacaaaaaaatagccaggcataatggtacatgtctgttgtcccaactactcagagggctgatgtgggaggatcacttgagtcgtggaggttgcagtgggctgagatcgcgccactgcactccagcctgggtgagagagcaagaccctttctccaaaaataaataaataaataaataaataaataaatataatttttttatgtgcactccaagttttagacagagccttattcctttaaccaagtgcaaattaaagaatctctgaattcatctataagctgtaagccctcagcttcaagatatcccagctttttgagctgaaccaatgtatgccttccatgtattgatttacgtttttgactgtacttcttggctccctaaaatgtataaaaccaaactgtaatctgaccaccttgggaccactttcccaaggcttcttgggtttgtgttttccctgggcctcagttgctcatattggttcagagtaaacttctgtaaaacattttacagagtttggtttttctgttagcaaagcaaaagagataggccttgacattaagtttgattttagtggtaaagtattagaaatgattcagaggtttctggcttgtacagttgggtgcatggtggtatcagtcacaaataaagtgaaaattggaagaaaagcagttgtgaaggaagactacagtttttgttaaacaagcgcacttgagacaccgaagaagaatcatgtagccgccacctagcgtaggaggccttctgagccttctctgttggatctggtgtggattgggtagaaatgtgctgggctgcagtttaattgggaggggagagagaagggcagggaatatcaagtcggattctcctgctctgtccccaggagaggcaggtaagctgctttcattgctggtcagcactagtaagtcaggaaggaatctctttgggtgaaggggaatttcagagacttcctttaaatactctacttagaaccctcaaggtatttgccattcttggggaaccctgagccagggcaaactgaaaccaaagcccttctgattcctaccgctcctccagttcctgcccttccccatcactaactcccaacaaatgtacacagattgtatttgtgtagatgtggcctcaggaaatcaaaaggtcctagaatgcaggtaatttaaagtcttactaaataatcttctgtccagtttttccacatgggttctataatctattcaaggaggtcggggggaaaagcattcttttatttatttttgtacctcattagtaagtcctaaccatactcttccttaggtcccttttccaactcagtctcgttctcacatttttagaaaggacaacgggatctttaaattctctcggtttgtgttgggaaaggacccaaattagtgtgcttcctcattgacagtcagagtagccttcaagcagtatatccagggaaggcatttacacctcctccccgccctctttttcagtttggcctactctagcctgcatttcgctctccctgtaactatgagagaaaataacacacactattcactctcctttgtctgcaaagtctggcatttcagtggttttctttaaggggggtcctcatttgtgaccagctttgtcattaacggaaatcaatctgaatgccccattgtgcatcttttttctttccttgcagtctgagattgcctttgccaagttttttctcaccgaacctgaaagcccttctctcattttcccgttccctgcctccagccccattgaatccctgccgagctttctcaggcataagggctgtagtgtgaggattgggaggaactcgacctactccgctaacccagtggcctgagccaatcacaaagaggattggagcctcactcgagcgctccttcccttctcctctctctgtgacagcctcttggaaagagggacactggaggggtgtgtttgcaatttaaatcactggatttttgcccaccctctttccaaataagaaggcaggagctgcttgctgaggtgtaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggtaggtaacaataagaccggctgttctcttctcaacgtgcagctttagatatttgcagattccatttttcactcatcaggtcagcaagaggcaaagacagatcacattgccctgatcagatgctaggctatgcattttccactgaatggatttttaatgtggcacttgcttgccttcttacccagggccaataaaaacagaacatttgctattccgtggagaatatgaagcttctctgacttttttggttttcttctgcatccacttattatcacagtagtgttttacatgattaatgggctaatcatgttctaatgaaacttacactttagaacctggattccagaatcagaaagcagattcttgctttgtgagttattttggaagtcgctgcagactgtactgttccctttgctattttaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaaggtgagaaactgcttcttcttcagagtggggatggggaggggggaataaagataaagatttccaatgcatgttttttttaagatgttggaaagtgtagaatattttcagtatttcaatccaaggagaaatacaccaaagttagtttaatgtgcatatgttatattttgaacaatgggtacttgctatagcataaatctcagttgtatttgtctcttaccatatactgttcacattttatatcaaacttgtatttcagaaaatatttaataaggtttgtttgaaagagagattgcattttgtttaattccccaggttgcctcagattgactaaatagacagtttgcctcattctaaggctttctttagagggacgactagctgcaaagcactggtttaggatttttgtttttaatatattaaatttttgtatttagatgtatactttttaatcaaattatgaattcaaatttacataatagaaaatctagaagtaatagaaataacaataggataattaactgatcatgatttattcaattatacaactctttcaaaaatcacatcgtcttccgtatcagaaatctgaattgtatttattgctatgttctgcattttgttgttggtctcagtctgttgttagcctggatggagacaaacttgttcacatacagaaatgggatggcaaagaaacaaattttgtaagagaaattaaggatggcaaaatggttatggtaagtaatgacaattctccattcttccttgtttttttctcctctccgcacacctctcacctccttccttcttcttccctcctccttccattcttcctccttccttccttctttaataatacatcactggcaaggttctttaactatatgtaaaacaggggaaacaaaaagatcccagttaattttcttcttcagctcaacttctttgattgtagaaaaagagaaaaattcatgtgtagttaaaaaaataaaagttgccattgatttgcctaaaactgtgtcaaaagattttttgtaggataactatggatgtctctcaaataaaatttaatataaagcccataatcactgaaatatataaagataattgctattataagagaatctcagacagatgactttatagctcctgtaataagagatctttaaacagtttatattttaatttataaagttacacaagttctgggcagataatttagaatataacagaaaagtataacaaaaaaattaaaatcccctctgatttctcatcagtgataacccttttttttttttttttttgagataaagtcttgctgtgtcacccagactggagtgcagggggtgcattcttggctcactgcaacctctgcttcatgggctcaagcgattctacaacctcagcctcctaagtagctgggaccacaggtgcaagccaccaacgccgggctaatttttttgtatttttgtagagatgggatttcgccatgttgcccaggctggcctacagctcttgagctcaaagtgatgctcccgcctgctgcctcggcctcccagagtgctgggattacaggcctgagccaaggctcccagcccccaaagagaaccattttgatgttacttctttccagtttttttctcgaatgcataatatgccttttaaacatatatattcaatactaggtagacatgaaaaatatttttttcaatcagcctcttcttacttactaggaattatctgtaaaagaggatttattagtgtcctaaggctgccacaacaaagtaccacaaacttggtggcttaaaacaacagaaatgaattttctcagttctgaaagctggacgcctgagatcaaggcgaccctagtgttgccgtccttctgtgggccccctcccttgcttcttcctacttcccggatggctcctggcaatcattgaggttgttgggcttacagttgttattactctgatccatttctgactccatctttacaagactttttcctctgtttttgtcctaaattgatcaaatataaaataattaacaaataatttatctaatgatggagtagtatcacaaactaggagaaatattatgccttcaccaagccttcctcagacactttttgtgtgacctgcaatggtatattgatgatactgacataggtgggtaggctcattcaattttggaggagggtgtgagaatgctttacgtagtccttgtacgatgacagcagagaaagttttgttgtttaagaatggggactcatgtttccttctccccttgactactgcaatcagcactgttctgcattgagatattcatgtttctgtggagatggaggtggggagcagagggacagttttcctttcatgttaaaggatatttgctcacatttttttggcaacaatcaataaaagaaaggactcatttctaaaagattcgctctgaagttctcctttatgcttttacctccatttttttccagaacacagaaaagtagatagctcaaccgtggcatgcatgactatgatcaggcaagattgagttcaaaaaggaagactaaagcaatagactacaaggatatactatactcctgaacatcacatcaatacatgaaaaccatgagcaccaaaaccccctaagttctgtaaagtggttttataataactcttcaagttagatttgacattagagtaatagagctgatgttccgcatcctatccacctacctacctgcgttcacataggctaaaccatgacaaccaaaacaaggagaatatttgtacctttacatgttcctcttgattttggaacaagtcattccaaataccatcagctcaaatgactggattttctaatggctattcaaaatttatctaggttaagaattgaaaactgttatgtaaacctattataaaactcattcacttttaaagcagatagctgagaaaacaacgtagacactccatttctcacacctgatctgctcaattaccctgataatttaaggctaaagaaattcttttgacttgaatctaaagtgctaatcccagtgtttgcttcattctcatttcagagacataaactgtatatcaatgtagggtctcttttcaagatgtgaaatgcttatgcagcatttaatgtttgtaaatgtcattcttttgcataatacttagatcacatatatgatgatctttaaaattcggtgactgaagttcctgtataaaaagatttgattatcttttgaaccttgcagacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtgaaattttgttgttgtttctaatatcattaatctggctaagaattctatattagacaattttaagtaaaatagtcactcttatagcataaagtaaggctgaaaaaattagcactttgtttaaaatactaatttaaaaaataagcaaaagccttagaaaatacagaaatgccacagttttggttgagccttccatgaagaatctgtgatggtaaaattcatttggccaggacccagagaagccttgtatagtgggttgggctacggaagtggtgtcgttttttcctttttttgagacaaagtttcagtcttgttgcccaggctggagtgcagtcatgcgaactctgtctcccgggttcaagcaattctcctgcctcagcctcctgagtagctgggattacaggtgcccaccaccatgcctggctaatttttgtattttttagagatggggtttcaccgtgttgaccaggctggtcttgaacttctgacttcaggtgatccacccgcctcggcctcccaaagtgctgggattacaggcatgagccactgcgcccggtggaagtagtgtctttagaagaaacggtttgaagaaacaaaatgatgtatatcaaaatgtcttattaaaaggtaaatataatcaaaatatcatgtaatcaaaatttcttattgaaaggcaatagagaaagggagtgaattttatcctggattataaaaaatgtttctccagacaactaaactgagttggataaagtcaatgagagtgcaaatggagtgctgtgcataaagacactcaaaatttcggggtggtggagtggggcggggagaagaaagggaaggtgattgagttgaccaaaccaaattaaatacttgtttgtatctggctggggtctgaatttgtgaaatacaaacaaacaaatattttacatatttcatcatttacaaaatgctttttatacattttctcaaccatacaatgtttagcaagaaggcaggtattatttatttttactttaccaataaggaaattgaaggttagatttgcatgtccaagttctcatgtgtagtaaataatattgagagctggaaatcttgcaatatttctctttatttcctctccaaaattaatatttcagctaacttttcttctgaaacaaaaacacaagattttattctccccgatcattccttttctttgttagcctcttgggaggctagggaggtaaatatatttcagcacttatatgtaatactgtattcatttttaatcagccctgtgttttagtaagtttttataaattaattcaaagttcaattaactggccaggcacagcagctcacacctgtaatcccagcaccagcactttgggaagctgaggcaggtggatcacgtgaggccaagagttcaagaccagcctgaccaacatggcaaaaccctgtctctactaaaaatacaaaaattagccaggtgtgatggtgcatttctgtaatcccggctactcaggaggctgagttagaagaattgcttgagccgggaggtggaggttaaagtgaggcaagactgtgtcattgcactacagcctgggtgacagagagagactctgtctcaaaagaaaaaaaaatgttcaattaacttacagctataagtatgagaaaattttcttttttttttttttcctaagagatggggtcttgcttagctgcccaatctagtctcaaactcctgtgctcaagcaatcctcctacttcagcctcctgaatagctgggactactggcacataccactgcactcagtttacccgtctttaaaagcatgaaacacaacatgaacaggttgttggctccaactgttctgacagccaccatctctgcttctggtggagggctgtttaacaactggatttcagcctacactctaccagaagcccagattctggcctctctcttattaaagatacaaagccaaagatagagatttatctttagctcattaaaatgaagccaaa

SEQ ID NO: 12946 - DNA, 5464 bp, Human
ttctaggtatatgttaacacagcagtcctcaacctttttggcaccagagactggttttgtggaagacaatttttttcatggacactggggaggggtggatagtttcaggatgaaactgtttcacttcagatcatcaggcattagattctcataaagagcatgcaattgtagatccatggcatgcgcagttcacaatacggtttgagctcttctgagactctaatgccactgctgatctgacaggaggtgtagctcaggcgataatgctcacttgccctctgctcacctctttctgtgcggctggttcctaacaggccaaggtccagcagcctgggaggttggggactcctgttttaacagataagagaagtctttttagctcaacagtcatatcactaggttagcagtgctttgaaaattctctggctgtgtcctctggcattcatcctgccaagttgctttaacaattctttcctgaggccctctgaggtgagaatattgaggcaaggtgattagaagggagccagtgtcagggtcatgtggaatgtctctgaggcctgtttagaggctgtgaagcaaggctctgtttgagaccctggatacagtttggtgccaacctcacctgaacacacagaaggctacagcccctgggtggatggtgggctgaagaacggttggggaagaggcatcggaaaaccttccttttttaacccatggcacctatagattgaatggtccctggactgaacggtcttgaacaggcagcattattttcaaggtgtgcctaaggtcatacacttttcttgctttctgctctcatttggcaactatggacaaccagacctagccagcactacctcattttttctaccccaccatctacaaaccaacccttttcctttgtgaagctcagtctgtttccaatttaacatatctggcctgatctttgtcttggtgccttgttttcccctaaaaaaagacagcctttgagaaaaaaatggctgccctaaaagccattagggcctagacctgttaccaagtctagagaggcacacagctgtttgctggcctaactgggagtagggtgagcatattctctagaactggcacttttcagatcccgagatatccacagagtgtagtcaaagggccttttaaaatgtgcatgctactcttattggaagaacttggtttcacttctgggaagatggcttacttacccatgggaaacaggctcccattatgaatagtacattcatgtgctaagatgtgttgacttttcaaaaagtgtcataggacatcagagcaggggtgcttccaagaaggtgtaatatcacttatatcaccagaaaccattttggataaccagggagttctactctgccttggccttctagcaggtgcctgagcactcagtcaccaaattcagcctgagcatcttctgaataagatgctctcctccgacaaggtgggaggggggtgaaaaggggggcggggggaaaaggaaaggaatgaggactagaaagataggcctgggtccctgtatatgggagtaacttccataaaatgtggacaaggggtctctgctgcggaaaggcgtctgccctctcccttgagcgccccaaggcagagctgccttagggggccaaatgctgtatctgggccaaagcctggcctgcagggcaggtggccagaacttggaaggaattctcttccgcagcccagggtccaggcttggccccagcaagctgccctgccagcgtctgctgcctggggcctcgcgcattccgagcccccgccccctccgcccgtctcccagcctcgcccccactcttgtccccttctcctccccccaccagctgtcccctttccctggagcagcgagacagccagagcctgggaagaggcggccgcgggccggagggggcgtggtggggaaggggaggaggggcgggagtgagggaataaggaggccccgccgtcggcgcccccagccactgcgcgctcgccggagagctgggtgctaccgctgtttccgctgctgagccctgcccgccggccggcccgctcgctagctcgcttcccctcgcccagggggaaaggtcagcagcgtcctggagccgccgtgtcactccccgaaagccatgaactgcagcgagagccagcggctgcgaacccttctgagccgcctgttgctcgagctgcaccaccggggtaatgccagcggcttgggcgctggccctcgtcccagcatgggcatgggggtcgtgcctgaccctttcgtgggccgcgaggtgaccagcgccaagggcgacgacgcctatctctacatcctgctcatcatgatcttctacgcctgcttggccggaggcctcatcctggcctacacccgctcccgtaagctcgtcgaggccaaggacgagccgtcccaggcttgcgccgagcacgaatgggccccgggaggcgccctgaccgccgacgccgaggctgccgcgggctcccaggccgagggccgccgccagcttgcctccgaggggctgcctgccctcgcccagggcgctgagcgggtctaaaaccacagccccagattgctggttcgcgccctcctcatctcgctcatccctgggcgcgcctcccaccttccacccccaactcccttccagggttcgcctcatctgaggcccagataatggtgagaggccaggagaccttgtctggaaggccctggaaggagaagcaccaccttacccattcgggccagtttctccctcttcacccctgcgcctccacccctaccccgcacatccaactgcactaaactgcctctgctctcttgtcttcagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaaccgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataacgcaagactcttctctcagagattccagccttaagacccagtaccatatggagaaggaatcctttttcttttgcttttggaaatgatgtttggatttgggggttgggtggttgtgatatttatatctatgtaaccagttccaatttgatatgtgtgattatgggtgaagaaaatgtttatatggctaaatgggttgttttttcaagtgtttcaaaagttatacctactttattacttatccctccttttttcttatttctgaagcactttcaaagatcacaatgcagtctttcaggatgcactttaaaaaacctttaaggcccatcccttttagctattatcaaacctaatttttagaagccaccttaataattgtttttattttactttttttgagacagagtctcactgtgtcacccaggctggagtacagtggcacaatcaaggcttactgaagcctctgcctcctgggttcaagcgattctcctgcctcagcctcccaagtagcctcctgagtagctgggattacagatgtgccccatcatgcccagttaatttttgtatttttagtagagacggggggtttcaccatgttggccaggaggttctcaaactcctgacctcaagtgatccgcctgtctcggcctcccaaagtgctgggattacaggtgtgagccactgcacctagccaataacttttttgaagtggcttattaaaagacaaggaagccaccaaatagtgtaaatctgaagtcaaagagaaaattcttgaactgagcaatcttaaccaatgatgggtaaagttagaggtgtgtgttgtattgatttattctccttgtctcaagaaggttgtcagaaacttccctgcttacagctgaaatgcttatatctgatgatggctgtttgggcttcatcaaccacacataaaatcacctcttagaagtaagccaatttgcttaaatatagctgggttctctgataatgatagcaggacaaatatattaccagtcacttaaatgcattgataacacacaaacctcattcaaggcattgggtcttaccttccagcccatctagcattttattggaactgttaataagttaagtgaacttacttttatttccaggattcactcattgaagctatactggccttgccccattggctcttctccagtcctcgttccagccataaggtcacccctgaaggtgagggccagggattgggcagcagtccaagacgatgacagaaagagaagggaagctgtgtgagccatttcagccaggcagggaggcctggggaggatgtggaggaagggcacaatatacagcaatgctgaggacatgtgacggggcggtcttcagtcctgtattctaagtaaaacaatgtcactcatttatctggcataatggggactcaaggttattattattaattttttaaattgagacggagtcttgctctgtcacccaggctggagtgcagtgtcgtgatcttggctcactgcaacctctgcctcccaggttcaagcgatcctcttgcctcagcctcccgagtagcagggctaaagcctgcgccaccacgctggctaatttttttttttttttttttttagtagagacggggattcatcatgttggccaggctggtctcaaactcctgacctcaagtgatctgcgcaccttggcctcccaaaatgttgggattacaggcgtgagccaccacgcccggcctcaaggttattttgataatgaagcataatcactgcttcaggtgttgaaattttgtaaacacatttgtaccattttcccatagacatttaaaagaatatattgccaaaaataaaagaagctgggagcagttaggacagtgctcataatacacattaatgtgccagctgtggaaaacaaatcccatggaaaatgttcctgcttttaaaaacattttaacctttttatgatgacttagggtacccatgaagaacatgtagcgagagta

SEQ ID NO: 12947 - DNA, 53924 bp, Human
  misc_feature (1)...(53924): n = A,T,C or G
aagcagaatgcagcgagtgaccatatatgatcctatttgtgtaaaaaagtggggaaatgtacatttttgcttctttgaggcctgaaatgttttatgaagacatttacatacagaggaaatacaacattggaggaaactcagtattggttgcaagtgggatggaatgagtgcatggaagatagtgaagggaaagagatttctcattgtatgcccttttggttttaaatatgtgtatatgcttgtgtaatatgtatgaatatatattatatatttaaaataaaattaaaaagaacaaaatatccagtcctttaagcctgatcaaaagccacatcaaacaggtcttgcccttcactgatatttattatatactgccttatgtttttttttttgtttgtttgttcgtttgttttggagacagagtctaactctgtcacccaggctggagtgcagtggcatgatctcggctcactgcaacctccacctctgattctcctgcctctaagtagctgggattacagatgtccaccactatgcctggctaatttttgtatttttagtagagacgggctttcactatgttggccaggctggtctcgaactcccaacctcaagtgatctgcccaccttggcctctcaaagtgctgggattacaggcatgagccaactgcgcccggccatgtattggcttattctgccaatgtttgtgtcttgccttagtaaagtatgctcctcgagagttagaatagtgctttttacatctttatatacatacctacagtgtccacagcccagtgctttttatgtagttgaaattcataagttggtttaattctacttgttaacaatgtaatactgctttaaacttgtggagtttctgtattacttcatttatcctcaaaagaacctggtgagataggcttttatttgcaggtgacattttctatgttttcaaatgagactgtataattctggctaagcattttaactttaagcagtttgttccttatctttgtaagttagtcagtcacaacataatggctatattgaatatgagactagaggagatgatctattaggttattttcaactctgtggggatgagtaattgaatgaatgaatgaatacattttattagtacaaggaaggcaaactgaatacttggtgtatgcattttgggttcctcttttaaatgaatcccccgcccagctccccttccaccactcaacctttggctgatctggttacttatattaatattaaactattaataactggcttagttactaataatagtgacctttaattaacaatatattttcattttaatttttaaatttttgtttttattttcttttaacaatatattttcaaatggtccaatggatttatcaaacaaatttatttagctagatgaatgagtgagaaatttatgcattgcctcatactttttctttgtgtttcttcctattcctttgctttgtttagttattaaatttcacttaacaccatgctttggcattttatttccagatgttagatctgaaaatgatctaacatttcagcaaagaactgaaggatttcagttctttgtgcagtgtcttttaatagcagtgtgtatagggtggggaggaataaggaaacaaaggcattgcagagatagagcaacctgaagtcaaagagcccagatgttttctcgtcattttttgttgtcaggaaataaagaataagggcagtgcactgaatgaatgtgctgcttttacctgtaattttgtaattttctttttgaaacagggtctctcaaaatgctgggattacaggcatgagccactgtgtcctgcctaaattgtaaaatctaaaaacgtaggttctattatcaattggtcttggctatttttcatgtagggaaaaaaactgtgaatttacatgcatattctctctttgtatttgcatatggtattcttctgtgtggttctgccggtgtgttaacctgtgttcttccctatagggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtaggcaatctgagacaaaaagcctactcttgaagataataatggaagattgatgattgtttagaatgaaaatatgttgaatgctgcacatctgtgttaccgtgtttgctagttgtccacccatgtgattgaatactctgaaatattttttcaggtccgtaaaattattagagtttgcaaaggaattttggaatatcttacagtggcagaggtggtggagactatggaagatttggtcacttacacaaagaatcttgggccaggttagttttatccaatttctataacattttttaaggattgtccatgttggagccaaaggaaagggtaccctcttcctactttttgcagaagataggtgaagatgcattgggctttcaggtgtctgctctgttgatggagatgatgctgtgctttgaggtgatgtcattatctctggtatctgaatctgctttctatatattgccttgtcaaatgaattaaaccaaacattgcaaatactgctattggagaatgtaggaaatacttttctgttactgtaatgctgaaggccatcctgcatcctgacctctccattccacattacacagcattccttcactgtctgccagctggcctgtagttctttatgacctcttagcttgctaattagcctgcctactattatggattcatgccctaacccaaggctgcataatataatcagacctaggagagaagagctattgtggttaaatcttattttgaaatgattattcaggcatctgagcattaaatattcaaaatatataaacggataccagcttttgatgttacagacatataacatgaacttgagggtctttaaagtatgaatgagaccaatgacaagatatgttagatgtttaacctgcttaacttgattgttatcactttataaaattcatttgttttatgtgaaatgttgatttttaattaacagcatttttatgaggttccagtgtaggtgttctgtaaaacttaatggcagttaagaatttgagccatcactgaagatcacctggaaataggtttctctggtggctttagagtagtcctcttaaaatttctcataatactggcgaaaattatatttccccaaatggaatcttatgcagaatccccaaacaaaaaaagacaaaatggagctactttaggtgaagcaggagcagccccacctctgcttctctttggtcttgatggtctgtgagacaacttgagaaatcctaggagtaatttgaaaatcaaagctttagagaatcacatagcgcctttgaataacaaccaacataaacaaaaagtgctagcagagtgattccaaaacaccagatgctttcaaacactgtcatccctataattatttttataatatttctatttgtttctaattataaaactagtacatgcttattttggacaaattggaaagtacagacaaatagaaatatgaaaacaaaacatatcattgttattcttagaacttttttcagccactagattcagtactaggctcatgtgagatttttagcacagagttcagagacatggcatgaaacctgtatgcatagaagcctggcaaaatgtttttcccttacctgtgaatttctttttaataaatatatatttattcatttagatgtttaatatttgtgaatatatttatatcaaaatatgaaaatgtttatcacatttagtgtttacatttaatacattactttcattgaaaagagtaatgttgcataaattagagttcagtgatggtgtctgttgtttaaataagtgagcaatcggtttgaactttcatagtatttcataatggatttagactgagaaagccagacccgggattgtttcactactcaccctgcacaatttcttctttgtgccccaggaatgactaagatggccaagatgattgacgagagacagcaggagctcactcaccaggagcaccgagtgatgttggtgaactcgatgaacaccgtgaaagagttgctgccagttctcatttcaggtacttcctgcctgtactttattttataggggggaaaaatgttagcatgttctaaactctgaggttcattttgttttcttttgttttcttttcttttttttttttttgagatgaagtctcactctgttgccaggctggagtgcagtggtgcgatctcggctcactgcaacctctgcctcctgggttcaagcgattctcctgcctcagccttctgagtagcaggcactacaggtgcgcactgccatgcccagctaatttttgtattttcagtagagacggggtttcaccatgtgggccaggatggtcttgatctcttgacctcgtgatctgcctgcctcagcctcccagagtgctgggattacatgcgtgagccatggctcctggcctgaggttcattttcttttgtggcttcactgcatgtccttcagcctaggtaaaaatgagacccgattgattggttatcacatgatggctgtagctgattggctgagaaccagtcttcttctctaatgctgtccttctcctgttctttgtttgaaattgcctttctgtggcctaattctgttctcctaaagctctaacaagcccctttgctgggaggtggactctcctctataaactctagcctaggatattaaattttcacacctttgtgttatagaaaaataattaggagctggaatggatattatagagcatcatatgataaagacatgaactcagagccctttttagtgtgtattaatccaatttttcctaaaagatatttaactgttgtttacatcatgagtagatcagttctttagtcaccagctgggactaccttcccattgagtagtgctctgaaatgcaaacatggtagctgctctctcgactagcaaaagggagtagcacttattgagtgtctagtatatgccagacagctcatggtttatatgaattatcttagtcaagttgtgggttaattagttatttctcagaaggcaactttattataaaaatctggtgactcatgtcattgtgacttccagctacctgctttggtgtttcaagtagtagctaaaaaaggacatatgagtataagagttcaggaggctgggcacagtggctcactcctgtaatcccagcactttgggaggccgaggtgggtggatcacctgaggtcaggagttcgagaccagcctggccaacatggcaaaaccccgtctctactaaaaacaaaacaaaacaaaaattagccaggattggtggcagacggctataatcccagctactcaggaggttgaggcaggagaattgctcaaacccaggaggcggaggttgcagtgagccgagatcacgccgaaagtgttgggattacaggcgtgagccaccatgcccagacattatttttttcttctttatgtttgggggttggcaaatccaagctacatgttgagagaaatctcggatgataaacttgacatcttgggatcttctgctgggatcaggggcagcaggatacgccattcagagtattactgacagttttcatattgtcccattaggtttgtagtagatggagccagggtgagggccaggatgataactgatttagaaggatattagatattttgtgattgcaggtcatcagcatatgcaggttaaattagttacttaatcatgttgtgatggtgtctttgtaccttgagttttctttttctttttttatttttacaataaaggttgttaatgttggaactttattgtcaaacttgtagtgtttgttttgtatactcattttaggatcttaaaagcccaaaacatctaaagtgtagaacatcttttgtgaatattgttatacaacaagattaaattccaagcttactttctgatcttttatttttacagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggtacgtgttcttagtggagaaataagcaaaatccccaactctccctggctgggggttttgattggcacctgtctcatactttatcttgtaatttttgtagcataagagtactcagatattgtgaaagtaatttcttcttcatttctgtttcataggttacttgctatctttgctaatttcctttgttctaaggtagaacaagtaaataggcatgtggggtagatactggtttaaggctgagatttatagcttttccatcaggctggagtcttattggttggactggtggaagagtatattcccgtggatgggagctctgccttgtatatgggtggttcttcccagctgactaagtaagatacagatatgcctgtaattctgaactttatggaaaacttttctttaaccaatctttgatccagagaaatctacagaggaaactcttggcatttctagatgtgtcccttgatcattccattttccccaaggaaggtttaattaaaatattagtcttcacattggtcagttagtttgagggatcccttcaccctttttctggaatctcttttaggaccccagaggggctggcagattccttctagagcctgttagcagtggttttgtgttgctgctgctctggtctgctgctccctgtttaatgactgtgaaccaagctttcaggtctgggggaacagagatacttgggttcatactttccttgtaggagcccaagatgtaggcagtggggggaacacactgtccccaagatctagctttcccatgtgtgaccccaatgtctccagggccagccagaaggctggtagtcaactaaagaagggattttgttgtatgacttccattgggtgctcagtagaacggtatgttctccgggatctgtaaggtaatgtaaaagctggggcctgaaatcaccagccctctctcttgttgccctgaaagctaatttaattatatagagtaagttagcttattttaactatggatttatttacagagacattttctcattgatgtgaagttcttgaatagattctaagactgtattttaaatctatatggtaaaatctttttaactctgatattttatttaattttgcttttgcatagttgacaactttcacttccctgttatgacttctttatgcatctttttttgttcttttgttttattctttttctcacgtttagaaggtaagctttctcttgccctctagtttctttttcgcttaaaaagagaaaagcatgtctgtgaggtttttttgtgctgtgtgccgtgccttattctgtgtataacactgtgcttgaatgtgcgtcagaatgtgatttaatacgggactctaggcagtgctggggagactgactgtggctcatattgagtgatttctttgggaaaagctaaaggaaagacattactgtgggctatcaggctgcctatatttggtgggtgccttcatttctttgggtaggctcctgggatcttttttggcctggtctttcccattgacttcatttgaggagcaggattccccaggtagctgggagacccctgagttacctgtggaccctgctgttgggaaaggagacttccagctgatgctatctctgtacctgcctctcccaccagtcttctttgcgggctctgaaattttgcttttggagatgcatcattgaggttttaagccataatgaaagagggtaggctagagagcttagatgaggcacctgtccttcataataatcctagccttcaaaatccaaaggaaaacagaagtgaagtgtgtctaaaggtcttcctaacttcattctgtggctcactgcatgttttgctgtccaaactgaattagctgtagttctccatgacctcatgttcccctaacccaagctcttcgcttattctctttcttttgcttctagcagatgacaaaaagtaataaggaggaacaggcattttaaccttaatgtttctctattttcagaagggaaaagctatccatcatttagtgaataaatgttattgaactttattttgtgcaagtgccatcaagagctgcttctctcattaaaaaaatgtagtcagttgagttttcagggctaggattaggcacttggggatacaagtgaaatagacctggtactcaccgtgtacagtcttgtagctgctcccagttttatgctgaggaaaaccaatttgttaggatgctacaaaactaacttcatctgaaatgaaagaaggtaaattaaattagctcaactcaagtacacgatgacatcagaatgaacaagagatgtttatgttttaatctactgaccataagaatgaaaaagagatgcttattttttaacctaatgacatcagaataaaaaaagaggtttatttttaacctaattttgcttttgttttacatttatgtggttcaaatatcaaagtgctgcaaaaagatatacctgataagtcttcctcctaacctggttcccatccactctaccgctcctcaccctctaagagtaatcatttctattggttaccaaaatagaaaaaaattttaccctgaaaatagaaattggtagctaggattttggctctttttcagttttgtagcattacgcatctttcattgctccactgtaagcagtgaattaatcagaccttttgtctgactgtgactgctgggttcccattctgtttaatgcatacagtgtctttcacctcttctcgcccctaccaataaataattaactttgtcttaccatacttgtttcatgcctccccattggtgcagtattcttctggaaagtgatgattcctctagaaaagtgggggaagaaagtaagtggaaaaaattcttggtaaaagtgcgtcttgccgaataagttaagattttaaagaggcaatgcaataactgattattttaccttttatacctatattcaaattgcacatttacaaatttaaaagtaactttgactttaaacacttcacttattttaaaagtaaaaagtttccttttcttaaatcaacaatcattttatagtgatcattaaaaattaggttagcatttttttctgaaaatacattatttattaaaagaatttgagttaaacacaattctaattctaccctttgtaaatttagtgctctacatttaatttttttggtatttatattacttgtatcttgatgcatgctgagaattaagaggaagtgagataaaaaattaaaaaaaaatttcactgctaagactttgaaccctacataggcactcctgcagctttgcaccgtgaatcattaaattctattattcagaattagttcctgtggtgggtctctccccactgtggtcctgggctggtggtgggtaaaagtagtaagtgactcagatgccttatacagaagattagcaaacttaactaaggcaggaaatgttggttagaacttgtgagtgtgtaatactacccccttacttgcagaccactgggatttaagagttgatttgttaaattaaaaaaaggtcatttgtgggctttctatgagcaagtgttctagtgttttgtttttagcagctaatagaatgaaagatctctaagagcttgagagaaatagttaattcaggcatttatgatattttatctccctgctccccatgaggagaaaatcccaaaataaattgatgtttcccttctgatctaagttatctttggctagtacatctgatcatgcactcataggtagcatagatttttagagccaggaaggtattcttagagatgaggaattgagacccagagaaggtaacttgcatgaagtctcaggactagacaactttctcttgtttaaatgtagtttgtaagattttgttctactgcccaatctatactttccagaaacatcttaaaccagaaacatctggtttaaaacattgacttgcaggtggaaatgaggttagaaaggggatggagtgggaagacaggtgttggtggagggagaagggagagtatggtgggcagtcatggagagaggttcttattccccatatttaaaattttcaagagcctaggattgcaggactttacttttttaaccgaagttcctcttgattgtccatagaaggaggtcattattattcacaggtgttctgaggcctaaatctatgtttaatttaaggagtgtttcagttcctaggaaagcacgtacaaatggtttagcttgtcgttccatcttttggtatgcagggaagagtgccaaggcactgtatttttttcatttaaaacatgaattcataagaattttatgttaagaaggagcataacatggtgggggaggacccagatagattcaggccagctgtccccaaagccacatgactagacctggtctttttatacttcactctttcaacacccacaaaccccctgaaaaacaaaccaaaaacagataagaaattggtagagacttttctttttcccaaagttgagcttttacagagaagaatactcaaatgaaggtgcagtttttctctcttctatttcatatctgaattatactgacctgaaatatacagacctacatgacaaggtttagcaaaatggtttgtggtacaaagcatggctgaccacaagggttacgattattttcaccctttataaatatatccccaaattgacttctgtcctagttgtccagtgaatttgtttatgtcatattcattgtttgtatacttacatgcttatgacagaattctgtcaattctataataaatattgcctttcaaaagaaatatatatgaaagtcttaggagaaaaaaattcccttagacatgtttgtttttactagatatgactaacataaaatggttacttataacctactgttttccagaaagaatttaagatggctctttcagttattgttttaaatctctgaaattgtctaaaattaatgctgttaaaaattttggtaacttattgaaagtcgcagttattaaatgcagcttcattcaaaattggctattggttccttttaggggaaaatgaacatctcttaattttaacttcttgacggtgtcacacctcccactgagcagtaaattactcacttcctgagaattacattctttccttgcagtactggccattagagctttattaaggagaaaaaaagaaatgatttttgaggatgctgaatagacaaaaactattttttccattgtgtttcaaatcatttttgggcattggagaataaaagcagtcatttttgttagtgtagattatgaatttgatttctggagcttattttctctgcagtattaaccaaagtcaaaactgacaaggcagagatttgctgactattgttggagattagtagaatctttagcaactctccttggtaaaagaaaaaaaaatcttgtttcatttgataagcaatgaggtttggagtcaacaaacctgagatcaaattaggtttgtaggagtcagttcctgtttcttaatttgtagtattatttaaatgacatttaaatttgagattcaatgaggtaaggagggggaaagtagctaaaacagaacctaacatgcagggaatgcatattaaattcaatgcatgtcagttgaatttagtttcctaactagtagcctttaatgttagagtagacataaaaatttctgaccttcgtttccctttgaatttagatttttgaaatgtaataaatacctattgcttttctcactgaaaataaaagtgtgttaggaaaatggtttaacaggttttaagtgaaatatttttacattgacataattattctccaggatgtccacacacttcctaagtaagagtttgtgattaaaagaaaacctatgcctagataacttgtgttagatcctgaaggctacccagttctctgaggttaggagttgcctggcctcaagtcttttaaaaagttattgattcaggccttgctaatttggaattaagctaaagttgacctttgcattaattttgaaggcaacgttttctgcacaaattaatttaagacatgataggagagatttgctgatattcaaaccatttgagaatcaaagcacttaaaaataccacatatcttcttctaattacaagtggattttgaaatagatcctcttatgattctgccttttattgacagctaccatggttacatataacttgataataaaaatattttgttttcaatttttttggtaatttagttcacttctttttcattgctatagctgagaatttgctatttagagccttagatagccaaggattcaacaggagaatcatctgtgtctgtttagaaggggaaggagggattccgacagttgagagatctgtcttttgaatagggggctttggaacagttgtggaccttgagcctaactatgggtgctgccaatgcttatttgtgatagtgctgtatctttttttgaattggaagtggggatgctcctggtgcccccgtgtggaaaactagtggtgcaacacctttaagaaccccagttgtgcaggattggaaactgaaggaagctaggacattgcctagaattttagaggttaactttgtgctttgatggcttaactctgtaagagtcagtttcctacagcaaaaaggaggatagatggtctttgaagatgctaaatagagacttaagagatggctggtgttatattgttctctgtgtttttatgtgtttaaaaaaatttacggaaatacttaaatacatttaaagtgattagtctgttgtttcagcttctcctgatgtatcctgggagattttatgctagtttcctgatagtcctcgtgaatcctggttgtaaaaaataagctgagacccatttattctatcctgcatcttcttccaggtgagggatagtaagggaactaagaaggaggaatagcagggaaggtcagaaaacacttctaaattatattactttgaggggtttatttgtagaattaaaattaaactgctagattaacattttcaattgtttcttccaaccagtaattccaagtttttcaggttaattgaatatagtgaaatatcatccagtgtgtgcatttcaaaacaagatgtaaaagaactgtgatttgtggcaccacatactaacgaggcttccctgaggtgggaagggctttggcaaggctgcagtagatgaatgttgactagtggaaaggctgacaatgaggcatgtgacaacagggctttttcctgctgaagacattaaacatattctggcttgagcaattttaccagttttcacagttttagcaatagggaacccaattccactctgtttagcaacagagtagaattaactgaatatttgcatgcaagatgctgcattttgacagaaatgagaattgtggtgtggtgacaatatttttaaggccttcgtaggactgactaccttagctatgtatgttaatgctgtaacttcttctctgtcttacgttctatcatggtatctcaacttttgcaaagaaaataatggtgggatttcttcccaaaaggacactgaagccatgaagagagcattggcctccatagactccaaactgaaccaggccaaaggttggctccgtgaccctagtgcctccccaggtaaccctctagttctgcttttctgatcaatacaacgagaagctaaaaaccaagcaaatgaaagaaagaaattttcccataatctcatcatctgagagaactactgtaacattatggggcataccccattatctgatagttctgagtaactgaagcaagtagtaggccttacaaggatgaagggaatagattcgatcacctctaatcacggaggagtaagtcatactgagctgggcattctttgcaaaatttttggttctccccttccctgaatccaaaaggtaattattttgaatgaaagttcttctcttccagttcccattgagcagacttccatttatgtcaacagagttcttaattaagcagattaaatcatgatgccaatgagaattggaaagttgactgtataaagataagacccaaataggttattgaactaggctttattgattttctaatctaatatttattctgttttagattaatatttgaatgaatgtgaaaaacctaaagtaggttggaggtgctaaatactattaaattgttagagtctgttttcatcatccatattcttaccacaagctacttagtatctccaaatagatacagttccaagtatctttttttgcgtgtctgttgttgaaacctcaccctatggtttaagggcactgcttggctgttagctatcagatatgttgccttctattcactcgtcttgtttaaaatcatccattccttggtgaatgaaatgacttgtaaagtatcctctctaaataatgaatgtgtcaacaatgtagatattgaatatctctttattttaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccaggtaaaagttcctctgtccttacagagcagtagtgggtaactcactcctaacagggtgattcagaaaacaagcctctgccagttttgagttatctctttggctagtagataacagagatattatagtctattaaattcttttgagatggaggtgaactttccctttgctgactttatttatttatttattattttttgagacagagtctcactctgttacccagactggagtgcggtggtgcgatcttggctcactgcaacctccacctcccaggttcaagagattctcctgcctcagcctcccgggtagctgggattataggcgcccgccatcacacctggctaattttgtttgtttgtttgtttgtttgtttgagatggagtcttactctgttgccaggctggagtgcagtggcgcgatcttgggtcactgcaacctccagctccgtggttcaagcagttctctgcctcaacctcccgagtagctgggattataggcgcccgccaccacgaccagctaatttttgtatttttagtacagacggggtttcaccatcttggccaggctggtcttgaactcctgacctcgtgatccaccctccttggcctcccaaagtgctgggattacaggagtgagccactgtgcccggccacacctggctaatttttgtatttttagtagagatggggttttgccaggttggccaggttgggctgggattacaggtgtgagccaccatgcctggcctgactttatttaaaacatgtttttatttatttatttatttatttatttagagacggagtctcgctctgtcacccgggctggcatgcagtggtgcaatctcggctcactgcaacccctgcctcccaggctcaagcaattctcctgccttaacctcccaagtagctgggattacaggcatgggctgccacacctggctaattttttataattttagtagagacagggttttaccttgttggccaggctggtctcaaactctcaggtgatccacctgccttggcttccaaaagtgctgggattacaggcgtgagccaccatgacctgccaaattttttctttttctttttctttttcttttttatttttttgagatgggagtttcgctcttgttgcccaggctggagtgcaatggcgcgatctcggctcactgcaaccttcgcctcctgggttcaagtgattctcctgcctcagcctcctgagtagctaggattacaggaatgcgccaccatgcccggctaagtttgtatttttagtagagacggggtttctccatgttggtcaggctggtctcaaacttccggcctcaggtgatccacctgccttggcctcccaaagtgctgggattataggtgtgagccaccatgcccggccaaattttttatttttaatgacatggccttgctctgtcacccaggctcaagtgcagtggtatgatcatagttcactgtaactttgaactcctgggctcaagcaatgttccttcttcagcctcctgagtagatagaactataggcatgtgccactatgcttggctagtttttcaatattttgtagagataaggtcttgctatgttttgtggtctcaaactcctggcctcaagtgatcctctcaaaagtgttgagattaaaggcgtgagccaccactcctggcttgaacttttaaaatacacaaatgcctaatagtaaagttgaaacttgttccgtaattgaaactgaaacacaaatctagtttctaatttactagccataggcttatgaaaaataaaggggcagtggtgaagtctggcatgggtaaatacattttacggaggatggggagaaagaaacatagcgtgaaaacattggaattatttcacctcataaaaaaatcatttaactaggttatcctctaagttggtaatttctgggcttttttgagtttccttttcatgattatttattcggattcataattatttaccttccttttaccctcctaaagccttggcctttagagcttttctccccataaactaaataaacatagtttgctattgagaaaactcaatataatataaatttgtttggaattcatacagatgaactcatccatagtgataatgaagttctaaaagatttttatagaattttatggtatggacattacgaaaacttggaataggatgagacactcatgaaacatcatgagataattaggatacacagggtctacatacaaacagggctcagaaacactcctctacatgcagtgcaccattatacctggtctccaatattagtgcaatagacataagaatgcagatcttatttatttatttttattttattttattttatttttttgagacaagagttttgctcttattgcccaggctggagtgcaatagcatgatcttggctcactgtaacttccgcctcctgggttcaaggcattctcctgcctcagcctcttgagtacctgggattacaggcatgcgccaccatgcctggctaatttttgtattttaatagagacggggtttcaccatgttgatcaggctggtcttgaactcctgacctcaggtgatccgcctgctgcggcctcccaaagtgctgggattacgggtgtgagccactgtgcctggccaagaatgcggatcttaaaggcgtggttcttaaccttttgtggaccaagatcacttctatcatctgatgaaaacattcatccttacctaaaaagatgcatataaacatgcccatacaatattatgtataatttctagaggttcctggattccctgcagccctggaagctccaggactttcaggttgcgtctctatgttgaaggggaaagaaacagcttaaataaatgtgatcccattgagttcagtgaatcttttctcctgctgagaagcagtctcctctgtcatgagcatggtaagaactttgcaaaaaggacaaaaagaagttttgttctcattcggagaaatgccagtgcagtttgataggattcttggctcttctgatttctcacttttgtgtcttttgtctgcaaccttttcccagtgtggtagccagttttcacttggaattctcaaatacacagttgtatgtgtttagagaaagatgagtatgagcaagagaatgaggtagttattgtaggggttccaccattaatctgtaaagagaaaaggctagaacagtgaagggtaactatggtcctgcttcacagtggagcctgcaatatcctttcctgatgaaagattagaaagttatctccctgtagtcctttcttaagtgtacccagctgtttaatattttagtggctgaaatgcggtaacaatttcttcttgatattctgttcagtcacacagggtttctaggttgctagtatatatttttacccccatgagactcaataaaatctttctgttttgaatgaaaaaactgtgtagcccataaatagttttactttttcacagttggactcttttttaaaaaaaaaatttctaaatttccagcctcagagaagttattattttgtaatatacagttggactcttttaacaaaaagatctctcatcatgaagtagtagatttgaagaaaaaaagcacattaaatcctaaagactatgtttcctaaaagtcttcccctcttctgccacataaaaggaaggcctcaacttcaaggaaaaagtgtatatataccttttatatacccggcaataaatgaatgattcattacctcaagttttggtatagatgaaaaacagaataattttatttatttatttatttatttttttttttaggtttttcttttttttttttttttctttttttgagacggagtctcgctctgtcgcccaggctggagtgcagtggcgtgatctcggctcactgcaagctctgcctcccgggttcacaccattctcctgcctcagcctaccgagtagctgggactactaggcgcctgccaccacgcctggctaattttttttttttttttttttggatttttagcacccccccccccccccccccccccccccccccccccccccccccccccctccccatccctccactttacgcctcctcacagcccccactcccacaccccccttccacccacccccccccctcccactcacccctctcccctcccacccaactccctccattcctcacctcactcatcccactccaccaccccacctcatctacccacttcctcaccccttccacactcatcccatctctccaccatcccactcaatcccaccttccactcccccacctccaccagcaaccacctctcactttacaccacttcttctctctctcacctcacactacctacctcccatcaaccctcgnnnnnnnnnnnnnnnnnnnnagctggaggtcaaggctacagtaagcagggactgcgccaatgcactccagcctaggcaaaagagcaagaccctgtacttaaaaaaaaaaaagaaagtgaaaaataatcagataggggcttttaccagaagtactgcacataatgtagtagcaaaagcatggtatatagcagattttcaataaatgttagaaggaataaatagcaagaggtagaggtacatagggtaataattggcttaaagtaaggcattatgagttctgatttacatgtttggcagacctcaactagtggttatgaaaattatatgtaacctatgggcaaaataaacagatttatgggccaggtgcagtggctcacgcctgtaatcccagccctttgggaggccaaggcaggtggatcacttgaggttaggagcttgagaccagcctggccaacattgtgaaaccccgtctctactaaaaatacaaaaaattagccaggcatggtggcacatgcctgtaatctcagctactcgggaggccgaggcaggagaattgcttgaactacttgagaggctgaggtaggagaattttggctcattgcaaccactgcctcccaagatcgcgccacttcattccagcctggaaaacagtgagactccgtctcaaaaaaaataaaaaaacccacagaggctagatagatgaatgacagatcaatactattatgaagggaagcaaaggtgttttggagtttatcctaaaaatagaagttctgattaggataatcagccatgccattctaccaaatggtaaagttactgcccctatcattgagtttaccagcctgcttggattaaaacaatctggattgtaaaatgagggcaaatcatactttgtgacttggaaagtaaataaggaaaacaagtaaatagggaaagtaaatagagaaacaagtttccatgaactcatatcatttttagtagtaatagcatatcatttctgagagaggaaaatagtgaaatcagttctttaggaacttgatgggaaacagtggtttcctatcaccatgtgctcagtattagctagtttcgattatttatatatttataggttgcctaggaggaaggtaggcatttaagattatcattaggttcattataaaaatgatgataattcagtaataatgatagatttttattgccagtgttttcaagtatattattttgatgcttgaagccactccataagataagtggggaaaatgtattacctaccttcattatatgttaccttcactatataagttagaaaatggaaacccagggaggttaaacatcataaacaaggttccacaggtaccaagagtcaagatttgaacacagatctgcttgttcccagtctggtacactttcattaacactatgcatgcttcctcctgaaacattttcaatgtatacttgcccataagaagacaatttaatggactatttatttcagaagcacacattactatggtaacaaagccctccctagcaataagatcaccagcacattttcccactgaagtttagattggattatgtaatcactaccaagaggagaataattatcaaaatttgctggcctggtcttcaaagtggttatgcagttccgtgaagctaatgtgcatttttaaaagaaaaagtacttgatttgggcgtcttgctttgtttatgtctgttttcttgtgctgtcccagatttactgggaaaaaggaaaaagccaagcatgttcatgaaaaccacatgtactgtgctattgggaatattttgtcattaagtatttgagggtgtacaatgacagcatgtgtctgttttgagcagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcaggtagtcacagtgattttcaggaggggtgggaaatatttcataaatatcctaagtcataaatatcctatctttcttctctgtctcttatcatttactgtggttggataatggtttctaagtgatgagtgacttccagcacttaccaatgttaacacctcctttaccaccacaggtttagacaaatgtttatctatattttgaaataaagatcttaatttacagcacttcagttaggtaaaagtaagctctcagagtaccaagggaagattgcagtacattggaactattccttgtcccagaattcacaactcttgggtcattgtaatgtttaggggttaaagttttccgatactgctctactgtaaaatgattttcaagcatttcacaaacacacatgtttgaggaactgaggaactaataaggtgtggttaattcagagatgagataaagcttgggaaaatattttatgctaatgggtgtaaaaaaattgattttaaaaagatgagagattgagtttcttatctaagaacctccatacaataataaagatcagaattataaaaatgattactggtatattacttttgaaatccttcttctggccttgttaagtttagtagaaaggagtgtgtgagtagatcacagcgtgctgcttctccgtttctatgtgtagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacagtatgtatttaacccttacattgccttttcatatcttttcttctctttctctctcccttccctctccctttctttctttcttcccccaagaacatacatatttcaattcccctaggttaaatgcacttatgatgctcttccactatattctcattaattctaggtcagatgttaatttgctgtatcagtgatgtaactgaggtttaatgatttattgctggtcacatagttataaattgataaatttaggatgctaagaactccttttttgagatgctttttaaatttctaagctagggctttctttgatacatcatgtttatgacctatctgtttcccatacataagaggaaaataatttttgtggctagctatgaaaagactcctatgtgtatatggaggggaagaagcgtaagaatgtactttcctccttccccagcaatgatattttgtaagtagcaagtataggagatacttaaattacatttcctggatgatttttcttgtaacaacagcctccccacagcctcctctcctaaagtctctcatggcacctactttgatgatatggaaaaggggtatttcctctttttttttttattttttatttttatttttttgagatagggtctcactctaccacccacgctggagtgcagcggcatgactatgcctcactgcagctttgaactcccaggctcaagccatccttccacctcagcctccggagtagctgggactacaggcacgtgccaccatgcctggctaatttttttattttttgtagagacggggtgttgctatgttgtcagggctggtctcaaactcaagggctcaagctatcctcccacttcagctttccaaagttttgggattacaggcatgagccactgcacctaactgctttcttctttcaatagatatttttcacttttaagaaaaaaacccctgcagcacatgctaaaataacactaaggaagggtttaatgtcaaatgtaaaagttgctctctatactcttaggacctaatggaagtccatatacatactaggtactctttaatgtttcttaatgatgaagaggtaatgaatggtaatggtgctaacagcagaccttcatgtgtggtcattcatgccatcattacttaatactatagcacacacataaacatacatctatgtaacctcttgccaggagtagccacgatcagaatcatgttaaagaccctctttgttcacctttataaaggagaatgttataaaaatttagaatcataaaggaactcttaagagaatatctaagctgggcatggtagctcaggcctgtaatcccaacacttggtgaggctgagggcgtgtggatcacttgaggtcaggaattcaagaccagcctgccagcctggccaacatggtgaaaccctgtctctactaaaaaaaatacaaaaattagccaggcctggtggtgggtgtgtaatcctagctactcagaggctgaggcaagagaatagcttgaacccaggaagtggaggttgcattgagctgagattgtgccgctgcactccagcctgggtgacagagtgagactctgtctcagcaaaaaaaaaaaaaaaaaaaaaaagaaaagaaaagaaaaaaaagagagagacagagtatctaaattagctgttctggcgcggatgggctattatttttatttatgtatgtattttatttatttatttatttatttttgagacggagtcttgctctgctgccaggctggagtgcagtggcgtgatcttggctcactgcatcctccgcttgccaagttcaagtgattctcctgcctcagcctcccgagtagctgggactacaggcgcacaccaccacgcccagctaaatttttgtatttttagtagagatggggtttcaccatgttgtccaggatggtcttgatctcttgacctcgtgatccacccacctcagcctcccaagtcctgggattacaggtgtgagccaccacacctggcctattatttttatttttacagatgagacagataaagttagcctgaaagttacctttctatggctgagaggacctgagatggaaaatgagtcagattctttgtatttttataatggttagaatttgaagtctttggaataaggtgttgggggcagtttttttctttgtgatataattgtggttgtctttttatttctgtgttgatacttggttgaggttctttggttggaaggacctggtcaagtaaaaagtagaggattattgaaaatagaggcacctcatcaaacccaatagcttgaatgtggccagatcttgggcaactggaagcccctccctccacctcttagtcgctgtgtgggatcctctatgtctgtttcaccctgtgtgttgacttagtttatttatctgggggttttgtctctggctgtgagctaccacggcccaggcttaatcactttccagctccagataccatcactggttgactatgcagtgtttttgaaatatggacccaggattatctgcctaagaatcatctgagaaggtcgttaaaaatgcagaccccttgaccccaccgcagacatacttaattggaatcgcttttgatggtgggtttaacaatctgtatttaaaaataagatctccagtgacttttatccacactggactttgagaacccccagaatctaattgagtgccttgcctgactgtgggtatgttgtccttgaggtagataaccacccagtttaatcagttatggcaaggactggggattatgtgataccaaatgtatagtagtttatgaatgaaggctgggcacggtggctcacgcctgtaatcctagcactttgggaggctgacgtgggcacatcacccgaggtcaggagttcgagaccagcccggtcaacatggtgaaaacccgtttctactaaaaatagagaaattagctgggtgtggtggtgggcatctataatcctagctactcaggaggctgagacaagagaatggcttgaacccgagaggcagaggttgcagtgagccgagatcgtgccactgcactccagcctgggcaacacagcgagactccatctcaaaacaaaacaaacaaaaaaaagtgtggcgactctgaagtcacggtgctgggtttgaatcctgactctatcaaagtaaataatgggacattgggcaagttatccaacctcatacctccattttgtttctttaataatgaggataatactgttatttacatcatagggttgttgtaaggattaaataatataaggcaactgcttatggctgggtgtggtaggtcatgcctataatcccagcacaggactctgggaggcccaggtggtaggatcacttaaacccaggagttaaggaccagcttgggaaacatcgggagaatgtttcctatctccacgaaatatttttttttttaattagccaggtgtggtggtgcatacctatagtcccagctacctgaaaggctgaggcaggaggattgctgcagtgagccctgggaggtcaagcctgctgtgagccatgatctcaccactgcattccagccagggtgatggagcaaaacccctctcaaaacaaaaaacaaacaacaacaaaaaattgcttgtaacagtacctggcagaattaggactcaaaagatagtattactactagtttgactataactgtttcagctgctcctacaacaaacatggctgcctgggcccacccagttccagaggaaactggtgttttcagaggtggcaggcagagggtgccgctaacctagtgatgattgattgagctccgctaaccaaatgattgatctgagctttactgatgcaaactcatatttaatgtcttaactaggacaaaataatctgaatgtaaattattaatttcttatgtaagggccaaataaataaaccactcctttcaaaccaaattaatagtaatcaggagcaatttgtcatcctattagcatttgtcattagcagctaagtgatctcaatgtaaatagtgtttatgtgtgacaggatggctgtctttttctctgtagggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtaagggcagcagtgcactataacctcattaaattggtctcagtgcaaataagcaagttgttgataggggtcctgtaacatctgtaattaggtaagggttctttagctgctgataagtaactgtgattccatttccaaatgcagccagtaaaattcctgtgatgtaatcaagaagcagaccaggcatggtggctcatgtttgtaatccaagtgctttgggaggctaaggtgggaggatcacttgcgcccaggagtttgagaccagccaagcaacatagcaagaccctctctgtacaaaaataaaagagtaaagaattggctgggcatagtgatgctcacctgtagtcacacctttccagctacttgggaggctgaggtgggaggatcgcttgagaccaggagttccagtctgtagtgagctatgatcacaccactgcattctaacctcagtgacagagagagaccatgtctctttaaaaacaaaacaaaaaagaacaaaattctaagttagttatgcccagtgttgtgaggagttggagaattgggcacatatataatttactggagaaataaattagtacaaactttctaaatttggtattagatgtcaagagctttaaacaaagttcatacccattgactcaggaaattaagggtttcttccctaagaaataattagagatctttctaagaagttgcatacaggaatatatgcatacagcataaatgtttaataataactgacttgtgaaataattattgttaatatgataaaatattacatagattttagatcatgattttaaaagatagtgaaataaaaataaagtgttaaataaaaagaactggctgggtgcggtggctcatccctgtaatcccagcactttgggaggccgaggtgggtggatcgcctgaactcaggggtttgagaccagcctgggcaacatagtgagaccctgtctctctaaaaaaaaccaattagccaggtatggtggtgcacacttgtagttccagctacttgagaggctgtggtgggagggattgcttgagccggcaggtcaaggctgcaatgagctgttgttccactgcactccagcttgggtgatagagcaagacgccacatcgcaccacagaatggcattgcaattgtctcctctgggtcttgtaagtttcattgtttttctcttggtccaggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggtagaagtcaggagcacatatcattttactttttatgcttcctattattgaaagacgagggaaggaagagagagttttgaaaaatacataatttctggggtctagggaaaatgaaaagagtgtgaccaaagatataaggaaatctagagcttattaggaaaaagcttgctggtatatagtagcaactaaatttgtgttttccaaattccactcagtcaagagcccttttgtgatttttgctctatccacatatcatctgtacttttatttagccaatatttttcttaaaatggacttctttttttttttttttaaatggacttctttttaaaacttaaatttatttaagagaaaactctgtgggccgggcatggtggtacatgcctgtaatctcagctacttgggaggctgaggtgggagaatcacctgaacctgggaggcagaggttgaagatcacgtcactgcactccagcctgggtgacagagcgagactccatttcaaataaataaataaataaataaatgaaagaaaactttgtaatcctgaaatcttgggtttgataagctagttgtattttttctattatcctttaaaagaaacacataattattaaaataaaaacatttgcccatgtaacacctaaaattatctcaggtatcaccagctagtttatgctgcccaccttgcaaaacaatgagggtgatggagacttctttgtatatatccagaaaacttaaattggattaaatgtgatgactatgaaaaagagcttgttcatggcttctaagaatactcttatttagacccatgttgagaaattgatacagatatttgttattgagtttttctagaaaacttaattgaaagaacctggattaaaaaattcccattcttgatttctttcctcttaagacaataaattgcttagaatttggcactacatccaccaaacaatccttacagttactgtgatcgttatcaggccccgccagcactggcaatggtgtggaactctagcccatctctgggccttctttgggctcaacctcatgattctcagtatcatttcatggaggccaccaaaaaaggaagtagggttccttgattgagtggaacagtctctagggacatgtgggtcatgtcttatttctactacaccactaatgtcttacagggcaggattcataaattacacctgttctgtgctagctcagtgctttgtacacagttaacaaatatttattgaatgaaagactgaatagatgaatgaatgtcagtgaagtaagggcattagtagatatgctttgaggatgtatctggacattttcatatgtaaacaatgtttttaaggatctaaaagctcggatgcaggaggccatgactcaggaagtgtcagatgttttcagcgataccacaactcccatcaagctgttggcagtggcagccacggcgcctcctgatgcgcctaacagggaagaggtgggtatctgaggtcttccatttttctgtcagcctgtgctataggtatatgtaaaggtgaaatgtgattacagtggacatcaggatcagtggttgggaaactgtagatgaagggtggaagagcagaacagggaaagccctaccacctctacttttagtctccacgtatatcagtgaggaatatctttagttgcaagcaatagaagacctgaccatcagagatgaaaacaaccgggtttgttttcatcacaaaccaagaaacatggaagtaggtggctttggcattggttcagcagctaaatatcatgaaagctggcatttctatgattttctaggtcattttctcagggtgtgggatggcatcatgttaaatgcaggaagaaatgaagaatgggggtactccagtcacaactgtgcctttcgagtcaggatgatctttttaaatcaatcgatgtcattcttatactcagacccttccaatgactccccgctatcccagagtaaaaccagagtgctaacaatgaagaaaattgccagcgatgtgctggtaagccaactctccaggaaaacgaaaaaccttgatttgtaatgtttgttgatttccattatgtaaatactcccacggtggctgtttcaacatgaagtcactgaaacctgagttgggaagagatggacatgtttcgctcctgtgagctggcacgagtcggtacaggtggctttagcacaccactggatctggtccccatccatttctttgctctcgtgtggtaccactcttccccctcatgctacatctgtatgtacctcccttgaattgtattcctagtgtgtatttatatgttctaatcttggggcctttgcactcgtttgttccagtcttctccagataaccatatctattagttactgtctttcttcagctttctactgaaatgtcactttcgggtgaccactaagataacaccaccaccccaactactatccccatggatttcttcatctccatatcctactttttcacttagcatttatcaacatttaatgtatttacccatttttcatttttggtttgtctgtctccctcccactaccatgaaagctccatgcagggagggactttattctgtcattgccttattcccccttcttggaacagtgcctgccacattgttggtgctgaatgagtgaaaatagaggctttcttagaaattgtccaggagagctttgctatgcctcattggcttgaactctgtctcatggccaccctagctgcaaaggagtttaggaaagcaagtatttggttttccagcctttatagtattggcagcgaatgagaaggggtttgggtcaggtacccaagacagtgtagaactggtaggtggaggtttttgttattatgtgctgattaccccagttttctttctgtaacctgagttactaggcagttcagctgattgttcccttaggctgagatgatttgctatttttttaattccagacttctctttcaggctagtagatacatctaggtgggcctctccacctacagtcttcctagttacctcagcatatgttgtccttctgttctctctcagaaatttgtgagttgtcattgacttttcccttccccacacccgttcatacaaataaacaactaaggcacactcatttaatctcacatccattttctgttcatattgccagagctctaattattttcctagtcccctagtccccctagagctatgactgcatagctctaactggtcttctttgactctttcactaggccatcaatcaaataaaaatacaacctgactctgacattctcctgcttaaacccttcagtggggcctgtactttcacagaggataaggccagggctctgtgatctagctctgacacttcccatacctgtttcctacaaacccctccctctcatttctggccctagctatacctagttgcttgtggtttcctgcacagtctgtcttttccatgtctttgttttttctgtgtaattatcttccccttcttttttggtgaattactatttatccttcatcctattatcctttgtttcctagagaggttaagtgctttttcttttgctcctacctatagtatcagtgcttagctctattattgtacatagcacactgtattgtaaatctgttttcgagtgcttttttctcactgggctgtgagttccttgagatgaggatattgtgttttactcatttttgtgtcctcagcacctgtctcagggtctggcacatagtaggtgctcagtaaattttggttgagtgacgagaaaagcaagttaagcagttagttaaatcagaaggagcagcagtcatggtctggcattgagatggtcaaccaaggatattaggtaggtaaaagcccaggagatccagagtgtgggagaccagctagggtaaaagaactgaggccacgggaaggaggctaggagatcagggattttaggcagagattctcagcattaaatggcaggaacccatgtagttaaatccaaacaagaggctggcgtggggaagagacttgagaagatagacacagaacactggcaatgatttggaacctgctattgaaccaagagacctttagagattgtctagagccagaactgatctccaagttaggcagaagttgacaaaaaagaggacgcattccactaggcagctccagacatgttcgtgtagtgtataaacctgacccagtgctgttgggaagcatcagttctaataatgcagtaagtaagtaactgaatgtgaagactaaataaaccccattctccaaagcttatcttctagtttgaagaagataagcttttgcaagaatctattctaacaaatgaccaaagatctcttgctactttaagtttaatagtcccctccacagtatgcaaccttgcacagtatccctgttaaaggaaacattaacttttttagaatttgagagctgaatgaacaattaagtagatgattttgcatttggggttaataaaagtcagtcatccttgccctgaggcctgagtgtgagcaccagctatcatttttcccttggaggtcaatggcagagtttttacaacattaatggtaatgggatatatgaaggatgctgctctggggagcctggagctcaatttaggactgtgtggatgttctgggcttttaatgtacccagctgcctacaatagagcctggagtgggcttgactgtcttcttcaaactagaagataagcttttgagaatgggggttgtttagtcttcacattcagcaaattactgcagagtatataatgctcctgcttgtacctggtaagcactggttgaactggaaatgaaggttatgtgcgtgtgtgtgtgagtgtgtttgtgtgcatttgcacatgatggtgatggctaaacgtctgaggagatccatcaaggccaggatttggagtttgactgttgttttattaactagggtttgatgtcatctctaaagtctttgagcagttgctgcccttcttaaaggatgaaactttttcttaggctgcctgacccattttattgaaataaatgttcttaatatctgttttttcctcaaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggttgggttttgctcattcctcatacagtgttcagtaaagaaagttaattacagaacagtttctatacatttttgaatacttaccgtaagatggcataaaaaaacatatacaggccagcacggtagcacctataattccggcactttgggagggtgaggcgggaggactgcttgagcctgggagtttgagaccagcctgggcaatacagcaagaccccgactctaccaaaaaaaaaaaaattagctgggtgtggtggcgcatgcctgtgaacacagctatttgtgaggctgaggtgggaggattatttgagcccagaaggttgaggctgcagtaagctttgattgccccactgccctccagcctggggtgacagagcaagaccctgtcaccgtctttatacattttcataacatttgaatttttttttacaaggactatttattagttttttttttttttttttttttttgagacggagtctcgctctgtcgcccaggccggactgtggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatcttagttttgaaagtagaaaaaattagtaaagcaatccccttgccacatacacacataactaggaaaatatttggataatcttttttttttttttttttgagggacagagtttcgctcttgtcacccaggctggagtccaatggtgtaatctcagctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccgcccacctcggcctcccaaagtgctgagattacaggcatgagctactgcggccggcttggataatcttaagaggctactttgttttgattttggagtttatatcttttctccacatctttgtgagagttttttttttttttttaaattgatctgtttctataactttcttttttctacttattgtgtaacaaggcatggctagtaagtttgggagcaaaggaagattgggaaaaaaaaccaaactgtacagttattaaaagtttactatgtgataggttttcttaaaaatattagctcaacattatttagtgtgatgtttgtgcaatttttcttctattcaaattatagaaaattcattattttttcatttatttattcagacatttactgagtgcctatgatacattcgaaactatgctaggctttataaatttgtgatactggcttatgtgtgaacttgtgaggagatatgggggaaataaacatgtctctgaatcattaaacttttgcctgtgtggcgtgttaataaattagatcctcttgtccaactttttaacttgtccaacttttacacaatttttcataagctacaaacatgtctaacactctttaaaagctcccataaaacatggaacataaaatacaatttcaatatgaaactgagattcctaaaaaggaggaacaggaatctaggcttataacaccaattatagataaaatgaggactctggagacagatttggacttgagacctctgtgagtttttttttttttccgagacggagtcttgctctgttgcccaggctggagtgcagtggcatgatcttggctcactgcaacctccgcctccggggttcaagcgattctcttgcctcagcctccccagtagctaagattacaggcgtccaccaccatacccggctagttttttgtatttttattagagatggggtttcaccatattggccaggctggtctcaaactcctgacctcaagtgatccacccgcctcggtctcccaaagtgctgggattatgggtatgagccactgcacccggccgactcctctgtgctcttgatgcttagtctctcatctgtaaaatggagctaactccttcctaatggactctatttggattaagaatatgcatgtacagcctgtatcttaccagatacgtggcaaatgttaatccttttttccccaaatgctgtaactgactggccaggacctcttgagcagtcacttaaattttctgagacttggtttttgcatctctaaagtagagatattaactgtcctgtctcatggggttgttgtgaggattttttcttcatattattcataaatcagttttgagtacttttcggtatccttcttaatggtgatttttaagatggaagagttgacatcaagtgtttaaacatatgccagttttgtgtatgttcttctgaagtatcaagtggacactcatttactttgtcactttattaccttcttaaaatcaggctgtgatggtaaaaccttcctgtgaagggcccattctggggagctgtttattgagaccaaacctcatgtattcagcctgaaaagagacttgccactttctggctttacagtgccatctgtaggtaaagaggagaaagcttggctgaaggtttgtatctggagagcaagggtgctctggtgtttaaaggtgttttgtcattgtcaggtggtctcggctgctcgtatcttacttaggaaccctggaaatcaagctgcttatgaacattttgagaccatgaagaaccagtggatcgataatgttgaaaaaatgacaggtagagttttctatacaaatcttgttgtctaatccatgaagaatgagttctgagaaattggagcgggactggttctgttactcagctgtaattggataaagggccggtcacgtgctgagcagtgtacttggctctgcttaaggctgctgagcagtggcggcttctcattcaagccttgcaactttgtcagaagagagactctttgagtctcttttattttaatgctgccctcctggcgtgatgtttattgtcaccactcctatcttctctttgaatagtgtctttgcccagtccgagcccgagtttggtttcagaggctgggaggcggtgtttgtggatacagtaagtgtccctgtcattttcagtgggttcacatttcaaggaaccacaatagctaccatttaatacaacttgtctcaaagtttcctccaacttatcaactacgtagtttttttaaaaaggagaaaccaaccaccagcaaacctgtgtctgtgcaattgaagtggcacctctgaatcgtcttcattctctgtaaagggagagataggaaagaaggaatgaggaatgtaggctttttgctgtccctgcagaacctgctgtgactggggtccatggcagcccgagatgaaagtggaactcctgaggtgtctgaagagaggtaacaggaataagaaataggctgttacggttattggaatcctccgcatggctcatcttgagcactacaagctgccaacaagcaacagatggctggggagtgagagggacagggagaaaatattattcacagataacgtggtggtgatgcagtgatggtttcagacatattccttgtttcctcccgatgttgcatttctggttgtctggggtggatacaagaaggctggcaaccacggttggtataaatgctgcaaatccagatgggcttttgggctatgtcctcactgttttttttaactgtggtgtttacctggaagcttttgattatgtaggaagagtttgagctgaagaagagaattctggatgttatactttctcatgagaagtttgagtggataacagtgttttggagtttctgttcttctaaattgaaactaaattccatttctgttttcctaacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggtaagcaatgcatggcactatgtctcacctccactgagaggttaactcaggaaaggtcgtgagggaatatgtaccccacaaccaccacatacaaagtctgggggcaaaaactatagacacttagtttgagaatgctagattaatctttttccatccaagtctctgcagttatcagcaggcttgttgtatgttagtttttctggaccaacttctctgtgctttcttttttttttgagactctcacccaggccagagggcagtggcatgatctcagctcactgaaacctccaccttctgggttctagcgattctcctacctcagcctcccgagtagctgggattacaggtgtgtgccaccatgcctggctaatttttatgtttttagtagacagggttttgccatgttggccaggctggtcttgaattcctgacctcaggtgatccacccgccttggcctgtcaaagtgctgggattacaggtgtgagccaccgtgcccaacctctgcgcttttttagtgctgggattacaggtgtgagccaccgtgcccaacctctgcgcttttttttttttttttttttgagacggagttttgctcttgttgcccaggctggagtacaatggcacaatcttggctcactgcaacctccgcccccgcctggattcaagtgattctcctgccccagcctcctgagtagctgggattacaggctcccaccaccacacccagctaattttttgtagttttagtagaggcagagtttcaccatgttggccaggctggtctcaaactccagacctcagttgatccacccgccttggcctcccaaagtgctgggattacaggcatccagcctgtgctttcttaatatggtctggctaaatagctcctcgccttgttcagtcattattttggaaaattttcaaaagatgcatgataaccaatttaccatccatttagtttatgtaactggtgttaacttctcttgggcttttcttaaaatgcttttttttctttgtaaagcattctcagtttctatcaaatctggagggcttaagttgatctgtgggtctcctaggccctacacctaaagaaaatctgggttttctttaggtgaattttgatcatatttttggtactaccatggcagatcataattggagccgctcctttggttgaaatcatctgaattccttcctgttttgaacatctgatgttttcagtcttgtctatgagtagaatgcagtcaatgcaagagagtaggaaggaggggctcccctattcatctctggttcaggcagaatctttctaatatccaaaacccattatcactaaggacatgcttggtttcctaattggagtttctaatagtagagtagattcctgaattccaggcaactgaacagagtagcgcagctcagcataagggttaacatactgaatgccaaggacagcaaaggagtagagagaaaggtgagaagtacttcagggaatgtatgtccaatctgaaactgacatctcccatgttctgagttgggcaggcttatctcttgactgcctcatcataagagaggtgatggatgccacctgagcccaaagtgttcatgcccagggatctcctgggtactttttagttgtacagccaagaaggcaccctgaacactaaaagaacagctggtttgtgatgcttccaatgctctgcaggcctcagggcatctgccttgtcctgcctccccccttcttcaatcactgcccgtgatatttactggcagcttcacatccagcttttgttcatggaaccagttctgctgctgcaaagacagtgctttggggcactgacccacccagctgaaagtgaggatgtcttgtgtttaggactgcaaaagagcttcctggactcaggatatcggatcctgggagctgtggccaaggtcagagaagccttccaacctcaggagcctgacttcccgccgcctccaccagaccttgaacaactccgagtaagtaaattcagatatgcagagaattgagcaggaaggtgttgagacttcagcaagagagaggtagattgtgttttagagcctccatcactaggtggcttcgtttagctttcatttgaagcttagtgggaggcagatctcgattttcattcctaaatccagtggagttataacctagtgcttatatgcatgggttgtgtgtgtgtgtgtagtactggtgtgtgtggtagtggcttgctgtgatggggagcggctggagcagaggagctggctttggtaagtgtggatgtgatgagtgatgaggtagtgcattgtggtaaaataatctgcacagcttggagtaaggagatttggtgtgttcttagttgataatggtagaaccgaggtggttgaaatcttgtgttggttctttcctttatttgacttttttttaagtaacaagatacatgcttttaaaaaatttttccctaactataatttaagatctttagataccttccccactaccccccgcaagtactgtgaatatatttttacatggtgtaggaagaagctagctaggcagtatgttgcagacacaaattccagaaacagaaatagtgattatttctagacacttattccaactaacagtattagaaataccttgactttgtaaataacttatcaaggcaataatctgatttactttcccatatttaatgtcagtaaaagatgttaagtttttaagttggttgagtacaaaattgtgtcatcgcacacacagctaaggaacagtgtttcccagccttcaacgcatcttagattcttcccagctgggtgcttggtgggtgtttagagctgggagagagggctattcctgggaatggcttcttatgtgagcaacagagttatgtcatttagaatctggatcttagaggtcatttggtctagctacccctcagtgacagatgaggaacctcaggccaaggggagaagttacttgcctatgtagctgctttttggtagaaccaggaccacaacttacatcttctgtagggactttttgagaatccttcatctggtagcactgtgtatacttccctgggatgcaaccaaaacagtagctgcaagccttttttttttttctttttttcttgttttgagatggagtcttgctctgtcgcccaggctggagcgcagtggcatgatctcagctcacggcaacctctgcctcccgggttcaagcaattctcctgcctcagcttcttgagtagttgggattataggcacatgccaccatgcccggctaatttttgtgtttttagtagagatggggtttcaccattttgggcaggctggtctcgaactcctgacctcaggtgacccacctgccttggcctcccaaagtgctgggattataggcgtgagccactgcgcccggccactgctagctttttgtagagaaacctgcttctgttgagattgaagcaggtggtccttgtggctcagtgtgggtggtcttatgtggagtcaatatgggtgggttttctagggatgctttttagaagaaaggaaagaattccaggggggagtagttttaggactttacttacaacttgttttctcttttttagctaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttacctgtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatgatcagagctccaaatatgaattgtgtgggctgtgctaaagctagatgaaatgtttgcattttctttttttttccacagaagcaagtagattggtatcttagaagccatgtgcttttgtcctttctcagaatcatttcacctgtcaactcaagacagctccaggctgtctcttactcagcaaatctgaaggtgtaaatattaatgtggttggtaaaaatatggatgctacagcagtcttgccctatgaataacttttgcctattttcccctaaatgatgaaaagtgagcagtagcttttctagataagaggaatattattgctaaccctgcagtgaaaggtagctcttagttctaaactgtttctaatatgaccctagatcttttttttaatgtttttatgaccctagatctttattcccaccacctatttgcctttattctttacacatcctcaaagctttcaagctcttgtgtcgattgtatttcctcagggacctcctgcacctgcagctgatcttggatttttttcaggctgggaaattcacattggtttttaactctgtattttgctgaactgttagctgtgagcccaggttctaagaaggaagggagactttgctggtgttggacctgacctgtagaattatttataatggtatctctccaactgcatgtggcagagccccactgtgcatggggagtgggggagggtgacagtgaagattttaaaggaaatttaaatttcattacaatgaaccaaaatacactatgcagaacaaaaaatatacatgaattatttaaaaaaacaaacaaacttaaaagcagacagcattggcccacattacttgccccactctgccatttgtggccagaagtcctgaggtctatctcctgaagtgtgcaagatcaggagtttgctgactttgagttgtgtgaagtcagaagctacttgaaccatgtgtgtactgggctggggaggaatatctgttcgtgtgtctgtcaacctatctgtctttgtacactgtgggactctgagccttagcagcagtgagctggcttttcttctgagcagcagagatgggtcttggttgagtttaggcaaaagagtttagatggtatctgaaccccttgttggccctgaatcctccaacatcgtcaccctttggagtcaggtttcatgtgcaggttaagacttttaggagtggtaacaacctcaaagaaaattccatataaactacttcctcttgagtacagatgtttgatgtaaagaacctgtattcatcattctttgtataaatggtttggcttcattgtggcagtttttaattttctttccatgttagtctattttcagcatctggcttttataatctccatccctggttctaaattcatgttctctccatcatgattctcattcttaaatgagcaccattcttctgagcttctgtgagctcagctgcagtcacttgccaagttcacatattattctatctgtgaactagataagcagagtttggggtgagtgagaacctattttgcaagcaatttaggttgtacccaaggagaagctttctgaggtggtactagcaatggatgcaaaaagagatggtagaagctttgcctcagaagaccttgaggggatagagagctggtctgatgtgtgggtgttccctgagatgggcggctgacgaggtggcttcttgaggctccttacagctgggtgacagtggggtacttaagttctcttcagtcaccattgtgtttgtttttcctgcctctttcctagtttggtattcgttacctctgatgtatcatttttaattctgggacttttaactcatgaaggaaataatctatgtctggcagctgcagagctgacccaaattgcctcctgtgtcccaggaaaatgtagaacagtgaccatatgatccagcagtgttcactttgttctgtacaaagtaacttgtgtggctgcatttactttttctctccggattccttttaaaggtaatttgctactatcgtttggttgtttggctcctcagaaatattctcatgtgagaatcactcttgtcaagtttgactttagtatcaagtatattaaagaaatggatgccacttgctttcttggtgtaaagatttctctagaagccctttgccattggagtgagtcccttttcttctctcaccacacagtggcttgggctgagtggcgctggaggctgagaattcccccttctgtgaagcttggtacacaaggctcctagagaacatgtttctttctcatcctaggcaggctttggttactaaaccagctgaagcccagtttcccaagtcgtattgctcttactaacactatccctatttctcatccttcccgccatcgacaaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaaggtactgataagcacccccagttgggggctgctccatatgcatccggccatgtgcagccttgacacattgcatcactcatgatctgtgctggtcctgtgagtctgagcagggcgggcatctgtctgtctgcaccatgttgttaggactggcttcacaagtttgataggtctgctaacgccagattaattggactgcatttatgtttaggggatgaagagagatggggggggtcacttttggaaaggattccttttcttactgattttgtggccatcgctggaaaccccttgggaagccgtgaatgcatctctcaatgacttccaggtcaggaaccatggtagaccattacgaggtcacctggcctgaccattgagctttgcctgctcccaactgacccctcactgatggctcagggagagttgatgagggggagaggcagctttatagggcagggtctctgggggaggactgcttgctgccctgcacttggctatgtggcagatgctggccttgatgggagtccacagaaaatggggcctcactgactgcttgtccaggtatctcagtgggagggaatgggagtgggaaatggagtactcaaggccacaagacaggccgccatagaactttggccttggggaatgaaccaaagctagtttggagagtagggtgattggggtgatcacttttccctttaaaggtggcatgctgcaagaagaaaggctttgaagagtgatgggtagtcactaaccatggcactatgctatcttctaaccaacgtgatggggtcctggaatgatcctaggtctgcactagaagaggtagacccagaggaccttgtctaacataccccttgcttcttgacttcttcccatacctgcgttctctccggcctcaattactgcctgagatgttacacccttccagcataaatgatgaaccgcttcatggtgcctgtagaggcctcttgcagagcaccctgcagtggtatggtttgtgtatgcctcactgcactgtagagaaatgaagagcatgaggggaaaaatgagtagggcctggacttttagctagttttgaacactgcagttgctatgacttggggttgttagcagccaaaagaggagctttcatgagagggcacagaatacataacttgtctgtttctttactatgacccatgagggttttagtaaaccaaaatgccaagtctaagataaactgccattccttggagtgagggttccatttacagcctgaatcacgacttttattttcctaatgccttctcttgcatcctcttagctgaaggttcctttaactggagtcttcacttagctgaggggactgaagaattgattctttacccttttacgtgggaaaaattaaagcaacatgttcgttcaggctgacaggacaaataagaggcagtagagggatagccagagcaggctagatcagaaaatatcttttttttttttttccctcacccagctgagaatagttacttgggtttgaaattctagttaagtagcaagaacgcttggctgctatttgcaacaagggtaagcatgaagagggtgatttcagcatctggaaaggctcctctgtatttttcccctcaggccagctctactgctttctccctatagaaatgaaagtgcctgtttaaccagctccttggccctgtccccagtttattgatatgattaacctggagatgccaaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaacatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgtgtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaattctgctgcttatttatcgagtgccttttctgtgccagccactgggaatacagaggtaggtaagtcttgccttcaaggagcttgtgggcaaggcaaacagagaaacataccaaattaaactttctctttaggtatgtgagcgaatcccaaccataagcacccagctcaaaatcctgtccacagtgaaggccaccatgctgggccggaccaacatcagtgatgaggagtctgagcaggtatgtggcagctgtttttggtttctggctggcagcttctgtgccgttttgcagtaatttaactctgctttggggaaattttaccccttaattgagtatcgagtattcagtatgtgggatgcactcagactgtctcaggaggggaaagtctgtgttggatagatacatcagaaatttggaattggggccaggtgcagtggcacatgcaggtaatcccagcactttgggaggctgaggcgggagaattgcttaagcccagaaggtcaaggcagtaagctgtgattgcaccactgcactgcagcctgggtgacagagtgagactcttgtcttgaaaaaacaaaacaaaacaccaggaattgggagccaggtgtggtggtgtgcacctgtagtcccagctactcaggaggctgaggcagtaggatcatttgaaaccaggagttgaagactagcttgggcaaaatagcaagaccccatctcaaaataaatagataaataaataaataaataaataaataaataagtaaataaaaggaatctggaattgctcttgggcaacttttgtcattttacagataggaaactgaggtctagagaggttaagtgtctgaaataacactatggatcagtggcagttaggactctactcagttccttacccttggaataagtttggctcttttgaggcctccagtgcctgttcatttcaactcactgtatgtttctggctggagagaaggtccgctttccagctctctgtgtgttagtgcctcagggaggatgaatagtgcaggcttttccggggcatgaggtagttaggcctgtgctgaaactgaaatgacagctcaaaggaggtgcttctcttatattctctttaggtttctctgatagagatagaaataaggatgctgagaaggttctcttaaccactgcttcctgcatataccttggcagtcacccaagtttgtcctccttcccaaaatcttggcccaggtctttcaggaaaccctcatttgagcaccccttactctccttatttcccctccgggaggccctgctctaagcaagattcccacatggactgcccacacagggctcctcacacatggggtacatagttttgttggactagccacacgaggctcatcacacatgggctaaggtgaagcactgtattaggtgttaagggagtttaaaaaattaagagacacaattccccccacccaacgtggggaactcaaaaatagtctgaaagaacaactgtttctgatctctaggccaggagatagggcactggggcactttagaggaaataaggcggccattcttcttggtgccattattgttgcttctgctaccatattctaatccaacaactctcaccctaatcctctcttctcccaaaccatgggaactgtatcttcacacctaacttccacatattctatgaagggtttgcacacttcgctgtttctatgtcatgtgatctcttctgtccaaagaaaggtggaaaaaaatggggaaggaagggtaagactgagattcaggcctaatcagagacttaatcaattaaccactaaaaatatgccttgagaatatctattatgttccattaaatattccagttttaaaaagggtagaaattgacagtatggtagaatggaaaaaacacaggactgtttgggaggctgaggcaggagaatcgcttgaacctgggaggcggaaattgcagtgagccgagatcgtgccattgcactccagcctagttaacaagagtgaaactccgtctcaaaaaaaaaaaataataataaaataaaataaaataaacaacaacaaaaaacaaaacccataggactataagtcagaaatcctgagtcctaattctcactctatgaatgtctctgggcctgagtccctttgctgaccaagtgaaaagaacaactgatgaggaattccagcccacagttacacttatcagagcctgtgaaactgagtgtacaaattttatgcaggtgtgcattttttctgggggagaattcaccgccttcattaaatcctcaaatgatgtatgacttaaaaatagccaagaattactgagctgatgaattgccaagatccttccttgactttctatggtagagtaccaatgtgatttcagtcttataagtttgtgcgtttgtttgaaagattaacgtatttagattttcatgggtttaaagtggttggttgcttggtttgttcatttggttgtttttaaaattcattaattaaatatttatgaaatacctcctgtgtgccaggcaccatcctaaatactgggggtatgacagtgcacaaaattgacaaaaatctactctgtataacttaaatgttagtatgaagacagaaaaaaccctcaaaactcccaaacaacctaggtaaaatacgtagtgtatcagttcgtgatgataggttcaatggaaaaaataaggccaagcgcggtggctcacgcctactgtatgtagtcttagcactttgggaggctgaggtgggcagatcacttgagcccaggagtacgagtccaacctgggcaacatggcggaacgccatctgtacaaaaaattaaaaaattacccagatgtggcagcatgtacctattgtcccagctgctcaaaggctgaggcaggaggatccttgagcccagggggcagaggctgcagtggccgagatcacaccactgcactccagcctggatgaaagagaaagaccccatctcaaaaaaagaatgagcagggaaatcctcaccaaggtgacaagtgagcaaagatctgaaggtgaggggatccctgggatccctggggaaagagcagtccaggtacaggaaacagcaagtcctgagggagaagcatgtttgaagaccaagaaagaggacatgctgtaagctatctgaagccacagtatacaatcagcgatggccagttttgggttctttttggtgatctgggaaaacccctagtgatgcaagcaaatatgggggatgccaggtaccagtggggttagctgcatcccactcctggctgaaacctattttagagacaggcctgcatcagggaccctgggtaacggaaagtacctttttccttgcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaatgctttaaatgatggatatgttactttagcaagaacttttaggtcaggtttctcctttgttttgatgaatagtcaatgaaactaatcctcaagatctggaaactaaagatttttatttaatccaaatgttgcactggaagaagaaatcaacagtggtatatttacttaacaaggatgtgtgtaatacaagacaaccctggggattacacacttgaaggaatggaagtggcaaaggttaacaggcagaaagcagctggatgaaacagtttattttcatcttagaagattctagctatctgtggagaccaccactgttccccgaaaagctaaagttgttaagtttgtaggagtaccacaggtccttccccctgctgcaagacagagacttgctctgttgcccaggctgcagtgcagtggtgcaatctcagctcactgcaacctctgcctcccgggttcaagcaattctcctgcctcagcctcccatgtagctgggattacaggtgtgcgccaccatgcctggctaatttttgtatttttagtagagatggagtttcaccatgttggccaggctggtctcgaactcctgacctcaagtgatccgcccaccttgacctcccaaagtgctgggattacaggtgtgatccaccacgcccggccacacaggtccatttttcatattccaaagcccagtatagaataaatagggttttcagggatccaccagggctataaaacagagttagcttttggggacatagtcctcttcttccttaaagaaacactgactaaaatagtaggagcaggtttttagagtagagttgggacatcactttttccctgattttctagatctgaaaggggtaacatgtcattaaagggtgatgatattgatatttagtgttgccaactgctattatcactgctttatcttggaaagttgccgactataaagacagattccagcctgcttgagttaagggaaaggccaaggctgctactgaattagcagtttctaaaactgtcttgtttttgccatttaccatatgttcactggtgctgccttcctgctgtagtataatcattttctcaaatcagttgcctctcaggacaagatcagcattttcctagggtccttctgtagcaccacttaaggaatgaacctatcacaggaactccctttgaataaaatgatggtgactcccacacgcaggaaagaatcatttacttcatttgctcttgatatactcccttatgaatttagaacaagtgatccaggattagctgtaactctgtgcttgaaaaatattttactactactaagtattcagaaatctttgttatcagtaggtggtggtagtgatagggaagggagctttgatcactaatctctcagactgtggccagaatggtgatgcttaagccaagtattaatggctattaacatactgaggttagggaaggagtactgagaagtgctttgcagcaacactcgcagcttgtgtgatgatgcagaagaaaatctgatcatgttcaccctgctttgacaatgagccttgcccattggagaatgttcaatcaatagtagacctaaaaaaaatcaacttgttgctttcatctttttattgatagcacagccagagctaccaaaatgatttactggattctagcaaattaataaatacagtaatttgattgtaaaaggaaacattctacttggacattttagtagaaattgctagagggaaggagctcctggcatacattctacttggatagaagagaagatagcacaggaggagaactggacagtccaggtatagattgttgagattagggattcagcagaaagcaaagcaaatg

SEQ ID NO: 12948 - DNA, 53924 bp, Human; identical to SEQ ID NO: 12947
  misc_feature (1)...(53924): n = A,T,C or G

SEQ ID NO: 12949 - DNA, 12211 bp, Human
tcctacaagccctttagggtctgttcacatctctttactcttttttttttttttgccttagactcaaggatgtaaaatatcttatccctaaacatgtagattatatcttcattctgctcaaattgctgttgaaatcctctagtgagattttcacttcagttatatcgttcagctccaaaatttgtttggtttattttgtataatttctacatcattgttgatacactcatttttccgtatatgcttttcccaatttcctgtagttctatttccatatttttaattggaaattttagcatatttaagataattgttttaaaacctttctctactaatttcagtgctcatggttcttcaaaaataatttctgtcaactcgttttctttcttataagggactgtgttttcctgtttctttatataccttattattttatttgagcatttcaaaatatagacatttttctaactctatatagatttgttctgtgtcatgacgattatcaactaatatgcttggtatgttcttagtcttagcataagcccaacataaaaccctaaggccttgtcagcaattttctgaacttgtatctgcctggactgtgtgtgcccattagtagttcccccaaatacctactggcttttgaatagcttactatttcaaaaattcacaccccagcttcccctcaatgggttagacggactattgcacgtctcttcccctaatctcttgcccttggcatcatactacatttctactcagcacccccataaataaataagtttattttagtcaatttcagatcacttcttgacgcgtccatgagacaagtaggggccttttgatccaccatattgctgaaatcactctgtaaaagctttcaatgattttatattatattgtatcaatgtataataattaacttatttctcaacttactttttggttattatttgaggaaaagtaaatagaacgaaatcagggcattgcaagttctgacaactccaagatgttgataatgtattgtgcaaactacattcatcatgttctaatctgccctccaaaggaaggaacaagtgaaaactatcccacatgagaattattcatccatttatatgtaattaatttccagtttttccttacaaataatgtttaacaagatgacagattatataaaatggttatcagttttttggctagttacttcttgatagtctgtaataaacctggttgaagaacaaatactattaaggcactgcttgcatatattaaatgatgtccaaactccaaaaactgttaataattaacactccaataaaaactacaccagaatttctttttatttgcaccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactgtttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttcgaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctgcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggtaagaataattccttttagttttcggatttcaaaagaataaacctagtagaagtgaaacccgtattgggttgtaaggttcgtgttcctaccttactctggatgactcactggtctaggtttcctaggctaggagaaaaaagtaggcaatccttgttctgcattgaggtccattcctatggtcacgtactgcttatttttcgtttgtgcactgtttctttcttctgttcatgtctagttcccagcttggcagaatatgtaaaactcagtattgaagaacactgttggtcatctccctctggtggagattaattgcaataggagtgatttctctgtttctacaactgaagaaatctttccatcttccaagaacatacgatccagagaaatacttatagcaaaaattactggatatggtgtgcacaaaactgtcggcagagtatcactgttctgatgggcggcagtgagtgccacccagtattaccggacctggactagagtttccactgtactatttcacttttaaaaagaacttcctgaaagaaaaaaataccacctcattttaagtaaaatctagaacctaacaaaggaaagtctaaattcttagtccttttttgtatgcatcatatttgtatcaaagtggtaggagtggtcttctgacacaaaaatgaacaaaatggagacctcattttctagatagaacttgtattccaagactgtcctcaggctactaagtgtgtgaataggaactaattattgaaatttgagtctctcactttatcgataagttgtgatgatctacaaggatacattttctagaccagtgacaaaagtggtttaatttttaatataaattggcatgggcaggaaatgaaaataacgacacaactgaagctccagccttggtaaacctttgagtgttggcacacttaaagactgctctcaaaaaagatttaaaaaaaaaaaaaaagactgttctcaggagatggcggggagaccgttatctagttccttgtaatttcaacgaaacaagaaagcttctttaaatacatgtaaaaatgaaaacagtttatttatatttttgtcattaaaaaatacctttcaaatctttatccaaatttggtcaataagtcagtaattttaaatttcactggaattctgtctttcctgaaagagatagccttattttttatggcagaactgtaccttagtaaattcttacagatttcagtgaatttttaatgtacaaatcgatatcctcagagtatacatctttacccctagtgttcagttctgttgtgtagccagaatgactgtgcagaaaagacttaatagactactattcacagatgctttatttcccaagtgaaccctagttgggtcgatgtaactagcatccagtcaaaatctcaagaactgagacaccaaagaacatctcttgtagacagcatttcccaaatacgatgttggaggaagtctgagtgagcattctgtgtaatatcactgggagagaactcatatgagcttgcaccgtttcccttctatactccatgtgatttttaccatgtataatatcactatattaaaaataattaggactatttcagtcatgttaacttttccaacaaatcactgaatctgagggtgttatgtggtacctccataacagtgatcaaccagagattgcctgagactgaaggtgtttctgggatgctcaacctttattactaaccaggaaagactcaggcaaactgagatggacttttcaccccacatacagacaggaggaaaagctgattcttgtataaaagtcaatgcttgtgcctgaactacctctcagccacagtgatcaccagatactacctttggttgctcctccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaaggtactgtgtctatgatgagcttgtgtgcacatgtatttattgtgattgtgtggagatgacaattctatgactggatgagtagttgtgggtgaattttgcttctgggttcaaatttattcacacatactcacatactaaaactgaaatcaaaatcaaggaatgatgatcacttttcattttggctgtgttccaatttatgacctgaaagtccctttacttttttgagcttcagccgagatcagtgtgatttgacatgtgctatagaatcacagagaacaataatcatgttatggtttttcttatcgcctgggtgattttctaagatttcttattattctctcaattgctatctttatcagtgagatagaaagcaatataagaaagctctgggagtattaaataatagacacttaaattgtcctaaattgtgtccagcatagtgagcatgttcaaaacttgttttaccccccttttatgttgctttagtttctaagcaacataaatagctattcttaagcattgggttgaatggatagaagaattagactgttaaaatgagttgtaaactctactgaagataattcaggtaacatcatagttattacttaatactaatctttacattttaagaatttactcctatcattcagtagatgtacaaactatacatccaacgtataataaagtttataaggataggtcagagccaaaggaatcatgagaaggaagagaatatgtttgccagtggtcataaattttgaagcagtaggaaaatatctaaatactagatggcacaaagtaataagatttgctcaagcattcattcaaaatcacctccattctttaacctctgcagctttggtccacttttcatcgaccagagttggtccgaccagccttggaaaactcactgaaaaaagctcaattggactatgttgacctctatcttattcattctccaatgtctctaaaggtatgcagtttgtatgagcataaaattgcgcttctgctgtcattataaacattgtttatctggatagttgaacagagctttttattaggaggatgtagggattatcacacagaagaagaaccgtaagtggaacacctaatttcctttctttcgagtaaattttgaatcctacttctctaatgcacacctacaagagaagagagtacagcaacctcaaagcctcttcctcaaaaacttgaaattacaatagtctctttcaaggcactgtcttagttgtggcttttgagtccatctcttgggatgttcccagacacagagtttcatgcagttgtggtgcccaataaaactgctgcacatgtgatgcacaatgagtttccaccatctctccccatttcaagctgaagcagatttggtggaagccactatgcatggttcttaaattagaaacccttaatgtggacttgcaaagctttattattctgctgcctcttctttcacaatagagtttgaagctgtatttagccaggaattactgtgtagtgtataacttttgatttaaagttacagaaaactactcaggctagttaatgcaaaagagtttactgagttatgtaaaatgggaagtcaaagacatggctacatttaaggatatgaaatagtctacaaaaatgtatcatttgtctattcttatctctaaactccaacacttttttttattattgttgacccaaactttttcattggtggcgattatggctttggagcagctcaaggctcatggtcatcaccataagacaactcctctgggtctcccaacttctgctgaccctatgtgattcacagtcctgcccaaagactatcaactcttcaggtggtctgataatcctaccgtgtacaagagtacaatccattatttttggatatcaaggtatttccaaatcaaagagaggtacttcaatagaggaaattataagggcggaataaagtgacataagtcaactgtgaaacttgattaagacctagaaaatggtccttttccatgcatataatatttgtaagagattagaggaagcctgtctcctgaatacattccttataccttcatatgtaaaacacttagcacatatcactttctggagcattgtaccacctgtctcatggaggattagtgtccttaaaggtacctggggttacagctatgagtggagaaattaatttgtgacatcattaaaatgactgcttctatttcagccaggtgaggaactttcaccaacagatgaaaatggaaaagtaatatttgacatagtggatctctgtaccacctgggaggtgagtgcttggcggagaggacacagagaaggatgacaaaaagagaaaatctgtttcccaggttcaataggaaagaatggaatatgcaccattagatctagaaattcagaaactttacaagagtagctttggtgagatgaagggaaaaacacaaaaggaatgtttagagagtggggcacaagacttgggggcaaggaggacaggaatctctttccttgcttgtgcattaatctatgcagtttcctaaggaagagatagaaattcttactcttgctgcctctatcttcttcccctatttgctgtttgaatttttctttttttgacaatcactgctagctattttcattgtcatactttgaaagttgttgctctcacagttctgtcttgcatttaccgtgatttgcagccaactgcacaaataattcctcacaacccctttctccacaggccatggagaagtgtaaggatgcaggattggccaagtccattggggtgtcaaacttcaaccgcaggcagctggagatgatcctcaacaagccaggactcaagtacaagcctgtctgcaaccaggtgagctcccttggccttctctcctttcggttcttcatgccccctcttcctgtcctattgccaaatatctgtttgttttgtcccagttatctttgtgaagtagaagattatctagagagcaaagcttctgtcaagaaaggcgtgaagatttcttgtttgtaccctgcttggaaaagtattagggaaaaattggaatgagtttaatgctgaatcgtgtgtaatatttaggggaggtccatttgatcagggaggcctggaatcatcaattagaactcaaggaaaggtggacttacctctaagctatgaaagatgaccagaaagtgcatgggtgaaggtgatttggagggaatggtgtatagatatgaagctaggaaaagatgaaatgagctgtacgtgaacagagagttagaataagagaagagaggtgctaggggtttacatggaatttggatgtctgaatgcctcttcttgatgtttcaacaattcttgaccaggggcatagatatactaaaaattagctgcagacaatgaaagtcatccatgtcagaaagagaaaaattaggccgggtgcagtggcttacgcctgtaatcccagcactttgggaggcaaaggcaggtggatcacctgaggttgggagttcgagaccagcctgaccaacatggagaaagcccatctctactaaaaatacaaaaaattagctgagtttggtggcacacgcctgtaatcccagctacttgggaggctgaggcaggagaatcgcttgaacccaggaggcagagattgcggtgagccgaggtcacgccattgcactccagcctgggcaacaagagtgaaactccgtctcaaaaaaaaagagaaaaattacctgtttatggaggtaactgttcacagtggatgaaatcaacactgaggaactttagcagaacatagacctgacctatcactgcccatgtcttagtctgctacttctctttggggtctgtcatccaatcagttgtttaaacacatctattctatgcatggttttttcatagcttagggataagtccttttttccccctgagttattgttaatgattccaggcctccttgatcaaattgacttcccccaaatgtcacaaaaaaattcaaaattaaagtcactctacctttttactaatttacacttttttattcttttatacaacttagagccaatgagtaaagatctacaattgaaatgtgaagtgtataaaatttgtgaatttggcctaatgatacagttccatcatatccaaatagaaacattaagaaaatgcagttttaatattagtccttcaattttttattatgataattttcaaactttcagaaaatttgataaaaataatacacgattcaacataaccatttatattcaaaattgttaacactttgccacattgccaaatatttatggcaaatgtttatgtgggtatatctgcataaatacatataatattttcaaaatctctttaaaataaattggaaagatgacaattcacctctatagacctaaataaagtatgtcacagaaatgaagacattcttccagctacagtataattattgtatctaaggaaacgaactgcaatgccctcatgtcgtttaacatccagtctatatttgaatttcccactgtttaatggaaatgtcttttatagtgctcccttttaaaacagaatggaaacaagttgtgagctgatctgttctttataatcataggtttcccattcagcaattacttataatccactgggtgataattcctaacagaagaagtcatattccatgacaaattttcacatatgattgtgtaaacatcactaatacttttgtatttaatggttatttattattgtatttattattttttggagtttttagataatcattttcaattttaaaaccttatttaactattcttacgtgacattttactatgaaaaaaaatccttcaccaaatcaaaatgaagaacaaatattcctcaaagacaaagtttaatacttgcctctaaatatcaatttcctaagagattactataataaccaccaatggtggaggcaaattattttgttctttcttgctctctgattatctcactcattactctggacttggacatttttccttaagatttttaattaattttattaatttttgttagtgctcattcttacccaatgggtagatttttttcttgatgctgaaatctatccaaacatcaccagtgacatttctttgaaagtagtgcttttgtctttcagacttgcactcacgagtccttgaccaaattcttgctttctggcacaatctgaagcccaaaggctctaagaatcttactgtatcccagatatggaacttgttacatctccttctagttgtcaaaggtctttggaagccaggatctgattcatagatgagcttctgttcagaaatggcatttccatttatacttttagaagatatataaaatttatttctatgaaaaaggttattacttgacaataatatcctcagctcaaatataatgctatactgattattattcagcttccttactttcatcttttcaatattaacataactatttcatataaattgatgcttctctcttttggtcaactgcaggtagaatgtcatccgtatttcaaccggagtaaattgctagatttctgcaagtcgaaagatattgttctggttgcctatagtgctctgggatctcaacgagacaaacgatggtaataaaaacaatgggacctttacataaaccttcattttgcagaaaattttttagtcagagcatcctcagtttcctgtagttaagtttcaagtggctcatggagaggaaagagaattgcatttctgacgagatcttggatgatgctgatggtgatgctcgggggcctcgcttgagaagctccggtgcagagtggacgccttagtctgtttagggagccgcctaacaaactatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcccatatgaatgctttgcgtgcatcctgagggtttcttctactctaccacgggagaggcagcacaggtgcagagaattaagatgggaccaaaaatggagatttttttatttcagcattaagttgacaatctactctgcatccctgcaccaggaacatcattttttcatgttgtttgtttggttttggttttttttttttgagacagagtctcattctgtctcccaggtgggatgattctcctgcctcagcctcctgagtagctgggattacaggtgcctaccaccaagcccggctaatttttgtaatttttagtagagaaggtatttcaccatgttggccaggctagttccaaactcctgacctcaggcaacccacctgctgtggcctcccaaagtggtactacaggtgtgagccaccgctcctggcctcctcttcatcttcagaaatgtggagtagcattaggtgttctttagtctaccagtcattgtggattttttatttccatttcttcgtacgctcagttaaaatttcacatatttattcacttggagttttctgtttgtgtactgcctgtttaagtctttctttgactcttagttgcttgtcttttttttaagtataggagaccataattatactattaaatagagctgttaaacaaatcaccctcaacataggggtttaagatgaaaaccactgatttactcaggattctctagttagaaaattagcatggcctcagcctgaacttagtcaagttctgttcttggctgggctctctcatgtgtttgcaggacaacgagatagctctgcttcaagatgtcaatgggacatttgtctgggtgccattttctcctccatatagttcatcctgcagccatccagcccagacttcacctcagcacatggcatgaccccaaggcagtgagtggacacatgcaaagccttttcatgtctaggctcagggctgccacgccattgcttctggcaaatattacccacattacaggacaggccagactcaagggatgggtaaacagacaccaccacttattggaaagagctagaaattcatataaccaagcaagtggatacagggacatgtgagtgttggaggaagtgtttcttattaatctatgatggattaatatatgataggttaatatatatgatagattgatatatatattatagtttaataagatatatgagatagattacacatacatacatatatatattctgggtattaatcgtttagagatttagatgtattattgaagtaccacctcccaaattgcatatgtgctgtggttttctctgtagttatgtattcatgaacaaaagttgctacttttcatgtagttaaattattcatgcctctttcctgtggttgatgagtggcatgtcttttcttatattgggaacatgacaatcttttaatatgttatcttgcaaaattggtaattctctttacttataaattagttgtaaattcaaatgaatttctttttcaatactaagtaaaataaaaacccaaatatgcacatggaatttctaaattgatatcaaaaggtgccaccaacaattattgaaaagcattcacatttgctcacatatcttgattttttacctctaccataaatgaaacattcattcacaaataatattcttgcctctcttttgtcttcaattgacttatttacttttctgtactgtctaaataatgaaaggtcttgctaccagaatggtacaactttttttctaactctttattttatttgataatatcttgattattcttgactgactattctgttatatgaaattttgaaacatcaacatccatgaaagagtacatattttagtctttggttgatattgtattgaaactgc

SEQ ID NO: 12950 - DNA, 32487 bp, Human
cgttacaacaatttcagaagagtatctaacttatttgtcttaaagcttatactgcaaagtattaatatgtaatatatcagattatagaacttttttgttcttaagtttctttggagaaaaaaacacaaggacttttgaaggggcatttctaattaaccccacagccagcttccttgttaccaagaccctggatgggaatttgctatcactggttggctgcgtggcaccaggcagctcgttgggctcacttgcctcgtgctataccactccggagtgttcatttattcatgcagcctaaaaagtgtagtgggcatcgagatttgcttggtgctctgggagaagactaacatcaataaaagacgcagtccctattcattaggaatttacagactgcttggaagaggcgacccgcaaagcagagtctaaggaacgatgcggccacgagagtgtttggaattagggtgaagggaagctttccagcgcctaccacatcgcacatcaaaccatctgcaaagatctgaaagcatttttgtagtattttgatttttatagctttcattgtaacgggatttaacctgtaacatcttttcatcagagaactgcagattacacaaatgaaaatatcataaatccccatttgtactttctgtactttgtaccaaatgtacttaactgtatgctaaatatagtattgaatatgtatcagtgcaaacgttaagagccttttgcaaatagatttatgaacatggatacttattttgtttacttttatattacatgtactgtttatacaaaacatgcattaaaacgtctgtaatgttatttcagtgtgtgatggatgagtggttgctttaaatcactaggtttttgattggtgctagagtagctggtgttgcttaacgtggcattttttttcctgtccacactttccacccttggtacaggtatttttgataaagctgtggaatggaaaggtatgtttttcatggggtgttcaagaatctgttaccttaaatttttttaaagaggtttcctttctgggattccttttgtgtctggcttaagcagacttagtttaatttaacaagtaacatttttagaggcagtatttgagtataaaagtttgacgtgacacaagtttctgactttacttttccccattcccttattaaagatagtacgaaggattttaaagcatttggggtggggggttgctcttaaaatatatgatctgtaccatgagaaagaatgtagcccaagggttgtttatggtagttaatgatctagtgtgttgttattgctagaatcctggttatcataaatttgcaatttcattgaggaaagtgatataagtatttcttaatatattaatatatgaaataattttagagactttattaaatacacacagtcctctttatggtagaggaacagttcagcttgagctggtgaccggctgaactagaggggttactctgggaaagtggcgagtcggcagggcatgtctgcacagattttgtgccaggtttcctgcctgcacagcgctttcttctctgtccaagttctgtgctgaccacagctgtccacaggcatgtttacactccctgttcttgcaggttgacttgagagaaccacgtagctaaattggtgagagactcagcctgaccgcttgtctttagaaggcctgattggaagagtgcactctattgactttcctctaacaatgaaattgtgaaaggtacatggggcggctgtgagacgtgcagctatcgggtctcaccggcacatcccttttctcgtaaagcaatgaagcactttctaaggtgttggtactagtgctggaggctgctggtgcattagatgctgcccgtcacatcggtgggctgagaaaccttccttaaagacctgtgatgttttgtaaaccctgactgttctggtggttgcaaagttagtgtctgtttagtgttccccatctcaccagaagtgtttcctttttctcattcatagaggtcctgtaataaagagggatccgaacaagctcagaaagaaaatgaatttcaagtaagtaattcagtctttctgcatctgtgtgagatgtgaactagtgttagccacccttcgctactccagggcttggcagtgcctcttatctacccttggaaaatcctgatctatctttctacgaggaggggctcttggtatatctatcagaagccaccttacggagactgagtgagcggtgggtattcctcattcctcctgagagtgtagactgtggaagtttggtgtctttatggcaatcgaaacagcattcggatgttggcagatggcagccaggggagcattcgtgtgtggtacctgatgaggaggccctggctgccgctgctgtgatgcctctctcaccccctttctggtcgttcccacacttcccatcaggaagcgggtcactgcccagtggttttggtggccacccattttccatgggctaacagcaatgttttttcctatggatgatacccaagttggaaaagcttcttcctagacttagagaatgtgaccccactctctgaaacacacatgtgcagatggcttgaggccaagagcactgaccgatggagcctcagaggcaggggtctggggtgttggtctgcatgccccagcgtaagcaccttttgagcatctctgccattatgtgcaggctcacagagaagggtgcatgtgcacacatgcccaacatacgtgggtctaagatgtagatacacacatcgccacatcacttttaccaattgtatattgattattaaaatggtcaagaaataggctgaatgcggtggctcacacctgtaatcccagcattttgggaggctgaggcaggtggatcatgaggtcaggagtttgagaccagcctggccaacaaggtgaaaccccgtctctactgaaaatagaaaaattagccaggcatagtggtgggcacctgtaattccagctacttgggaggctgaggcaggagaattacttgaacctgggaggcggaggttgcagtagaccgagattgtgccactgcactccagcctgggcgacaggagtcgtccccaccaaatgcaaaaaaaaaagaaaaaaatcaagaaatagacattaaaacggttgagataaaaaaggaatgaaagtgatgatattttttccacacttttcagcggcttgttttacatgtgtcttgctctgggtgccctgctagaggatctagaacttgtgctctctggagtgacagtgactgggaagtccttgggtgggaagtgattgacaatctgttgtgaaccattccaagccctttgtgcagaggcctttggacatcctgttagctgaaaatggtggatcaccaggacctgcgtgatgctaaatccaaagtacttttcagttctcattttattttgacttctcagtagcatttgacatgacccccacccttttgaaatgtttcctctcctgagggcagccatgacacagagacacaaagtacagatctggctgtctacatgctagggcgccccatgatttgaccataggccctcttctcatgttgtcctgtctccctcggtcacctgatctataggccaaagggccgctacattcttcctccagccctgacctcgacttggaactaatgccattggctagcagtctctcctcggatgtctcacatgcccctcaaactcgccatgaaatcgcccggccgatttcagtcttttttatgtgaattttatatgaatttatttttaaccttttatttcataccaattttagacttacagaaaaaatttcaagaatagtacagagaggccgggcatggtggctcacgccgtaatcctagcactttgggaggccaaggtgggtggatcacgaggtcaggagatcgagaccatcctggctaacatggtgaaaccccgtctctactaaaaatacaaaaaaaattagccaggcgtggtggcgggcgcctgtagtcctagctacttgggaggctgaggcaggagaatggcgtgaacctaggaggcagagcttgcagtgagccgagatcgtgccagtgcactccagcctgggcgacagtgcgaaactccgactcaaaagaaaaaaaaaatagtacagagatttcccatgcacccctcacccagcttccctaatgcgaacatctcacataaccacagtgcaatggtcaaaaccaggacattaacgttgatgcaatagtgataactaaacgtctgtaatcccagcactttgggaggctgaggtgagctgatcacttggggtcacaagtttgagaccagcttggccaacagggtgaaaccctgtttttactaaaaatacaaaaataagctgggcttggtagtgaatgcctatagtcctagctactcgggaggctgaggcaggagaatcgcatgaacccaggaggcggaggcttcagtgagccgagatcttgccactgcactccagcctgggctatccatctccaaaaaaaaaataataataataatatctccaaaaaaaaaataataactgaactatgacctgaattgaatttcagaagttttcctatgcatattttcttttgttctgtctcgagatttagctagatctcaagattgcattggctatttctctttagtctttttcagcctgtaacaattcttttgttatttgtaatctttatacttgtgaagagtactgatccgttattttggaagtgtctcctcaatttcagcttgtctagtgttttctcacaattgaggttatgcatttttggctgaaataccacagaaatgctgttatgtcttctcaagaagttcataacatcaatactcttcttcctgggttttaaataaatgaaacttcatagataaagtgaaaagtcagtttaaaccccttgttccattctcaaccacttctctctcccgtttctgttcactcttcacatgctccaatctgacatctgtccacccatcactctgaagctgttcttttttttgtcaccaacaggttccatattgccaaatctaatggccacttagcagcaccattagggaataccactctccttcctggcagtggcgcctgcctcaccttgccttctgccctggcccctctttttgctgcctgaacttaaaccagtttttcaagttgtggcttgtgaacctctagtggggcatgaaatgttagcatgttgattgctttttaaaatgaaatagagtagaaaatattaataagtgttgcccagttgtgagagtgagtattgctgtggggatagtgtttgttttgggggtgtatgcgagggtgccctgtagaaagctttcttactgtggtgacagtcacataagaaagggcattttaaggcctgtgctggttcctcctcttctgtccccaggggatcgaacccagtttgtgagctgtaaacatcaacaacatgttgaggacttgtgaattggtatctgtaagccccagtccacccggcaatctcatgctctgctcttccttttccttgattgtcctgttccagtgagacaggcctctcagttccttgaaggcgtcacacttgttccttcctcatggccctgtgctcccatggggctgctgtggcttttcacacctcagatctcaggtcagttcagtgtggcctccttagaaatacccacaccaccacaccagtcacccttgtttccctcatggcagtgagcccagtccatagctgcgtgtacttgcttactgtccatttctctctctctccccatccctccttctctgtcatgtaagccccgttgtgggcaggggccttatgtatcttgttctttgttggttccctggcgcttagcacagtgccaggacatagtagacattgagtaagtgtgttttaggcaaatgtattaatgagtctttatttctgaagcccaagtaaattgttccaagttgagatatctgaaaaagtaggaccaattttccctccactgtcaccagctgtggctaaaccagtgcgtggtacaggagagaacccagccatgtctgtccagccccctttttaccatgctcactttcaggagcaatcaggaaggtgcctggagacatagtgatgacaagaagaccaccagtagttggtacacttattctaggattctctgctgtccttaacctgtcatttttcttgcttgtgcctgggtgttctctttcattttcttttcttttgagacagagtcttgctctgtcacccaggctggagtgcagtggtgtgatctcggctcactgcaacctctgcctcccatgttcaggcgattctcctgcctcagcctcctgagtagctgggattacaggtgcccgccaccatgcccagatagtttttatacttttttggtagagacagggtttcaccctgttggccacgctggtctcaaactcctgacctcaggtgatctgccctcctcagcctcccgaaatgctgggattacaggcgtgagccaccgcacccggcctcattttcttcctctccaaatccttctctccatacaccatctccccctttcttcctactgtgaataaatattgaactacagtattacgtaagaataagtgtgtttttgtttacaatgtttagggcagtgctaaagagaattggaaagttcttacatctctttccctcttctctatgtcctttctgggttgactcagctctggagaggattctggctagtgctggtgacatgtgttgacgatgccacacgtaaataaagtcacctccgagaatccttcccagtggacatgatgtgcaaaatgctgaacttccgagtccagcacccccttgtcctgccatgcccagcccctgtttacttttgtgttttacacagcatgagggtggtggtggggaccacagtcttcagagcaccaggaccgtgctgccccctggggagcaggggagcataatgtctaagcagagacttggaggaggctttgcagacccttgcttaaatgccccggatactttctgtgatgttgggcttggagtaagatggggactgcatctctggacaacactaccataggactaaaaagttcttggaaaccttttgacaactaaatagagatactagatctttgttttcattctctaaggttttaagaaataaaacctgtctgatatcaaatcccaccctaaaattcattagcttgatagatagatgttatcagtttattgtcatatacacaaaaccacaaattaggaaagattgagcctcacaagatcacaggccataattgtgaggattatacgaatgatggttgtagacgataattgtggggggattaccggcaaatccatttacccccacaaaatgtaaaagtgaccaaaatactttttgctttaatgtggtctgatatcctttggaagtagcttttcttttttgttttcttcttactatagtactgtatcatttcctaataagtttgtcctcttggtttctcagtttttggtaacgtgaatgtgttttagaggtttctctgggatcatgttcctccacagcacattgcttcacagggggtgaattagaatcatctgaaagctttttcaaaacagccctgctggtgcctctcttttaatacttggagtaagacctaggaatctctttgcaaaagctcttttttttaaaaagagacttcggtggtggtggggcatctcactatgttgcccaggctggtctctaactcctggcctcaagtgatcctcccacctcagcctcccaaagtgttgggattacaggcatgagccaccgcctggcctgtaaaagctctttaagagattcaggtggacctctgggtaagcgtgactccttcactccaacagatggaaaccattatgctgtaatgtgctgtttaagggggaaagaccaaggactgaatttgctttgagatcaaagcatggattttgaaggcaaaatgatgatagatcccacgttaattattaggacgaagatagaacagacagcatcatagagatttcagcaagacaacaaacattcaataacaggaaaaggtcgggtgtgccaactgaaaatagcaatctaggatgctccatgctagggtgctctttggactagaaagccgtagaccctggacctaaatcagtaattttcaagcttgttggacccatgagcccaatttagtaggcagaaggtcctttggatcctttgctttaactagacacactcaaccaaaagcaaatcaacccttaccagaatggatggtgttgtggcctttggtgagataccaagggtgagactcctatataggttgcgaaataaatagaagcaataaaagcactgatggatatttttctatttttggatctagtgacctaaattaaactcatattttaaatcttatcaatatagcatagtgcttgcaagcatgaatcctgcaaatgacacgatgtgtgactttggaacctctgtttcttcatatttaaaatggggatgatgataacagtagtgcccacgtgaaagaatactcatgaggatcagatgaaacactcctgtgagagtgcttctgatgcctggcgcttagcaaacactcagtaaacacctgatttgttgccatctgttttagggggctgaggccatggttctggagagcgttatgtttgccattctcgcagagaggtcacttgggccaaaactctatggcatctttccccaaggccgactggagcagttcatcccggtaagatttgttcataaacgcttagttgacatatgccacagacagaagatggcttctttgtctcattgctgcaagaacctgcaatgctgtgttttcactgttaacctcacctatgtcattaaactgtatcagaaatcatgaaaagcaacatttattttgtacttacatccgaacctctttcttttctgtaaaggtgtattcatccaaatttgaaatatatatgaaacttaccattttattgtcccctgaggctgtgtaccctgagactttgcccttttcaccgtgttcctctcaacttctagggccctgctttatagaacttgctgctagaacaccttggccctgctcagtctctgactgtagccctgtgggggccatgcctgttctttcccatcacccttccttggtttgttttgtgcattcctactgagtctccctacctcccatcttcctgtccccatatgctggtcaaattcttagatttcaaggccttgctccaagaccttgcagtcttatttctaagcagtcaggattattttccctttcttattgtcccaaggcagttttaatgttgctgtaacatttaccagtataccatgtcttagagttacatgtacatatctaaagcataggtcctgttcctctacccacccacccctgactccatgccctgcacaatgcttcatgcccagaggttctcatgaaccctaagtgttgaagtgtggctctgagccctggcaatacttctttgattggcaatgctcgtctttgtcagcctgcactctcttcctagatagatcagatattccccattttcattgagcgtaagttccttgaggactagaatcataagctgctagcttttcctgccctgctgcatgagatatcttatccatgagaggcctgggcatgtccagggctgccctgtacatctgtgcagatggagcccagcactaggatgcctggcagaggggtgctctgctgcgtctggctggggaccaggggcaggggtttctttgtctaatcccacagcccagaaacagagaggctagttgtgctctgtctccccagaagaggtatcctcttctagttgacagtggcactgtccgtctgtgctagtgttgtgctagctgccagtgctgaggatgtgtttagatgagtggatggtgccttcactgcgctggctttttcctttagtttgctccctggcacctggctatgttttagtagagacagggtttctccatgttggctaggctggtctcgaactcccgacctcaggtgatccacccgccttggcctcccaaagtgctgggattacaggtgtgaaccaccgcgcccggccgagatgataagtttttgaaagaattttgtaaataatagaacctcatatggttataagtggcaatataggtgaatcttacaaacataatgttgaatgatcaaactgcaggagactgtaagtagtatcataccattctataaagcctgataaattttaaaaattgtttaagaatatgtgcacatgtagtaaaagttctctttttggaaaaggtaagggaattgtgttaacacaattcagaataataaaaatatcttggggacaaaaagggcaggcatcaggacacatagattatagtatctgtggaactgattttgttctagttcttaagttctatctatgctcttgtatgtattgtttattatatattaaattttttgagatgggagtctcactctcttgcccaggctggagtgcaatagcatgatcatagctcactgcagcctcgaactcctggactcaagtgatctttctgccttagcctttcaggtagctgggagtacaggtgcacaccagcacacccagcttattaaaaatttttttttgtagagatgggtcttgctgtgttaccctggctggtcttgaactctcctggcttcaagctcttctcctgtctcagcctcctaagtcaccaggattacaggtgtgaaccactgcacccagccatagtgaagatttttttaaaattctgttatatactaggtttgaaccatatgacgccgccggtgtttgactgtttttgaccaacaagaatggcagtttcatttgattcaacctaataccgtatgttatttctagatttgcttttttttttttttttttttaagatagggtctcactctattgcccagtatagtgaagtataagtggcctgatctcagctcactgcagcttcaacctcccaggctcaagtgatcctctcacctcagcctcccgagtagctgggactacaggcacgtgccaccatgtttgactaattttgtttatttttttgtagagacggggtctccctgtgttgcccaggctggtctcaaactcctgggctcaagcagtcctcccgccttggcctcccaaagtgctgggattacaggcatgagccaccacgcctggcttaggtttactcttcactgcttgggatcaggtgatttagtttcatgattcctgtagccatctttcaaagggcatgtgagaatagccgggccactagggatagtaggtagtctgtttctctttctctactggggaaggaatttggaatactgagatttgttcatatctgagcatgttagcttcagattttccttgttgccaaattaatggcagttttgaaagctgagtgagctaccttaataagtcctgtgtgtcctgctgctggaagtggaggccctgttcttattgcagcatggtaatttgttgacagtgctgtggtgacagtgctttctggagggagttgaatagaaggttgagtccaatgcttacagtgagctcttagctctcagtagcagacatctgccacttgctgagctgcaccctgggctaggtgctgtcccagagacctcatctgcattctctcctccagctctcctggcaactctgtgagagaattcatgtcctgattcccatttgatagaaatgggaacacacagatgtatgaggtaacttggatggccatgtagctttgaaatgagaattaaagccacaatttcaactgaggtttccctgagttgggagcattcactcttacccctgtgctgtacttctttgcattttcacagaaacctctctttagatttctgcagggtggcaggttgcatgaggaagctctggaggtctcagttgattgtgagctcccatgggcctcctgtaaaagggcagccaaacaagcatggcctcgggctgatttaggggaagtgcaggatgcagaggccaggaggaagtcctctagacactgtttctttgcccaactttgccctggacacctgctctgtgccaggccaggtgctgacaccaccactgggagcagctggagacggcccccctgtctctgtgacgcatctcctggttaggacctattctggaccccacatctcacctgcaacacatcagagtagaatgtcccagctgatggaggagctggaagtggggccatgtgataaactgctgaagacatggacttcagcattgggtagtgaatagacattcagtgtggttttagaggccagaataatagatgatagtgtagtagttcaataaaatttaaggaaggagttctcatagttaaaaagggttcaaaatgaaatagatctttggaggtggccggctcctcactgtagaaatgccatagcaattgctgggtcactgtctgtagggacacagtgtccattcttaagggaatttggggcattgggtgagacttaaatgcactacaaaaacacttctcgttcctaagactgtgtgatctcactctttttagtttacttggtaaatgtcagtttttaactcccttttctttttcagagccggcgattagatactgaagaattaagtttgccagatatttctgcagaaatcgccgagaaaatggctacatttcatggtatgaaaatgccattcaataaggaaccaaaatggctttttggcacaatggaaaagtaagtggtcaaatcacttggtcctaacatagttttacagtggtggctcccagaagtaccataagtgagcatttgtttgccacagtagtcagaggtcttcctagttcactgaagtgcagggtgtcagctggtgatacttgtctcataagtaagtctttcttgtgtgtaaaagtcaattcctaaaccaggaaagaaggcttatgcaaaaatgctattgaacgggtgaagggacagaagaaagtcaccttcctagaatgccacgaacccccaaggccactcctcttcccctcagtcatggcagtcagaggggtcccactggcattgtgactgcgctgggattgaatgtttaaccaaagccccaagaacagcaagccttggtgaattgatcggtgattctttgttctgttcttttttgaaaattttttaataggtatctaaaggaagtgctgagaattaaatttactgaggaatccagaattaaaaagctccacaaattgctcagttacaatctgcccttggaactggaaaacctgaggtgagttttccttctatttcctgactttaaatattcttagtcactaaaactgttgtcagtaaacattgattgagcttgccttatgtctggcattttacattggttttacaggatgaatttaaaccataagttttgtcatctggaattatggttctctagaggactagagattatggactctatggactagaagcccacacgtggcctctggtcagtttgtgaaggttccattgagaaggaaaatgtcaaaggagtggcttggtggccagggcagtagagtgtctggtggggtggattttctctggtggggagaagggagtaagggcaggctggggagtgtgaggaagatccttcttccttacagttcaaccttggcttttgcgagaaacagagtcttcatactgatctctgaagcaaggccgtcattgtcctcagagtgatgcttggcgcaggccactcacatctgtacactaacaagtatttacaccttttttttttttttttataagacggagtctcgctttgttgccaggctggagtgcagtggcgcgatcttgactcactgcagcttcaccctcctgggttcaagtgattctcctgcctcagcctcccgagtagctggaactacaggcatgcgcccccacacccagctaatttttgtatttttgtggagatggggttacaccatgttggccagagtggtcttgatctcttgacctcgtgatcggcccacctcggcctcccaaagtgctaggattacaggcgcgagccaccacacccagccacaagtatttacacctttaattactcaggtttgtgcctcctctgctaggcttgatgatcgctgctgagggaaaacaagtaaacaaataaaataatgtcaaattgtgataagtgctgtgacagaaacagatcaaagtaggcccttagtctgcataggaggacctgcttgggtcactggtaagagaagggctgtctaagggggtgctatacaagccgagaccagcagagaaaggggctccaggagggagcggcacatgcagaggtcctccgggggaagagctgagtgcagagggcctgtggagttgttgccacgtaatgacgcagttgtcagaattcacatcacagatactactctgaaactgtgtgttgctttggagcacgaatttggtgctggccatgtggagaaagcaagactgtgtgcagctgactgagaagcgtgatgggtaacagtgaaacctttcttttcagatcattgcttgaatctactccatctccagttgtattttgtcataatgactgtcaagaaggtaagaattgctatgttctgttacagatgaggtttgtgtgcatacttagaaaattactggcagtgtgtctgaaaaatgtaaggtagcatcaagagtattaggtacattaaagtatgatacaaccagacaatgaggttttgtattatttttatagagtatgaggccagtcacaatgtctcatgtctgtaatcccagcactttgggaggccaaggtgggaggattgcttgagcccaggagttctagaccagcctgggcaacatagcaagaccccatctctacaaaaaataaaaacattagccaggtatagtagtgtgcacctgtagtcccagctacttggtaagctgaggcaggaggatggcttgagcctaggagttcaaggctatagtatgctgtgatcgcaccactgtactgtagcctggatgacagagcaagatcctgttaaaaaaaaaaaaaaaattacatggaagaaatccgaaagaatattcactaaacttgggaactgggatgaagaacttaaactttctaagtcacatattactttttcagtgtttaactccttacagtaaacatgtatgatttttttttaacctgaaaaagcaataaaagaacaagatccactgcctaccccattgagtcccgggcccttcccccttctgcaccacacagcgtagtgttgcttatcgcaacacgtgtaatcctaacacctcctctcctagtatcagtgcactgtgctattaattatttcgggcttctctgctttgaaaacatgacagtgatatgttccttactgtaacaaaacttcatcccatgcaattgcacattgaacagtctcatcagaggccccccactatgcagctcccactggtgctgctgacatggcctctctctgccttgaccttgcctcccctagtcacagtagttcaggtcccaccttgagcccttgtttgccaggctcagcagtttgcttttaatcctgagaacagtttctcatgaagactcgtcatccataagccattcatttgagccaaattaccttttactaattagctgctcatcgctggctaactcaaggagggtgtagacattacagctacagctttgtgtattacccttgcccttctggtggtgagggggtgataaatggcacagacatcactagagagaggggactggaggagatcggctgtgttgatgatggcaaagtgtaggaaggatcgaagaggtaacagttgtacattaattttgttgtgctactttgggcgtctgcctccaatttgccttttttttgagactgttactgtgtcacccaggctggtgtgcagtagtgcagtctaggctccacgtaaccttagcctgttgggcttaagtgatcctcctgccttagcctcctgagtagttgggatcacaggcgcacaccactacacctggctaattatttgtggagatggagtttctctgtgttgcccaggctggtcttaaactcctggacttaagtgatcctcccacctccacctcccaaagtgctgtgattacaagtgtgagccaatacacgttttctggtctccagtttacattgtaattgctactctaaatggaaaaagtatgctgaagagcctagacactatacctccactagaaatcctaaggagagagagctgctgaaaacctagcgaaggttggctcactggtgccagcagcaggatgtcggagatgctgaacatcatgtcgagtgtggggatctcaggaacgcaggcctgcagagccaggctgatggctgaccaactcctgacccagaatccaatactaaagcaaatagtcttgtaggaatgctgcctgtggtctccttgggaaggaaaagcaggcaagaacaaagcaggggatcccctgtggcagctgagctctcccttgcctttcttaccaggagggcactcccacagcttcccagctggagtgctgcagccagctggcctgcagacagcaaaccaagtcccagggctgctgagggtggtgtttggctagcacgagctcctgcatgccaccatgcagaacatttgggaagtactgtcctgacagcagagcaagaggccaggctttgttccacagtgatcctgggggtctggcgaggactagggctgtgagcaggggttctcatggccaggtgggtcaggagccaccctgcatagggttatgcctcccgtgagcacttctacgctctgtctaggccctggtgatgtccacagaccaaaagccacattcagttaggattccctaagggatcaaatccattctctcggctctgctgttcaaggacttgagccttctattgtaaaacataaaccatgttatccaaaccttttgcaggtaatatcttgttgctggaaggccgagagaattctgaaaaacagaaactgatgctcattgatttcgaatacagcagttacaattacaggtactgtgttacagtccagtgtttccatctcaatattgatttatcattacgatatgcttaattaacagttattagagaaaataagtcaaaatgccgctctgagttgcaagctgcttcacctggaatcagtggcttctcgtccagtggccggtgatggttgtggtgaagcagcacagccttctttgttcctagcagacagcgctagttggggacagccatgccattcagtccagactttggcattttcttttggcttcagaggtcattttcttctcataaatcctggtctaggagacacaatgttctggagtagtggttcaggtgcacctgtatagctttagtcagctgtgatgctgatcaaccacctgttgtctctctctgtcattaaagcagctacagtcctgctccctcagcaagtccagatggcaacaggagtggcgtgctcggaactcagcctttctttcttctgcagtcagggagcctccaggcatacggtttgcctcattgtgtgcactgtcttatgtcttatttcaggggattcgacattggaaatcacttctgtgagtggatgtatgattatagctatgaaaaatacccttttttcagagcaaacatccggaagtatcccaccaagaaacaacaggtaggagatgagtttttgtatacttgataggaaaattacatgtcaatttcatgcagttagaattacatcttcttttttattttttgaggcagggtctcactctgtttcccaggctggagtgcagtagtgcgatcatggctcactgtacccttgaccttctgtgctcaggtgatcctctcgcctcagccccccaagtagctgggaccacagacgcatgccaccacgcccagctaattgtttgtattttttgtagagatgggatttcaccaagttgcccaggctggtctcaaactcctgggctcaagtgatcctcctgcctcagcctcccaaactgctgggattacagttgtgagccaccatgcctggcctacatcttcatttttaaagataaccttttaaaatttggtttatgttaaaaaatgttattttgttcctgttaaatgtagacacaaacttgaccttttagtccagcttattaaaaatctctgtgccagagatacttgtattcagagaagagctttgtcatcctttgtagttccttgtagtatttttttgaaaagcccagccttgattctgctttctggccatctttttggtgatcactgacctttttctattcatttcacactatggagagagaagtaatctttcgggcaccagggtttagtagtgggaggaaatatctttggtgttaacagttccctttcctgtcctgaatgatgggaggaggctggtgattgtgtggagaatcagttctcatgggaatttcctcctgagatctttctctcccattcctcagcccagcactgaaaccttggtagcggtgctgaagctgagtaggattgggagggtgcaccaagcctgcctccaaaatagtggtctccagtttatgttttaagtgctactctaaatggaaaaagtatgctgaagagcctagacactgtatctccactagaaatcctggggagagagagcggctgaaaacctagcaaaggttggctcactggtgccagccccaggatgtcggagatgctgaacatcatgttgagtgtgtgtctcccagtgtgtcacagtagatgcatatgcttagtgacagctattgacattgtctattttaaccatcattgatcctaacacaattacttttttttaagctccattttatttccagttacttgcctgcattccaaaatgactttgaaaacctcagtactgaagaaaaatccattataaaagaagaaatgttgcttgaagttaataggtaacatttttccttttttgatttgtaaagatagctttcctctttatagactatatttgggagatgctgacttgcaattaggagtattttagagcttcttcttctttttttttttttgagacagagtcttgctctgtcacccaggctggagtgcagtggcgcaatctcggctcactgcaacctccgcctcccgggttcaagcaattctcctgtctcagcttcccaagtagctgggattacaggtgcctgccaccatgtccagctaatttttgtattttttagtagagatgggtttttgccatgttggccaggctagtcttgaactcctgacctccagtgatccacccagctcggccttcccatgctgggattacagatgtgagccactgcgcctggcctaggagcttctttttaatcgtacatctttaggacttgcactttgtcaaaaatagaatctgctacttctccattgtggccgagactatgcagagctttcagatctgagcatacagcaggcaaagtatattagtctgttctcacatggctacaaagatattacctgagactgggtaatttataaagaaaggagttttaattgactcacagttctgcatggccagggaggcctcaggaaacttaacaatcatagcagaaggcaaaggggaagcaaggcacatcttacatggcgccaggagagagaggggcagagagatagagaagaaggtaggactaccaaatacttgtaaaaccatcagatcttgtgagaactccctcactattgtgaggacagcatgggggaaactacccccatgatctaatcacctcctgccaggtccctccctccacacatggggattacaattaaagatgagatttgggtggggagacagagccaaaccatatcacaagaagagttcccatgtccaagaagggtcaggacactttgtggcattctgaactgtcatccagacacaacaacccagccatacagggctgctgccacccagagcctatagaattttttttttttttgagatggagtcttgatctgtcacccaagctggagtgcagctatgcgatcatggctcactgcagcctctaactcttagcaagcctcttgcctcagcctcccaagtaactgggactacaggcacgtaccaccatgcctggctaatttttgtatttttttgtagacacgaggtcttgctctgttgcccaggctggtcatgaactcctgggctcaagtggttctcctgccttggccccccaaagtgctaggattacagatgtgggctactgcatctgtccctgcaaacttgtcactgatgcttctggagtggcggccaccatatgctgtgttttaactcttaagtttctcctagaaaatgattaaacttatgtttatcggttttaagtcttgcttttaactgttttctcaacagttttcaaagcagggccctgaaacttccagattgtgcaaaggtctagaccactatttgtccatctctttagtcaagaggcctgtgggttgttcctattatttggggtctcctgtgacattttttggtagaatggctgtttaagtcactgtggcccctcatctttccacgcacttagcacagtcatctcctcgtggcctccagagtgctcacccccaacactaagtgtgatgtcacacctgcctacctgctgggctccaccgcagcatacatcatctctttctgtttcttgaactggtggaaatagaaaaaaacagatggaggagaacccagacagaaagggtagcacacgggactcttgtgggccggggaccacaggatgaacagagagtagggttggaggatactagagcaggcactcctaaatttgagctttatcttcatgtggatgagccctcagggtattgtttgaggaggaacttggattcacagtgacttgggggcttggtacagcttagagatggtgacgtggctcacgctctctgatctgctcttttcacttctgtgtgacaggaggggatgggacaaggatgggatttgagaattctcttgctcaaggagtgagagcttcatcccgcctccagcaaagggctgcctcttggttgctatggtgtgcaccctcccttgtagcaagcttgctttcttttctgccagcatggccacccaggccttcacctgcaccctgtgaatgtgaatatattcaccttgtgaatatattatggccaagtggcatttacgtgtgccatggccaggccagctgtgtgtgttcacactcaccagtgcacctgtcactagcagatgagggaagggtgtgggagtggtattcccattgttcttagttagtcccgtggaatatagacccatgatttgccaacactaactaggtttgcatccacacaagttaaaatgtccatctggcatgaaatcatttcatcagtcctgtaactgatactgtatgtctcttatatgtttcttgcttttatcattccaggtttgcccttgcatctcatttcctctggggactgtggtccattgtacaagccaagatttcatctattgaatttgggtacatggtatgttttagcagcgtttttgtttttttttttcttcctactcccaggtaaaaatgctatagtatttgtgaatgttggcagcaaatgactgttccttacagagggttctctgtctccccaagtacccgaatgtggtgacctggtggcatcaggacagtgtggctcagcccaggaagccgggggagaagccgctgtcactgatgctgtggttgcctttggaggttgccctcacttccaggccagctgaccttgcctcccctgcttcagagaagtgcctgcaatcctgatggggaatgtaggcatctgcaccctcgaagtccagctctgacctcagtcccttctgacacgggacagtaagtgaagaagagtgggtggctcctgcctgtgctgtggaaggttttatttatcggttaccacttcattctccagcctgtagtgcccgactttgggttggaagctggtaattattgaattagacctcctgtttttcataggcatgtttgtaaccaagctaggctgtcatttaattttaaccttaagaattgtcagccgggtacggtggctcacgcctgtaatcccagcacttcgggaggctgaggtgggcagatcacctgaggtcaggagttcgagaccatcctggccaacgtggggaaaccccatctctactaaaaataccaaaattagcatgcatggtggcgggcgcctgtaatcccagctactcaagaggctgaggcaggagaaccgcttgaacccaggaggtggaggttgcagtgagctgaaatcatgccactgcactccagcctgggtgacagaacaagattctgtctcaaaaaaaaaaaaaaaaaaaaaaaaaaaacctgtcactgacatagaaatagaaagtatttttaaccttcagacaaacctttctgttgttccatagtgaatgaatgttggtgagttgtcttggggtgggggataacacaaatgtccacagtctggtgagctgccttcctttgggacagggatgggactagttcattttgacctcctcagtcttatactacaatgatttctacttctaggcagaaggtttggtaatgcaaggatgatattaggtaaaagaaggggacattggatttttaaagcagatttgagtcatggtcaaatgatactgtacgacaaagcacacttcgtaacaaggaatattactagagataaagaagggcattttgtgataataaaggcatcagtacatccagaggacattaaaaacccttgtcttgcttcaaaagacatgatattaaaactgacaaaagtgaaagaagaaaatggcagattcacgattaaagttggtgatctcggccggttgcagtggctcacgcctgtaatcccagcactttgggaggccgaggtggttggatcacttgaggtcaggagtttgagaccagcctaaccaatatggtgaaactctatctctactaaaaatacaaaaattagctgggcatggtggcacatgcctgtaatcccaggtacttagggaggctgaggcaggagaatcgcttgaacctgggaggcagagtttgcagtgagccgagatggcgccattgcactccagcctggacaataagaatgaaactctggccgggtgcggtggcccatgcctgtaatcccagaactttgggaggccgaggcgggcggatcacgaggtcaggagatcgagaccatcctggcaaacacggtgaaaccccgtctctactaaaaatacaaaaaaaaaaattagctgggcctgttggtgggtgcctgtagtcccagctaactcgggaggctgaggcaggagaatggcatgaacccaggaggcggagcttgcagtgagccgagatcacgccactgcactccagcctgggcgacagagcgagactctgggtctcaaaaaaaaaagagtgaaactctatctcagaaacaaaaacaaaacaaaacaaaaaacatgggagatctcaccactcctcttctgtggttagaacaaaggaggaacacacgcagaaggagggatagggccttacaactctccctgccagcctggcctcatgcatgttcattaaaccccccagcaactgcagggtgcacattcttttcaaatgaatatggaatattcctcaagatagaccatatgctggcccatcagacaggtcttgataaattcaaagggattgaaataatactggatatgttctcagtgaaatttaagtggaaatcaacaacaaaagatagctagaaaattctcaattatttggaaattaaacagtacacttctaaataaaccctgggtcaaagaaattaaaaagaaaatgagaaaatattttaaactgaattataatgaaaacatagcatgtcagtatttgtgggatatacataaagcagtatctagaaacttacggctttgtagcttaaatgtttatattccataagaagaaacattacacaaaatccctatcaaaacattggcaaaaattaaatccactaacatatgtaaaaggataatatattatggtcaagtggcatttatccctggaatgcaaggctggtttatatttgaaaaaatcagttcatataattcttcatattaacagaatgaaggtgaaaaaccgtatgattatctcagggaccacaggaaaaagcatttgacaagatccaatgtgataaaaaaaaatctcagcaaactaggactagaggggatcttcctcagccagataaaggcatgtatgaaaaaccctcagccagccaggcgcggtggctcatgcctgtaatcccaacactttgggaggccagggcaggtggatcacctgaggtcgggagttcgagaccagcctgactaacacggagaaaccccgtctctactaaaatacagaattagccaggggtggtggcacatgcctgtaatcccagctactcaggaaactgaggcaggagaatcgcttgaacccaggaggtggaggttgcagtgagccgagatcacgccactgcactccagcctgggcaacaagagcaaaactctgtctcaataaaaaaaaaggaaaacccacagccaacattatcactagtggtaacagggaaaatgtcccctttgacccccaccccaagtacagaacatgcaaggacgcctgttctcactgcatgtcttctgtgttgtactgaagctcctagctggtgcagtgaggcaagacaaagaaaggaaatataggtgcactgggaaggaagaagaaacactgcctttattctttaggtgacatgattgtgtgcttttaaaataataaaggaatcaacagaaaagttgcttaacctaatgaatgagtttatcaaagtcacaagatacaaggtcagtatacaaaaatcagttggatttctacatggtagaaacaactgtacatggaaaaatgtttaatagtgtaagatatgtacattggaaactatgaaagagtgtaaaaaataaagaagtgaaataaatggagaagataccaccttgatggatggaagccttaaggtaaagatgctcattctccccacactgacctgtacattccccacaggcctaatcaaaacccccacaggcttctgtgtagaaattgacatgctgatcctgaaatttatatgaaaatgcaaagagtctggaataaccaaaataattttgtaaaagaacaaagaagacttctactacctggttataagacttctctgaagcacagaagtcaaggcagtgtggtggtggcataagtaatgtaaatcatccaggtgtggtggctcaagccagtcatccagcactttgggaggctgaggcaggagaatcgctagagcccaggagttggaaaccagcctgggcagcatagcaagactcatctctacaaaaaatacgaaacaattagctgggtgtctgtagcacatgcctgtagtcccagctgcgcgggaggctgagctgggaagatcactttagcctgggaagtcaggggagctgtgatcacaccactgcactccagcctgggcaacagagcaagaccccatctcaaaaacaaaacaaaacaaaaaacaaatcagatggaacagaatacagtgtccagaaattgatccatgtgtatataatcacctggtactcaacagaaaggccaaggtaatttaagagggaaaggattgtattttcaaaaaatgatgcaagaacatttgaagagtcatgtggagaaaaaactgaacctgattctgtgccataaacaacagtcaacttgaaacagataatagacctaaatgtgaaggctaaaactattaagtttctatgagaaaacacaagagaaaagcttagtgacctagactggtcgcggtggctcacgcctgtaatcccagcactttgggaggccgaggctggtggatcacgaggtcaggagattgagaccatcctggctaacacggtgaaaccttgtctctactaaaaatacaaaaaattagccgggcctggtggcaggtgcctgtagtcccagctactggagaggctgaggcaggagaatggtgtgaactcgggaggtggagcttgcattgagccgagatcatgccactgcactctggcctgggcgacagaatgagactccgtctcaaaaaagaaaaaaagaaaagcttactgacctaagcacagatttcttgggttacataaagcactagccataaaagaggaaaaaatagagtaagttgctgtgagcaggaaacacataaaaaccaaagtgctttttcccattcctttcatcagcaacaatcatcaccacagaagactaaagtgaccacgtcaggggtggttctccccgccaacaaacaagtaatcagttctggagtggacaccagatgggtgccctccaattccattacgacactgtctacgtggggacagagtcagaccccacaggttgagggttgagaccttaagactgccccccacttccaacaccagttgcaagtccaggcctctggaatttctgaccaactagccatatattggagttcccacgttcccctcgggttcaattaatttgctagagcagctcacagaactcagggaaacacgtaagtttaccagtgtattacttttttttttttaagacagggtctcactgtgttgcccaggctggtctccaacttctgggctcaagcgatcctcttgtctcaaccttccaagtagctgggactacagacattccgccaccatgcctagctaacaaagggtattttaagggtgaagagataaataggtggggtgaggtctgaaaggattcccagcacaggagcttctgtccctgtgggtgggttggggaactcattcttgttcaccttcctgtcagcctccacattcagttctctagaaactccccaaaccctgtcctcttgggcattttatggagatgtcattggataggcatgattgaaatgtggacaaccgtgttgaaatgtgattggacaaaaaaggtgtgatctaaacctagcaagacctgaccaggttcttcgggcttctctgtacagcattccttatcccagggtatggtgcaggaccccctctggaataagagtcttatgacccacagtcagattagagtctagctttgggcaggtgaaaggacggcagaaggtcagagagagagattctgtttactgtagtaagggctatgggagttatgagccagggaccctggacaaaaacacacatatatgtcatcacagttggactttatcaaaatgagtaactctgaacgatatcatggagaaaatgaaaaggcaagccacagactgggaggaaatactacaaatgtatatttaataaaggactcatatttaggatatataaagaactcataactcagccagaaaccaaacagcctgcttcattattattattttgagatggagtttcgctcttgttgcgcaggctggagttcaatggtgcgatctcggctcaccacaacctctgccttctgggttcaaacgactctcctgcctcagcctcccaagtagctgggattacaggagcccaccaccatgcctggctaatttttttttttttttaagtagagacggggtttctttgtgttggtcaggctggtctcgaactcctgacctcaggtgatccacccgccttggcctcccaaagtgctaggattacaggcatgagccaccgcgcccggcctcagcctgctttataaatggatggaagatttggacacttaagagaaacacatggccagtaagaatcttttcatgtgttttgtataattagtcattaaagaaatgtgaatcaaagcctcattgcgataccctacacacccacagtgatggctaaaacttgaaagaactgacggtcccaaatggcgagcacatggagcaatgggaatgcgcatgcgctgctgctgggaatgcagtcgcgacagccagtgtgaagatgggttagaccacccagcagccctcctggggaatttttccagaacaaatgaaaacaaattccacaccaagacttgcactcaaacactcatagcagcttcatttgtttgtctgtttttgagacagagtctcactctgttgcccaggcaggaggagtacagtggcccgatcttggctcactgcaacctccgcctcccgggttcaagcaattctcctgcctcagcctcttgagtagctgggattacaggcgcccgccaccgcacccagctaattttttatttttagtagagggggtttcgccgtgttgaccagtctggtctcaaactcctgacctcaagtgatccgtctgccttggccttccaaagtgttgggattacaggtgtgagccacctcgcccggtctgcaccttcatttataatcgtcccaaactggaagcagcctaaatgccagtcagcaggtgtgtggatacgacagtgccagatccgtgtactgagaacactcggcagtgcaaaaggaaggtggcaccagtgcatgacagcacaggccactcagagacagcacgctgagtgagaagccagacacgaggctgcatattgtatagtggcatttatgtgctactctaggaaagaaaagtccagtccatagtgacagatattgagtcggtggctgcctgtggccaactgcaagaggcccatgggagcttgtagggatgctggaaacacaggtctcctgactgcggtggtggagaactggctggatgcatctgtgaaggccctcaactggacacttaaaatgggctcatgcttgtagagtagaaattacagctcagttaatttttcaaaaaagttaattgtaatcttcctggcttctagaattgcagacttttagattaggagtgggtctttgagattgtgttgtcctcacacaacacaatcccagaaaaatagtggcagaaacagaacaccaagccgggttttctcccttgcctctcagtgtccttcttaaaagtcatgctgcaggagatcccgggaaataggcgatgggcatcctcttctccccttctgttctagactcgcctgtgtcccaggggtcttttgctctaaaaggtgtgttatgtcggtcagtcagtgcccacagcacccagggttagcaaggtgatgaatggtagcagtgctaagcatgtggatgagacgttcatcctgagaggcagggctgggctggcccatgcctataaaccaggcctcctgagaatgaaggtgtgtggggtgggctgggagcttgaggagcctgcacctgtagagcagcgaggcccccgagcagccctgctgcacaggccagtcctgtgcttttggtctcatgggtccgtgccctcagctcttgcctggggtggggattgggggacacatgggcagggttcaggccagcaggattccttgctgaggccttctctttgctgtctcctaggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaataaaaacccaacctcaagctgtcacccttggatgtgtcctgaatctcaggcagggctcctggtacctgaaggagcccacggagggctccatctgcacccactcagccccttagcttagcagtgctccgctgctctcagctggcatcccagcagcatgtggccccatcatcagccctcctccacctcctcctcttcttccccagcacactctggtttccctgcttctagcccagaagcgaagagccctggaggacgttggagactgggagcagtgctggtgcctggggatgctgagcggctgggcaggagggaggcttttgctgttcagccttctagagagttacagttttaagcaggtgaagccaaactgaatgaagcagtaaaggtgttgcgctcctgcacaggagctccagtggcttctcactcaccgtcttcctgtgcccaggccactgctggcctcactcagccctcgcctctgcctggtccacacgagctcgcttgcagtctcctcgcagagatacatgtggagccgatcttccaatactgggctccttcactttgccccactgtcagctcagtcacagtctcaggccttcctattctacccaggacactgccattccctaaaccaccctgggcccggccctggcccatcgtttctctccatgcagcttaactttcctggagcccctggtggtctctacatcaggccataagctcacgtggacaaggatgggctcgggcctgtgctgttcagtgcccagtcctccacgcaggtgacccaccccatccctatgtctccctatgtccatgccccagaggtgcccaccccagtgccttatgtgccattctcttggcaaactggacttctctagccaccactgccaggcacccccatgtcaaagccagggcggggctgactggtcatgtccctgggatcccacactgcacccctcctaaatcacactggggccactcaccacgagtgctgctcacctatccccacctcactgcccgccccaagtctctgcccagctctctccccaggagggagtaaggcgttgggttctggatttggtccagatccacctgcagctctccggagtccttcatttagccttctctgctcctaccccagcactgtgagcaccgtttctctaagctgaatctgctgggcatgtggaattaccttagagcccctgatacgacccctggcatccagaggtcctgagcaaagcagtccaggagccaatggacaggctcctcccagcagctggcctcagccacagctgtgggaagaaccactttgcagcttgttggcttctgggaagcacttcctctgcctcccagtgggggtgggacccaggccagagggaactgcagaaagccacccccattctgccagcaacgcaggaaggaccacctgggagggatcaggaagactgtagtctcaggtgaggggaggctgggcctggagtcaggctcagcccctgttctgaaccccggggtcctgggtaatgtctgctgctggggacagcctctacccttcctggcaggtgtgtggccttgggcgtgtgacaccatggccctgcatggagcactggccggggctcaggtgccccacactgctctgtacttccagacccctgaggcccggcaccagggcatggatattggcaccactcccaacagagagtaacccagacacccgctcacagccaggtgcacacctccaaggatggggagctcactcccctgacccggcctgggaagacatttgctcactccaagttagaatgtgctggaaacatctctccttggcccttttctgccccttttcaccccaagagtctgacattattgcagatctgctcaggtccaggccttgactt

SEQ ID NO: 12951 - DNA, 80632 bp, Human
ctcttttgaaagaggcgctagatcattgatcctctctacttctctactttgggtgaaaactaacttctttgacaggctgatggggtaaaaaaaaaaaaaaagttacctggctgttaactaaagattgatcattttttcatgtattttaatcacttgtaattcttctgtgaactgcttatcattttcttgtctcttttttttttttttttaacttgtctgtgtcttactgctttgtaggatttctttatatattctggacattagcttttcattatatgtagcaaatgtatcttttactctgatgcttacttttaattttatttatgttttcttctttccatgttgctaagttgattgtctccttttatggcttctgaatttttgttttgcttatgaagaccttctatatcccaagatttttaaaaaaatctgttttttttttctttaacacttcaataatttattgatcactagatcatttgggattttttaaaattgcagtattagattatatactattttttattcaaatggatagcccagtgtcccatcactgtttataaaatggtccagccttcccatctttagttatacattttagcaaatattaaaacctcataaattcatgagtctgtttctagatttttctgattttgagacagggtctctgtcacccatgctggagtgtggtggcacagttatagctcactgcagccttgaactcctgggctcaagcgatgctcctgcttcaagcctcccaagtagctgggactacagtgtgcgccaccatgcccagctaattttaaaatttgttatagacatgagggctttgctatgttgtgctggtcttgaactcctggctggagctgaactcctgccctcaagcagtcctcctgccttggcctctcaaagtgctgggattacagtcatgagctgctgtacccagctatatctagattctttagtttctttgctcttttgtctaattttatactaataggaaattatttaaattactgtagctttatagtataatttagtatgtgacagggcaaattcccacttttttccccagaagcttcaaaatgattctcatgcatttattcttgtatgtaacctttaggatcagtttgtccaattatgtaaaaaattaccaccgtgattttggtggggattactatagaattatagattagtttgcaggctatcagattttaacttaaagtagtgatttcaagctaaccttttaatctaacagtggctttagcctaagatattacctaaaaatttaaaactccctataatctaaaaagttatattatttaacttttcaaaaagtgtttgtgatatgaaggtctatttcttcccttctttcttcctgtttattataggctttttgtagtattaccataggaatacttttgtttaatacgtgtttctcagaagttttcattagcatgttattacataattagttgtattgttaaggtctatggttctatggcatccgagtttttctgagttttagcctatgtttctctgtgtcaagagtttgatgttaacatgtaactatagatgattgaagtatcttgttttcattcgatttgttttataaattgtgacaaactttagaatagtgtaatagtcttctagttatgtggcaatattactaggttttaggtcaaagatgagacagttaagagtgctgttttaccttatttattcccctaaaatgtgttatgatgagtgctataggctagtactaaatgttttatcgagaaaaaagggaagttcttttttatttatgttgaatccaaaatattaatgatgccaggccttttgttttggtattcaaaattttcagaaatccattctgaaagccatttcaggttgataacagtagttgctcagtcagtatttttcaaattttttgacagtgtgactcttaattgttgactgtgccatttttccagtagtaaacaatgtattttgtttcttctcatgcaggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaaggtaaatacttcaaaataacttcacagtgatttgttttaattgtatagttttttgctgccatgtatatgagcaagtgaatttaaaagactgtgcaaacctcacctgattatattattttattatgtgtattattttaagatataaggtggaaagaacactgcactgggagtcagggccacgtcttggctttgtttactagctgtatgatctttgtaaagtcatgtaacctctctgattggcctttagtttgttgttgttttatccgaggagaaagacatggtcagggatgcttactgcttaaggaaattaagaatagagaggtaatggatttggatagggttgcatgaaattagaaaaacattttatattacatgtgggaggaaattcaccttaattttctagtacaaaataggagagaagatgtttactaaaaagagttaaaatgacagagaaatcctcgttcagaagataataaatgctcatttcttgagcccttacagcaattttaggctggtattgatattcccattttacactcaaggaaacaggagcttagataacttgtccagagtcatcaacttgtgagtagtaggtaggaggtttggaattcaaatgtcttttgagtctatagtctgttctgaactattgtattattgaaaagcccctcctggccgggcgcggtggctcacgcctgtaatcccagcactttgggaggctgaggcaggcggatcacaaggtcaggagatcgagaccatcctggctaacacagtgaaaccctgtctctactaaaaatacaaaaaattaggcaggcgtggtggcgagcacctatagtcccagctacttgggaggctgaggcaggagaatggcgtgaacccggaaggcggagcttgcagtgagccgagatcgtgccacagcactccagcctgggcaacagagcgagactccgtctcaaaaaaaagaaaagaaaagaaaagaaaagcccctcctaactctaaaaatctattatttttaatattctatgggttttattgttttgataagcaccagcgacacaattacagtatagtgaattaactactaggataggtaggactgccacatttgtattttgaaggactttatttgtgaccttagggattaatgcaaatatctgccactttattatggaatttgccttttctttaatgtttgtataatttaaactttattttctaattacccattttaaagacctcttgtgttcattactatcaaattttgagaaagctgaaatgtgttttagatatctaaaatttaaaaaataatctgtctcttagttttcttacctgagaatttataataaatctcagaaggcaatgcattgtttatttatcattagatttttaaaattaatccagtggatatgtatatatattatatgaataaaaagttaggtctatttcaatgttaatatagtttatacatttatatagttacacatatattgtatatgtaacatatataatgtgtatatataatttgtatatatataatatttcatgtagttaatatagtttaagaaatgtgaatggaaaggtaaatgaaaaccctaacattagctttgggaaaaatctatataaatttttgtttatggattttgaacatttagttatattttagaaattggttcccagtcattccataagaagacaatcatattgaactatttcatcagaagtaatgactttcaggattgcccaagactctaaggattgtaaatttgattggcttcatgatgtttatctttttcttttcttttttttttccctttgggatgttatgaagtcaccttaaaaggaccagttattaaattgtcattacagaaaaataagttatttggggaaattacaaagaaagtcatttcaatcttaagagattacctaaaattacttcaagtccttagaaagtaaaaaaagaaaaaaaaatagaagattttaaaggtaaaaacagtataactttagcaaagcttgatatgaataaaagggtgtcctgggaataccagaaagtgtgaggaatctctgaaagacaagaaggacattggaatcaatttcaaggaggaagcattagatcagctcaagagaaaactgcttaaaaaaaaaaaaggaatgggagtgcttcaggatcctaggaaaaatatcagtgtagttggtcaagtatggtgtcagagcagccttataggcctacccccttttttgtgccatgtagcagagacagatgccctctaattaaaacagtgattataagtttgaatcagagccttaaggttaatggaaacattctggaggaactaggagcttctatacctagcagattacctgtccagcaatatgtctttgctacagtcacaaaggagaatcttgcagtaaacagaaatagcatttataggcagattaccaggattctcacatgtaaaggtgtgcaaaaacaagaattaacacagatttcaggaaaaccaacatcatgaaagagaagcacaaaattcagtaaatagaagatcctaacacaggaaacaaaacagaaagacatttaaaactatcattggtacctttcggaaaggaaagagggaatgtcatattcatgtagaaagattatatttccttataaaaagaacaaattagagaggtcttgaaaaatcttatagatggcctgaaaagcaaaatggacacattacaagagcaaattgataaattggaagcttgtgctgagtgggtttttattgaagaatataatgcaacaagagaaaaaatagaaagcatgaaggaaaagcagcatagatccacaggttctaatctctgctgagagcagtctcagaggagtgaactaaaaatgaataggaagaaataatcaaagaactaatagaagaaaattcctcttagattagaagggccctgtgagtgtgaagcaaggtgactgaaaaagatcaatgtttgtttatataattgtgaaattttagaacatctagaatagagaaaactctaaaagcttgtgagagataaatatttagaatacaacagaacaagactaaaattaataccagtattttcattttacaattacagaaaataaactgagaaatttattttcccaaattttgagggaacgtaactttgaaaggagagctctcaattttattaatatgtaaaggcataataaaacattttcacacatgcaaagattcatgaactttattattcatgaaccaccatacaaacagagagttgaggatgactgcagggttttgactgaacacctgaaagtaaagaatggccattaactgaaatggggaagactgcaccaggaatagacatttgagaagatcagaaactcagttttagacatgttaagtatgagattcctattagaaatctaagtggagatattgagtagacaggtgaatgaatgttcatgtctggatttcaggtgaggttctggtatggagatacagatttcggtgtcagttagcatatagtgtgttatttataacatcacgagactggataagatcatgaattgaaaagatgaaagattgtctaaggataagcaccaaaactttccaacagttacagaaaaaagaaatccagattacagaggtctaagacaacctccctttagggtctccaagttacatctttagctgaggtggttattgttattaggccaggaataattttttggtttcttgttgacttaatcacatctcctagaacctcttcttggtctcctggtcaccagactttgtagtgcaggcagcagagagtcttggagtctgaatcctggcctagtcttgccagagaatctgctcagcgcagcgcaagataaatatttgtgaagttgcctgtgtcggtcggagtcaagcaagtctttggtctctggaggccatctacagtggttgtgttaacacagaggaaaaccacaatgttgctagaggcctagagagggtcatgaagctgccatttacatgtaacccaaccctgcaggcacagggtctacagaggccatgctgtgaggtggcatattgagatgatctgaagaaacttgggagatgcaagtagggagctagttgaatcaagctcctgttctcagtctacaatatgaaacgtgcctgttttgcagaaagtttctcttagctttaatatctttgaaaagcagagacagccagattttaaaaaccaagagagtttagtgttcccgtttggtcctagctgctaaacacaggcacaggctacttggttttttcttagactgctttcatgtgtccttttagtgcagcatttctgagaaagctactagtggaaacagcagatatgggaacataggtggtgcactgatgtggcattctgtattgattcccatggaaaccagagactatacaaggaaatgagaacttcaacagaagtattattatttttatttcagaaataatagaagataatgtatctatgaaacaaaaacaggatggtggtttggacatggtggctcatgcttgtaatcccaacattttgggaggctgaggtgggaggattgtttgaggttaggagtttgagaccagcctgggtaacatggcgaggcctcatctctaataacaataagaaaaattagctgagtgtggtggcacatgcttgtagtcccagctactcgggaggctaaggtgggaggatcgcttgaacccaggaggttgaagctacagtgagccatgttcatgccactgcactccagcctgggtgatagagcaagatactacctcaagaaaaaaaaaaaaaaaaaaaaagaacaggatgatataaagaagaatattcagtgaacagtaaccattgtcattgaaaattaaaatataatagcaaaaataactgaaggaaagcattggaagatgaagttgagaagatcttttagtgaaacaaaaagcaaaagagatgaaatatttgggagaagagattaagttcatctgaggatcaatcaaggacgtcaaataccaaacaattaagtgctctaggaagagatcagtactctaggacgagatcacagtgatacagaggggaagtaatcatccaagaatatgatcgaagaatatttcccagaaccaaagaacacattttcagattgaaagggcctatcaagtgtccagcacaaacttttttatttggaaataccagaataccaaagacaaagaagttctacaagcttccacagaggaaaatagcagatcgcatgtaaaagacaaggaatccgaatcgtttcagatttctcaatagcaagacttcaagctagaagatacttctgaaggaaattaattttcatcttcggattccgtatctgctcaactgttaagtgtgacggtacactaaaagacattttcagacctgagaggcctcaaaatttttttaccttccatgcattctctcccaggaatctattggaggatgtgccccaccaacatgaaggaataaagaacagagaatcatgggataaaggaaacaggagatccaacacaggagagaagcccctggggaaaggatgacagctgtgcccaaggtaaagagggcaaccagtccaaaatgcaacacatcagagaactgcaagagggatttgtagaaaaagataaaattaaaagaatacttggtgttctaaaagagaaatgtcttgtgagaccattttgccagtttgaagagatttgatggttgaattagtaatgaacacctaaaaatataatcagacaaaacagattaactctaggggaaacaaaaagttgtagagaaatgaaaaagcaatcatattatgctgcagtggctcacatgtgaggtaggggtcatgatatatttttttttcctatgctgatattcttgttgcagcatcgtttgcagaaaagactgtcctttcactcttgattggttttgaaatctttcctgaaagtcaattgcccataaatgtataaatccaatactagcatctgtattctgtccattgatgattatatctatccatatgctcataccatactgtctttattattgtaagttttgaaacctggcgtgacaaggttttcaactttgttattctttttagaatttattttgggtattctaagtatttagcatttgcacataaatttttgaatcagtttgtgagtttcaacaaaaagcctactgggattttgatggagattaccttaactctacagttagatcattttgaggaaaaatgacatcttaaaaatgttgactcctttagttcatgaataaggtatatctttacatgttttaaaatttctttagcaatgttttatagttttcagtatacataatagtacagcatgttttgttatattatccatattttatgtttttgagctatggcccatgatattgtttctttttttttttgagatggagtttcactcatgtcacccaggctggagtgcagtggtgtgatctcggctcactgcatcctccacctgccgggttcaagtgattctcctgcctcagcctctggagtagctgggactacaggcgtgtgccaccacacctggctaattttttgtatttttagtagagacagggtttcaccatgttagccaggatggtctcaatctcctgacctcgtgatccacccgccttggcctcccaaagtgtcaggattacaagcgtgagccaccgcacccagcccgatattgtttctgaaatttcactttccagttgtttattgctaatgtaccacttttgaatgttgaccatctatatcaagaagccttgttaattaaataggttccttagaattttctacataggtgattatgtgttctatgcaaaaagacagttttactctttcctttccaatctctgctttttaaaatttttttagagacaaggtcttgctctttcgcccaggctatgaagtgcagtggcacaaatatggctcactgcagtctagaactcctgggctcaagcagtacttctgtctcagccttcccaataggtgggactataggcatgtgccaccatgcccaactaattgtttaaaaaatttttttgtaaaggtctcgctgtgttgcccaggctggtcttgaactcctggcctcaagcatccttccacctcagtcccctccaaaatgctgggattataggcatgagtcactgcacctggctctgtgtttttaaattctttttcttgccttaattctactgggtaactcctctagtgtttaatattaaaaagaagtgataagaaagatatctttgttcccaatcttagcaggaaggcattaagtattacatcattaagtatgttgctgtgtgtgcattttttggtctggtctttatcaggtcaaggaagttttcctttattcctaatttgctgagagattttatcatgaatggtgttgaattttgccaaataccttttttgatactattgagatggttatacttttttctccttttattctgttgaaacagtaatttatgttttttggttttttttaaagcgatagggtcttggtctctcgcccagggtggagtacagtggcctcattgtagctcactgcagcttcaacctcctgggctcaagcaattctcctgcttcagcctaccaagtagctgggactacaggtgtgcaccaccacacctgaataattaaaaaaaattttttgtctttgcagagactgggctcgctatgttgcccaggttggtcttgaactactgccctcaggtgttcctcctgcctcagcctcctaaagtgttgggattataggcacgaaccactacgtctggcctatgttaatttttaaatcaccttttcttctcaaagataaaccccacttgattataatgtattaccctttttatattcagtttgctaatattttcagaagatttttttgtctgtgtcataaagggtatttctttgtagttttatattgttttcagttttggtatcaaaggaatactgtccacataaaatgagttgggaaatgtttcctcatcttctgccttctgaaagagtttgcgtgtcattggtattctttttttatttcttttctaaattcatgattggcatggactctactaggtatcttcgttggaaagacacctatgaaaactagctatcacaatattcctgtatgtagacctctgggattctttttggactaactccatctttgtggtattttgcccccataaatttcagttgtctcagcctcttctaatttttatcactgtctgtcccctccattcattatgactcttgaacccagtaccaggatctggtaagtactggaagagcagaaagctggggtagttatggtattcatcggtcttatttcttttttctcagagatcacagtcctgctgttcattgcctgtttcttcagtgtctgaaaatagttatttcctgtattttgtctagttctgcagttgtttatgatgatagggcttgtctgttactttcatggctggaagtggaagagtgtaaataacatttgcattttataataatgtaatcctgaatattgccctaaccaaagttatggtagaaattagaaagtggactcgggatgtttgatgaggggaactgacagggctaaatcttcaagttgcataatgtgatgatatctaaaactgagaaatcaagaagtagcaatatggatgtattatttagagatatggtagtaaatgacaaagaatcatctaaaagagtcaacatgattatttctaggaagaggcaactggttgtagaggaggagggaaaatgggggactgctctttttcctaacaaaacttgtagaaccaattgactagaagcatattcaagaaaaatatcaatgaaaggagggaaaaatgatacagtgggcaaatggaaatcataggaaagaagatataatagtactgatattagtcataatgaaattcaagatcaaacacattttaaaagggcaaaagttccacaaagtcatgaatctttacttaacagtacaactttgaagtatattgagccattataaacaccaggagaaactgacatccgtatttataatggagagacttccccttctgtattttagaaatagatgaagtagacaatgaaaagaaaatggggaatttgaataacagaattagcaagatgtgtgtgtgtatgtgtgtgtgtataactttgtacagataaatttgtcacaatgttaaatacaagagcagtggtcaaaaaacaggccacaatggaaaaattagccaattccaaaaagtaaatctcccttgtgtattttaaaaatttatcctccttgggagactttttaaatctgtgggctggtgaatttccttagttcaagataaaaattaagctattatctcttcagatacaaccttttttctctttcttctcctctgtgactctgattaaatatttttcagattttttttcactgtcttctatgtctcttaatctcttttctgtatgttctttctccttcataccttagtaaatgatttattctgacctgtcctcatgtgcgaatagtttgttttgtatccaatctgccactaaatatgtctgttgagtttttaactattggttttgtgttttccatacctagaagtaatgtttgctcttttttttctcttgctgttattttaaaatagattattataccctgtaggtattttcaaggttatatattttttaaacagataagcattattttttaaaaacatctttgtccagtaattccagtggctgaagtctgtgggctatatttctgcttattgttgctcatgttgttgtatttctttgtgtttggttaatgtggctgcttccttgttattgtcattgagaaaattatttgtaaggttccccaaggactagtgtggatttgctcctctctagagaggcttcaatttggcttctgctgggtcctgtaagcattggcattagggctgccatgtgcttaaaggtttttggtctagccaagcaatatatctccatgctgcaactcttccctagggttgatttcaacaatttctccaggatggttttcccctacctactttttcttttttcttaccttagtctgacctttctgtagtttgttcttaccctgagactatcctctggtttgtaatttgttcttatcctgagcccaccgtttggaggtgggctgtatctcagcttatcatggaacctatcttgccaaagactaccatgagctggtgttgggctttgaatgttctttctccttagctctttctctccctaccccatttattgttaatcagattttctgtttaggctctgaatttttactttcaaccaaaaactggcttgggatttttccagtatagatttttaggatgttagtaagaagaaaaaaaaaatttttatgttgtatttttcatggtttttagtaaaagggttaattagctctccattactggaaactagaaccctaaaaaaatagtataatcaaattagatgttaacagcaaaaggattttttaaaagttcatttacctgtaatacataaattatggtcttccataactcttggtttaaagagatcaaaaagaaaattacaaattattctgaatcaatacttggaacatgatttctgaatatctggcatgaggcccaagtggtatgcagcagaaaagctaaagctgtgaatacatttattagaaaacaacaaaaattagaaaaagaatgagtactatgacagtggaagggatcagaaaaagaaatcagaaaaagaataagccctgggacagtggaagggagtgagtaagcagaattttgtgaaataggaaaaaaaaaagtttttcaataaagattagagctggttctctgaaaagaccaataaaataattaaagtcttagcaagtttaataaaaagtaaagagaagacacatgtaaatagcatttggaataaaagtggaaacataactacacatatggaagaaattaagtaattacactagaaactgcaaaccatgttaactagtaatttggcagtttataactattaaaaatagtgttatatctaaatacttctccataggcaacctattttgcattagtttgatatgtaatgcacaatagtatgtttaaagagaaattttctgcttgtaacttttcatttgatgctatattcctagaaatttaacatgtgttttagtcaaaaagttgatcagatatatttttcctttttttttttttttgagatggagtttcattcttgttccccaggctggagtacagtggcgtgatctccactcactgcaacctccatctcccgggttcaagcgattctcctgcctcagcctcctgagtagctgggattacaggcacctgccatcacgcctggctcatttttgtatttttagtagaaacagggtttcaccatgttggccaggctggtctcaaactcctgacctcaggtgatccacacgtctcggcctcccaaagtactgggattacaggcatgagccactgcacccagcctgtatttttctttctttctttctttttttttttttttgagacggagtcttgctctgtcacccaggctggagtgcagtggcacgatctcggctcactgcaagttctgcctcctgggttcacgccattctcctgctccagccttctgagtagctgggactacaggtgcccaccaccacacccggctaatttttttttatttttagtagagatggggtttcaccgtgttagccaggatggtctcgatttcctgaccttgtggtccgcccgccttggcctcccaaagtgctgggattacaggcgtgagccaccgtgcccagcctttgtatttttctttatatccatttttagtgctagtaatattagctttgtgagtctcactgtctgcagttattcgtgtttggtttcttcatttccccccgcttttttgaaatagggtcttgccttgtcacccaagctggagcacagtgatgccattgtagttcattgcagcctcgaactcctgtgctcaagcatccctcctgcctcagcctcccaagtagctgtgactgtaggtgcacaccaccatgcctggataatttttttttattttttgtagagatgggggtctcactgtgttgctcaggctgtcttgcaatcctcctacctcaccctccctaagtgctggaattacaggtgtgagccaccgcacccagccctcccatctttatagtctacctctcatccttattttattgtattagtttattgatattctgaccttgggtttgtgcagtaggtatatatggtggtgtgtgtagtgaaggaattgtaatggaggaggaacttttttggaatacatgcttttccaatgttttaataaaacttttggacaagttgaagttaataaaccttttgattatgcatttgctatttgtggttagcatattttatatttttcaggtgttaagattaaacaactagtatttataacttcttttaaggtactggaataagatatatttggagggtaaattgtagtagaatactctgtctcatgttcttctgtgtttgtatcttttgtattatgtagcagttatgttccaacaacgttgactttgaagcctgatggaaatatatttccataggaacaaaacttggaataacatagcaaaaagactaagagaacaatataactcagtgttatatgcttaacatgatggtgcatcagtaatatacttgataagagttgatattgcaacctgatttttcttacttgtcactctccctcaatttttttgtgttcatgtattttcaaatattacatgactttgcctcatgtgtaatcagtattttatacaacctcatagaatactaacaaaggaaacagcttgagggtgtttgtcacattctgccagttctcagaaaaatctaagtcccagaaaagttacatcattgcttcttacgccttctgtgatgaagaaccagattttttcttttctttcttttcccctgtctgttgaggactgatatagagtgctattatgcatggctaatattttgcttgtgtcatatgttcgactacattgaaaaatatcttattctgcagagtccactggtgatggacctgaatgttggggtagtgtcagttgctctgagagtttctgaacgcttatctcagtttttgtactttccttgttatggactggtaaaaggcagtgcgtcaactatactttgaaacaaaactaggagcaatccatgtgtttgatccattcaggcagtggagcatcggtgttttagatgtcagtgaagagcaacagctttcaaatgaacttgtttgtttttttttgtttgtttgtttgtttgtttgtttttgagaaggagtctggctctgtcgcccaggctggagtgcagtggcacaatctcagctcactgcaacctctgcctcccaggttcaagcagttctcctgcctcagcctcccaagtagctgggattacaggctcatgctaccacacccggctagtttttaaaaatatttttggtagagacatggttttaccatgttggccaggctggtcttgaactcctgacctcgagtgatctacccacctcagcctcccaaagtgctggaattacaggcgtgagccaccgcgcctggcctcaaatgaacttaattgtaaacacttcagaaggaactaccccaggaattctggggtagaaaacagcttttctaggtgcaaatgaaaaatttaagttatcttatagaaaagtgttttaattagttaatatatagttcacttttatatctttttacatttgtgcctttagagctccaaatagcttcaagggattaaaatcatccaggcagatagattaagatttgaaggagataattaatgtaggtacagaaaagtaagtggagaaggaagttttgagaggaaggcattaagaaaaaacttaaatgtggatgactacgtaattgattgaggaactgaacttaccttaatagatctttaactgtttggttccttaaattaaaatgcaagaaataatttatgttttaataaaaaatgtgtgtgtgtgtgtgtgtgtgtgtgtgtgtgtgtgtgttttgtttgtttgtttgttttggtggcttttaaaacacagaaatgctgagttttcaattctggagagtagcttttgatgtttgcttggcaaatatttattgagcttctgaaatcatactaaatttatatttgatcctggagaaagtcctaaaatcataccaaaatcaggtaaattactaagcaagctgctttgtatgccttccactcacaaataagttggagtatgccaaataggatccactaactcaaagatccagattcttaatgtgggaatcaagtggtatgggtgtttacatcctaccaaactgttaaggattaagcctgaatcttttttgggtcaccagctctaattcattgataacaaggtaaactatgaagagtattaagtttccttaaaaagcagtaagttaaaattgaaagtgggaataaaagggaaagaatagggttcttggagacctcagggtatatactagtaaaagttgtgaaatataaggtgaaatctcactttcttaattgccgtcagcgttactctgggtatgttcacaaatttgagaggttttttttttttttaacgcttatatatgaagagatggaggttaactttactttaaagtcatagcaaaatttcaggcctgtagctatttcttccacccttccttgtttccacctttttttttttttggtttggcattatttctgttgttccccactcttgtattctgataggtgccaatttccctaccagttgagtttccatccctggaatctcttcctatccagtttaaaatattatggcatttaatgtgcccctatgttggtgttgtgtgtgcacgggtcttgggggagggaagaaaagaaaaaataatgtgccgcatcttccatttatcattaactatttgtttttagtagtaataattgacttttgaatacttatatgtaggacacagtgttaatcactttataggtgaataaataaagtactgtagtttccattttacagatgagacgactgaggtagaaaggtcatatgactttaccaaagtcacttagatagtaatggctgagctaggatgcagtgccagcattctgtctccagagccctcatttggtagccctggcattagtagtaggaatgaaaatggtatcaaaatgctaagaaagaaaagatcacacaacagtgtgattgctagtattatactgagagattactatgttccaggcacagtaataattgctttaagaacaaatgtgtaacttcattaatctcctagcacatagtaggttttcattaaatatttgttaattataatgtgtaaaacccacatttagatgcaagaacttacactccttgcctcttacatagcaccttagaggcttaatcttcccataaactctgttggacactgcagggaatatcaagattggtttgttgttgttttgcctttaaaccgtagatgttttagcactaaaagtggtctgtgctaagctccaaaaaattttttattagaactattttatttaacatttgtcttttattaaataaaaaaattttttaagcagttaaaacattctaataaagggagaatgtaacagataaccacatacccaccaccaagaatcagataattacttacgcagtttttttaattaatttaatgctaacgtctatgtttgtttcatgcttaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggtaagtcctcttgttttctttgtcatcttgatattttttgtttccttgtcttacttggaaataatatttgaccctgctcaattgtgtgattcctctgaacacattatatcttgaaggagaaaataagaaattacttttgaataattgctaagaaaccaatgaccagtcgtgatcttaggcaagtgtcttaatctttcttggcttcaatttcttcagttctaaaactaaggagttgaactagatttctaacgtgctgacaatctgtgaaaattggataatgattctattttgctgttaaggctaacatgtgatatgaatactctgtttcttttctcttttctgtgtctgtataagaaccaacagtggaggtgcagttgtttgaactcactagagattttagtaacctagattttaaaaattctgcccaagtagtaattcttgatttttcagaactattactatactgtctcatcattcttattcattttaagccagtttggaggaagagggagaatttggtaatgtgaaataaaggacccaatttctttgtcattcattcgggggaggagagagcttaaccttgtttcttagtacctcttttttctcttcttccaccaaaagccttgttagagtaatgtcgaactcatactttccttgaggcccttggatatgcatctggtaatttttagtttctgatataccatgagatactgactagattgttgagaaggcaaatataagctgatcgacaggcagagtgtttacttggtaggagagagctggttttgggggatcttccaaaagatccttgagaagaatttaaagtaatacttggcatggtaccaatcagaggaaagattgtagtgaacatgcttaaggagataggaaccttgggaattggctgagcgtgttaaaggccccagaaggaggatctttaaggagtctaatgtctgtttttgtaaaaattaatttaaaaaatagttaatctttattgatgatgtgtttatatgtgttgcaactatacagggcttcaaaatcaatacgaaatgattttgaccccgcgaaagtcagggacattagtaagaaggatctgtcatggatgataaacatggaggcaactcaagagttactatgacctaggtccagggatgctggcagtcgttagttacatgatactcaggacatcaagttctttccaaatccaaaggagtggtctagagttgatatagaaaaagacttctttagtaagaaatgttcagcaaagagctcattttaggtgtatgactcaccttctgtagccagttctccctcttttttttttaagctagtggttattccccagacagagagaatcctgcctcacctttgatcgtttccttgaacaacatctcaactttgcactaatccttttatctccatcttttaactctattaaatagagttaaaaaggtgtgagctaccttttttctaaccacagggcacttctatatactcctctaaccaacgggcacttatgccagtatttacacctactaatcttactgattagaatctacttttttttttttttttttttttggagacatggtctcactttgtcacccagactggagtgtagtggtatgatcatggttcactgcagcctcagcctcctgggctcaagtgattcttgtgcctcagccccccaggtaactgggtctacaggtgcatatcaccacacctggctagtttttgtattttttgcagagatggggttttgccacattgcccaggctggtcttgaactcctgagctcaagcaatctgcctgccttggcctcccaaagtgctgggattgcaggtatgagccactgcgcccaacctagaatctactttcacgtttctgacgtgcagttccagtaaatgaatggaacttttatcttgatttgagagctcttggatatggatgtacctgtttttattaatacatcttggatctgatcaactgtagtactggaggcatatgaaatagcatccaaaatttggatgaaattaaggcatagactgaatatgatatttggattctaagtttcctacctcttttgggtatgtgatttataagagggttttttgtttgtttgtttgttttttgcccaggctggagtgcagtgcacaatctcagctcactgcagcctccaccccctgggttcaagtgattctcctgtctccaccacctgagtaactgggattacaggtgtgcaccaccatgcccagctaatttttttttttttttggatttttagtggagatggggtttcaccatgttgactaggctggtctcaaactcctgacctcaagtgatccacctgcctcggccccccaaagtgctgggagtacaggtgtgagccatcgtgttttttatttacttacagagatttcttatttccgtttcaagtaactctagtaagattaatcttaactattatattgaaggaaatgaatctaagtagtgactactgaaagagagtactttatcatgagtctaagtatacttaaaaatatactctactagttttatatgtttgaaataattctttcttggtgagaggacattggattttcttaaataaaataaatgggtgctttcctttatttctcttgaaagtccagaaagaccagagacaagtgttttgttttttattaaatagtaccacttctaaataatatcttttaaaattctcttaatttgtctttataacctttttagtatttggaaaacttctagtgaagttggcttcactcgaaaactcaaaagaaggttcaaattgttagcgtcactttcaagtcaaagaaggatccttgtaatttacttatctttggatgatgaacaatttgatatttgacctaattctgattaacagaataggagagtttaggaacaattaaagcttattttgaaaataatttttgcataccaaaaagcttcataccaagattgattgtcaaatgtattcatttgttggttgatagaaaaaaaaagatcttagaagacaaggtaattagagccaacgatagaggtaatgatgatcaccttctaagtcctaaaattttagatttgtgaggacctaattcatttattctgcaaattaattcttgaatacctactatttgctagatattttgatgccagggggcgggtaggggggaagtagttagcaagccagacacaagctcacagactggtagggaagacagaattttaagtgcttaaatgtgtgctgagtatttataaaaggaaattacacagctttttgggaacatatattagaacacttagctagtgtggagattgacaaaaagcttctctgaggaaaggataattagggtcagcttgaagaattaataggtgttatctaggtagcacataaagaagagtgccctgggtatatgtgataacccaggaaagtagcttgtttgatgagctatgactttaaagacacaacatttcattttacaaataagaaactgaggcaaaaggaagttgagtgacttgtccgtggtcttacagttcctattccagtgtattctgtgttgattattggcatgttgttcatccatccattcatttattcactcattcatccatctgattaccaagtttttgttttttctctgtagtatctatgaatacttgactgttttcccaaggaatatatagcaagatattttggtactagacatgcccttgaacatttataattctgtcacatggcctcttattttctatgttagtaggaaaattggcccactgtgaaggacatcgtgatattgagtatatagataatgtgctgatgtacagggtgctctgtctactctccataacctttgttagttcactagaatactattttgctagttgtttaggcagaatctggagtgttcaagttaatatggaaagtttaaattcattgtttttcccttgcctgggcagcctatttcttatcaaccgcttgccatttgctaatactttgaggcccactattgttacaaatccgtgtaattctttttgtttaatgctaagatagttcagtttttcagtaagcatttattgagtacctgcaatatgccaggcattatttaagacactgagcatatactgataaacaagtagtagtagataaataagtagtaccttcctttttacgaaagtaacaatatgagaagtgttgtgtgctgtaaaggcacaagggatagcattccaccttgggagggaggtacgtacccctctgctgtctttggggtaaagtgcttctggcacagcaactatacaaatgcttctggatgagaaagacctcaatctgcaagtgatttgtttggctggaagattagattgcagtggtgagaaagaaggtgccaaggtaagtggtaatggatcatgaagggctttctaaccacgctaaggagtttgcactttatcctaaaggcagtggaaaacttttgaatgttcttaagaacagagtgacacggttagatttgtgctttgacagtaccattctggctgcagtgtgaacatgtcatcataattacataccaatctcatgttgttataaaggtgttacacccaaacgttggccagaaaacatttccataaaccagtggccttcaaccttatccgactcagtgtccactttttaaaaacgaatgtaacaccccttgactttcatgaaatgacttcttgataatataatttgtctacacacataatttgaaaaagtatatataaacaaggaataaaaggaaagtaattataaaaagactatttgtacatataaatgcttgtacattcctactctagaaccttgctattcaaggtgtggcctctgggcccataacattaatatcactggagagcttattaggcaaactcttcagccctgcctcagatctgctggatctgaatctgcattttaactagatcattgaagaatttctttacatattgaggctctaaagtactattttatcctatgtaataaagaagtaagatacttgcacctatttgtaaaatcatggactgtgacaactacaaatgcagattgttactggtgtatgaattggcaactcaggtaccatgaaacatcaataatgtgatttttctcagataactcttagtaaaattttaaacaaagctgggaaaatactttgtaattacgtataatatgaaatttgtttctggctcaataaacagcttcaggcatgtcttgcagggcattcagaaattgtgcgggacaattctttgttgtacggggctagcctgagccttgaaagacatctctggtccccatccactgaacaccagtagactctcccagtcactttaacagtctctcccaataaaagtttccacaaatttccagactgccccttgagtgcttccctcattgagaactactgccttaaacctatgatgctgatgcaggacaacctgtgaccggcctgactgaaccctttggagcaggtatcttagctatgacgctggttgctgagttggtatgcatccagctggaatattgaatgcagttccaaactccactagccagaaagctttttcaaactctgctcttctctctttatcaaccctgagactttgctacggatgacttaagggtcattgtgttagccactgttactatcatatccctcaggggttttgggtggaaaagagattgaaactcagtgtaattacctcaccttctaatccattagaattggctacagcaaacataacagttaccttatacttacaagcacctaaaataaaatataagattaattactttctattaattaggtagaagactaagaattaatgatacacccgccgtagatttattcatgaagctttgattctatcaaatgcagaacataatagctaaattataagtctgtaagaatattatcaaatatgaatgggaagaaatactttacacacacttgaatagttacatgcagaaagctttcatttgcagagagcttgctatttggagagattgtaggaacagtaggtctaaagatacattctaggaaaacagaattttgaggtagttgcaaattatgtgagatgtctttttatcaagttacataccggtcaaattagccaaggttaagtttgtaagagaagctgaaagaatgcatatagtgttcacaaagtaaaggagatgaggtacgtaggtaccaccaagaagtaaccaggtaataaagaaagaaacgtgtaaatttgtttccgaaatgttacgtaccaggaaaagtaggggaaaaagcctcatgagacagatgagaaatggtaaaactgattgacataggaaactgtatgcacaatgataaatcataaagcatagagggttgagtgggcactctgttacttgaaatttgtgatttataaacagtgttatatacaatagatttatgagtaaagactgtctttatgtctgttctttcaattctgtctttacctttaatacataattttggtcattgtttttgaagaattgctttcgtgtaaggatcatctcttaatggcaatgtagttaagatctttgatctgttttgtgtttaagaatactgtacaggtaagatcccatagactattggagcagttattagaacatagtagataataccaaatttagtgagtctcagtttctattcagtgggtcaagaaaaaaaatagcttttaaactcttttgatttcctataggttagctacacaaactgcaattaggaggtagtgacatttattagaaaactttaaaaattatctttttccttttgctgaagagggatgatgaatgtctccattataaggataaagttgtttaaaatggggacagtttataccttatttcttcttcttttataggttttaaaacgaccagaatattttgggaagtttggtaaaatacataaagttgtcatcaataatagcacatcatatgcaggctcacaggtaactaattttagggatttttgcttttcctccctatggtctgggcttgacctgggctgttccaaaggaaactttgctctctctgattagaaagcttgagggacaaggacttaagcaatgtagtgacctctgttggtggggtgggggattttttgctgcttatttgacccttctaggacttaacaattaagagggaaatagtaaaacaaacatttagtgatggagtgaaagggagggggaggtgagtctgttatcaggcaatgtgataaatagataaggattcgatagtgatttctaatctgtaatattttcagatattgaaaacttaatagtgtctttgttatgctgctgttatcagatagaatagttttccagattgcatttatttttgagaatgtaatttgacatagtctttaagtcttattttttaatctaaattttaatttttttataaccttgacgagcctgtcaaatgactgtctaaaaaaataaatcccaagccaaagtaatattttattcacatatattacagtattcttaaaatcagataaaattcattgagtattattactttcaaatgagctagtttagtgtttaatcaaaactgccactactactactaattattgtcattagtaatagtagtagtcagggtctttagaattccctaggttgcagtagaatttttttagtattgtttaatttttaactaataacagtggaatgggatgttttcactttagggtccaagtgccagtgcttatgtaacctatatccggtcagaagacgctctcagagccatacagtgtgtcaacaatgtggtagtagatggcagaacacttaaggtaatatagtcctcttgattcttttttttttttttaaggaagacgagataaaatatagtaagtagaggagaactgagcatttatatattaaatttgacagttaatttgaagagtctgtcttagggtccataccatctattatagctaatttgtttactgctggtttctgtagggtcctcttttaccagataggaataaacacattcattatcggggataatcttttaaaatatcgcatttttacatatatcttattttgtgaaaatagtaccattattttcttcagaaataggtagtccttaaatatatggacattgattccagtttcagtgaagagtcccactaagcaaagctttactgttagtggaaggaggatggcataattagaaaaaggaatttgccttcttatgtgtctaaccactcataacatggaacagatttttttgtctatctcctctccttatatctagggaagatttgggtgtccaagttttggaaaccatagacagatgtttcctttagttcttccaaatgagcctcatctataataaatcctgctaataagagtttagttctctagtatttgcagccatactttttgttttgtcatgtttgtgcctcattttaggtgacttgaaaacactaaacatggagattctcattgtgttgtcagttcacattgagtcttcttttcctttacccctcttcctcctgcaggcatctctaggtacaacaaaatactgcagttacttcttaaagaatatgcagtgtccaaaacctgactgcatgtatcttcatgaattgggggatgaggcggccagcttcacaaaagaggaaatgcaggtagtaaagtcatgtgaattatcaactttgcagaaaagggagtacttttttttttattagttaacattgcaaaagcaaaaactaaggatttgattttgtaaaaactgatattactttaaagtagcatttgccaaatgaagtgtttaatggaaggtcagttctgcaggatattgttacaataaaaatgtgtctgtggtcaactaagtttgaaatgctagattaatgaagatgaacaggtttctttgctttaagacttttcagagtccttaatatgctaatacagatccacgaagggaatttacaaccagaacttagttgaccaggaaaacactttgggaaatgctattttaaggggaatgtcaacaaaatgaaagctaagtgggatattgtaattatttgttaaaccaatctatactctttacagagcttgctagaaaataatactctgtcaaatgatgctgataaactaatattatttttacaaaattattctccccatgcaagtgtccactgagtcagtatcctgtaaagggtgaattgaaggcttaatatcctatgttcttttttacatttcctcttctcctgtctcctttcaatttgtagtataaacatgccttaacaagtaaaaatgttgaccatacgacatattaaatgaggattataccaaagcacaatgctgcacttccctattgtagatgaggacttcagattgttgctgtggacttttcaggaatacttctcatttagaaggtggggggcattcattgctacctttcattctccaggtcaaactagagaaagtctggtaggggctcctttaagaaaagattgttaaatggagtattaccttttttgacttggagctagtacagattaaatcccattataataaatacatcagagttttcttgatagtatggtctttatgattcaaaaacaatgttaaaataaggtctatctgatatttaataaggacagatgacttaactgatttcttaatgctttttttgtttgttttttggatgaaaccttcttgaatgaaatctaaggtagaaccatttcaaaatttcaaactaaattttaattagtagagggtatactttattcatatttcctatcaatttctgtctatcagaatttacaagtcccacccagttgatctcatttaaagtaatattaaacaataaaataaaatgtatgggctgtcctttggaacttgtttgtaatgggatttaacctgtctttatgaactgcccctgtagagtcattttaatatcaagttgagctctttgtggctttccacagatattagtgaaagccgtatctcctgaagtattgattccagaaataattttcaagacttttcatgttttaaaaatgtaaatttcacatctaatgtatttttaaaaataatttaaaactaatttcataatgttgtcctgaatttatcttgctcttctttagctgagtttaaaattactttaaaaggggattttttgttgttgttgttaaaacactttcttgatgtaggaaagaaatttgaataaattttatggcaaaaatcagaaaatctttccttgttactgcgtaactcaaaatttagtgccataggaaatatttataggtccaatagaaacaagcaagtggcctctcagaacagggaacgatgcattgtgcagtatatatgacacaattatgctcagttaagtgcaattgccctcacttgttattgttttgatttgttccgttttggttttgttgtataacatctatttagaccataatttaaaaaaattaacatccctgaaggtaagtaaaactattcttccagtctagatatacatgcaaatagtaaaatgttactcaaagtaagttcattatcatttatttttgtgtctaattagcttccacaggcaatctttgcctaatttttcccataatatttgtgacattgccttttgatgtacacctacccagctagagtaagcatagcattcttttgtgtatagagcagaggttggcaaactttttctgtaaaggccagttagtaaatattttagggtttctgagctatgtatgtagtcttctgtcacaactactttactctgcctctgttgcactactacatcctgcctttgtagcagaatggcagccaaatacaatatgtaaatgaatgggcatgaccatgttccagtaaaactttatttataaaaacaggcaactggctgtaaattgctgaccctgggtctagagtttaaaatacattaatttttattttacttttgataaccatagaagaaaagagaaagcaaaaactaattcatggaagttttacttagtgtcaagataatgaagaatatagtaaaactgttcatctatgtattacttcaagtgctaatctccaaattaaaaaggagactgatgaattttggctgattttcagaaaactcagtgttacaagacttaattcttacatgaaagacttggaagtaggtttaaagtggaccttacactttttgagctagcaaaaatgttcttcccttaatatgcttttctgtacaataaatgggttgatgaaatgccttaatttaatttatcagatatatatcatataattttgttggaatgactttcattgatctagaagttttgtgatatcctcacaggtttctcttacttgttttatttaaaaatttatttaaaatttatttaatattttattttttaaaaatattatttattttatttaaaatatatttaataattcagaagattattcagtattttataccagccattttgtgaatcccactgcagttttaatttcttctttcgttaggcgggtaaacaccaagaatatgaacagaagctacttcaagaattatataaattaaatcccaattttcttcagctatctacgggttcagttgataaaaataagaacaaagtgacaccactgcagaggtacgatacgtaagtattgatattgatagtcagacatcttaccttcttatcagttgatcttctcttttcattttagatctttttcaggcaaaatccttgttgacaaggtctgtcatttatgcagaattgtttagctgtatgggaaatgttgagtcacaatttctgggtttgaatgcttgctgcctacttttccctggtaacacttcagactagctttttgatgggttcaccttttgtggtgatttgcagactactctgagcccagggaatactttccttattaaagagaaaattaagggattttaggttttaaaaggctctgattacctaattgaggtcccccttgatataattagggggaaaatactataaaagggaaagtgggtgttatctgaaggaagccttgtgtgttggggacacagatattcaaggatatctagttccaggaatcactaaagtcatttaaatcctgtaaatgaacagggagtatcccatattcagaatcttacttatcttaggagaccagtcatctcctatcttccatctcattatggttttgggtaaactatattgtgtcaatgcttaaataaatttatggtcttcagtagagagtctcattctgatatgttgatcttcttatcttagattatattttgttatggcctgtcagaaaatcatattaataaatataatttgggaattttattctatcctgaactttctttaaatttgatgtgttaggttttttgttcttttttatttgataagtttaacttttatcaaatgaattttaaaagtaaatgttgtaattaatttatgttgatgatctttttttaaaattccaaagttaaatttgtttgaatgttgtcctaatgtctaggtgttaaatattatagcccagtgtctgtttggtgctaaaatgatgtaagaactattttcaaacatagctaataataactacatggattattgtttgagtccatttcttcaaaaacacattctttaaattttgaagtctgtgtttattcattttaagagtaaagattatttaaattattaaaaactaaattagacacatatatatgtgtatgtaaatataaataaatataaaataggccacaaagcgaaacataaagttactgtatagtaaactatgtaaaatttgtttatatcaaagctaagaataaaagctaagtcaaaacagatctttctggtttgacaagctttgatcttttcctttaatcttttgtacccacccttttctagccctgtatggttattttatggcaaaccatatgctattacttatcttattcgttgccacctctgtagtgcttggtataagaatgaagttattgtagtaaacagtggtttattttagatgcttttaacatttatgcacatcattgtttgcattaaaaatgttgtcattctaatttaagtcaaattctgggtttatagcccttggtgatttcagagcaaaaatttaaaatttagatgatctctttgagataacatttgttgtcttctgaatataaaactatatgtttttattgaaggaaatgtgaaaaatttatgaaagcatacagaataaaataaacattgcatatgatcttaatacccagagcttttcattgaaagtgatttgtgtacagcatgccctccaataacatcatttcattcagtattgttttgttacaatgttgatgagaaaaaaatcgattcccatttggggccactgcctctgtggactttgcctgttctccccatgtctgcgtggatttcctctgggcactctggtttcctcccacatcccaaagctgtgcacattaagtgaattgacatgtccaaattgtcccattgtgagtgagtgtgagtgtttatgtgtgtgaggggaccctgccaaggttggttcctgccttgccctctgatttgctaggatgagctctggccacctgcaaccctgaaccccagtaagtaggttggaagatgaatgcatgaataaatacaaattattgtaaaatgtaaatttgtaaagtgttagtgtattttcttatacactaattccttgcattgtgtattttcttagtcttttttcttcttgcgaatgcctataaaccattatacacagagtaccttggtttgttacatttgaaaacctaatacatattattatgaataatttccccatgtcactaaaacataattttttatggctatgtagtatttcactatatgttcatattttaaatttattaagccaaccttctgctattgtatgttatgttgactttgttgatattattgataacactgtgatatgaacatctttacatataaatgttatatggttgtaacatataaatggttatagctttgattgttcctacaagtagaactgctgagtcagaatatgagagtacctatttccttgaattgggtatttttttttgccttctgcatacttgccaatttgataaacaaaaaaagctgtctcattttaacttgtatttgattaacagagtgaactttttatgcactgtgagtttatgtttcccatgttttatttgtgtgtttaaaagttttatatgagttacagagatctgaacttccccaatcagttgatcaattatttgtgtttcaaaatacattgaatttgtaaatcagtattggaagaatttatattctgtgacactgaggccgggcctggtggcacatgcctgtaatcccagaacttcatgaggctgagacaggcggatcacttcaggccaggagttcgagagcagcctgggcaacaaagcaagacccctgcctctacaaaaaaacaaaaacaaaacattgactcctcccaaccattagcatagcatatctctcttgtgcctttcgggaaagattttctttttcctgttttattgtattggatctcctaccacctctttctatttgaaaaatgcttaggctaaacagtgcaaaaacagtgttagactggtagcactagcaggtgtttttacctcatacttactttcatggggatgtctctagtgttttatttactctttaaggatgattttgatcatttacttgagataagtatttttaatcacaatatgaaataccttgttattcctcatttattgagacttttttcctttagattggaaatgaatattggaatttaccaaaagtatctttggcatttataacaagtagttagcttttactgtgtttagtctgttcttgcattgctataaagaaatacttgagactggataatttataaagaagagagattcatttggctcacagttctgcaggctgtacaagcatggtgctgacatcacttggcttctgggcaaagcgggaggcaggcacatcatatacagcgatagcaagagggagggggttggagggggaaggtaccacacacttttaaatgaccagatctcctgtgaactcagagcaagagcttactcatcaccaaggggatggcccaagccattcatgagacgtccacccccatgattcaaatgcctcccaccaggccccaccttcaacactggggattataattcaacaggagatttggtggggacatacattcaaactatattatttacttatttttgtaatcagttattaatagatttgctaacattttattgactttgcctttattataaagtatagtcaggtagtccatagagcacattcataactgttttggtagcaggagaatgtctaggagccacaagttgtaaagggggaaacaggaggaaaagaggaaatataaaacaagtaaactcatttactaattttgcccaaagccagtgctacagaacctcagctgggaccagaataaaaaaaaatttttgagagtcttgctgtcacctgggctggagcacagtggtgtaatcgtagctcactgcagccttgacctcccaggctcaaacgatcatcccacctcagccttctgaatagctgaaactacaggtgcacatcaacacacccagttaatttttctttttttttgtagagatggcgtttcaccatgttgcccaggctggtctcaaactcctgggctcaagcgattcgcctgccttggcctcccaaagagctgggattataggtatgagccactgtgcctggccagagcaaattttgacataggtgtacatgctttgcataagtacatgatatagaaactttttttgggggggagggtggggggtggggatgttttctgttttaatgcggttacctaaatttattaagtgacaattaatggcccaagttacagagagtaagcctttggctgactgtcagtcatagcgaaaggtctgctttggtttccacttccacattgccatcacccagggtaggcatacagaggcagtaggtagtagggatgaatttgtagataagatttctcacaggaaagacttgccaaattagagtgatgagcagtgtaactctttccaaggtcatacccaagagataggtttcttcatcttcaaggtaagttaagacttaaactttctaggaaaaaaagaaactcaaagaagggtttcattttcacatttcttggcattcctagatagtgggtagcagttttacagaaagaattgcaagaaagcaaagcctggaaccttatagattgaggctctaagcttaaaatgtgattttctcttattttcaattaagccagagtacaaatcttaagattaccatagctattaatcctcactgaaccctgacatggtccccgatgcacatatatgttagtaagtgaatttttctataatatattttactcttatttcacctagtgagcagaaaattctaaaaaaggaatttgtcatctgctccccttcattattatgaattcgagagtatatcagtcttaatgagttttgaactatatatgtgctatgaataagttgctttgaaatgatgaatacaagtaatgagagtgggaagtgatgaagccttgcagtaatgatgcttaaggactggctattttattatttttaagtttggggctttgaaatatcttcatttagattgagatgctatttaagtaccaactgtgaaaggaatagtaactaggtaggctgctgtgcccaagacagtgagcaggcctagttacaagaattgtggggtatgcagatcactcggtgtaaatggttatgacttgatattgtggctgaaacaagccatcattgaggaaatggagatgttcggctttagatttaggtggagcgagggtggaataaaagttttgagtcttctgtgttcatttaatatcctcagtaggcctgtgtggtatatattgttttcttactacgggtaaaaaaacttaagtctcagagagtttaaacagtttaccagtatcccacacaaataagcagtagataagattctgaccaaagtctctgtgactttaaagcccaagctcatccctcattctcccactcttcagtctagaagaggtaaaattcttaagagcagctcttaggaaaaactttttaaaacataaatcaaatttgcttaaatgaaactgtgccataactatatgtagtttgatcttgaaaatatctggtgcttgaggcttgttatctgaagacagatgtagtggatggattgtaaattccaaggaattgatgttatttttagcaaactttccctgagccacagattggtggcagtaatggattagctagagaaatggtgaaagggaaacttttataggaatttatcgatttttattacatttgagaaggagtatacatcttttaaaataaaaatacagctatatccttactgaaaatcaagtataatctctgatagactgaaggtatagtcagagtaccttattagttcagcagaatgggaatggtcactgcatgaattccattctcataattatttggtaaaactcttgagatttagaaaagacatagttcatagatttgtagaaaaaggtctcaagcagagattgttagattatgaataggcctcaggatatttgtgaacactgaaattttatgtaacattttgcatctgtgcacattcttttgagagagagaactgacctaaaaatagttatcaattaaatattggtgtagagggcactggtctgctgatacttctagatagattagaggtgaattcaggagtggaataaagcagtgattctcaaactatggtcaggtgccatgagaaatggactagtaagttaagtgagtgagttaaagtttgctaagattttatatttacattaaaatcagcagattactaggtttttctgagtttatatctcagaatcttccttatttctcttgaaaagttttcttcctatgtcgtatttggctacatacagagttagtgcacatgtgcatatgcagtgaaaaactagtaagtgaactgggatatcttggcccacctaagtagaatatggtcaaaaaagaagttagaaccacttgtctaaagtatttgttccagagggtggggtgggatgagtgtggggttaaggggcagttaaagatagggttgtgtgtgcccttgtttactagaatgaaagcaaataagaagtgtgtttaggtttaacttaaatataaatcttttaaaaacattaagtgtattactgaaatacagaatttatgaataagtggagacttgctgtttttgaaggttaccacattttgtgatatgtttaggctagtagatgtccatattttgactttattattaaaaactaattctttgtacttattaatagttatcaaaacatttattttcattcatgttaagtaggtcatggggttatgagaaaattctaattaaaatcatatttacacaactacaatcgttctaggtttaataaggcacatttttcttacctttttattttatttttttattttttaatttattctaaagagagaggatcttgctgtgttgcccaggctgtcctctaattcccgagctcaagtgatcttcctgcctcagcctcctgagcaactaggactataggcacgtagtgctacacccagcttcttgttctgttaatagctaattatgccacttagatgtggccatgttttagtagcaaagtaatactttacatgttaatgtatatttgaagcctgtgtcaaagtatattctgtaaaggcaagttttacctgttgataacttaaatatatcctttgtgttagcaagtgtttaaaaatatctcagaattacttagggactctggtaaatggcaaaattaagatagattctttgaaatgaatatatgtgggagtatttaatttagaagcaaaatgaatatgtatttgtatatatggtaacatgacagtgaaatttggaaatgtctgttatgttgacttttatccttatgtaaattttatgtttaaaatgtaagtaaattttatattttgtttaaaatgtaagtaaaaatcagtaagtcactttgactatttttcttttgaatttggtaagcagaaaaactaaaccttctaacttttttttagtccacccccatccttgaaaatgttttttctttgattcttctactatgtaattggtttatgttgcaaatttttttaaagtaatcatgagactatatttagtgatttggttggcatcgccattaaggaagtagtaaaagaaagtaaaattcaagcattgcctttggagcaagttagaagaaatcaaaacttggctgaacatctacaaatccaaactgagacccagctgtgtcagtgactacctgtttgcagacagttttgaatttgatttctttatctgtaaaacaaagtaattaaatttgattttagtgatttcttctacttgtgaaatctaataatttgagagactttgaggagtcttgatgccttttcattgtgttcctcttctctttgtttcagtgatcatcaaataccagatgcctcaatttagactaattgaatagaattttcatgatggagtctggatatatactttttactttaaataaataaatatgtatatattttgtgcatatatgtattttaaaaagctctgttgcccttttgggttaatttacaaatatttcctcctaagaaatatgtaatctcagccaggtgccgtggctcacgcctgaatcccagcattttgggaggccaagcctggcagatcacttgaggccaggaggttaagaccatcctggccaacatggcgaaaccccacctctactaaaaatacaaaaattagccaggcatggtggcatacatccgtaatctcagctattcgggaggctgaggcacaagaatcacttgcatctgggatgtggaggttgcagtgagccaagatagtgctactgcactccagcctgggcaacagagcaagactctgtctcaaaaaaaaaaaaaaagatatagtcttaccatggatttttaaaacaatttaggactgaaactttaaaaaaaaggaaaaaattagatcgtttgtatgaaaatacatgtttttgaatttttatgtacagggatttatacatacagcattgccttctgggaatatcttgattgtgttaggagaccagattacctattagtatttcttagtcccacttgaatccagtacttttcaatgaactgcatggtatttatggacttcagcatcttgatttctctttctctcagatcatgacagtttcattgtatgagtgaagtacaggtgtagtcagtcttctcaactcctagccttttcagagatggttgtcaacctctgtttttgcctctctcattctttgttttagttcagtttatattatctgcttttctttgtttctatccttgaggatagaattggtatctccaatttttcaaacacctttctagctttttccctcactaggcaacttctgccccactgctttttgctgtacaaatggtttttttaaaaaaaatctctcccattgaaaatggaatgaacaacaaaactttagcttcaaaatgcaagtaattttgtttagtgcagtagaaagaggttgatttaagaaaacctgtaggttttttgtttgtttttaaataaaaaaagccctgtgcaatttatcttagtgcatccaaattcttatatctgataacattgggacctggcaatttttgaccagggaatagtccatgtcatggaatactctcttcatgagtaaatctggtatttattaaagtttttattttcttagcagttaccctcttggcatataatgggtgggtggatgctgaaagtaaaagaaatttattaatattaccagaccttaagcagactcagtgcttatccttcatgaggaaggaagttctacatctgatgccagtggagttgtgaggactctgacctgttggtcgtagtctcaagataactcttttctctccagccattagagaaacaaggagttcacatttattggaatttgtaaatatagtttttctttctattggggttacccatgtattttcagggattctcctatcttttattcttttccactgatagttccaattattaatataatatcaggtgtaactataattgacttgttatagtccacataggaagtaaaataatttctagttatatctttattctttaagcttttcatttattattcctttaatttgttattgttaaaataaattgagaagaatatagtaaaactgagtagaacatacatttactggtctcttgccataatcctgatttttcagcagctattatcggatagataacacaatctacaaattttaaaacatctttgataaaaccttcccaggtaaagcataaagtattatgaatcagtgcttaggaaattgcagttggatggtggacaaagtgatataagttattctaattagttgtaatccagaaacatccttaagatttgttttttatgtaatattttcatatgttgccctggccattagcaagacctcatttatattgaaaattattatttagtgctcttatggaagcactaaattgggtggtgactgggaagatgaaccaagatccagacactagaaatcgtcctttgtaatatctttcttttagccttttgtttctgttaccacctctttctctcagcttgaagcccttattaccatagtattaagtatagtgcaagtttatctcggattatcgctattatgttccgccaccaaattaatctttctaaaacactgcttatttaggtcatttctgtggcctatggagcctaacctgtgtttacctttctgtccttaccttccattattattccagctatcccatttgttagctaaactaaatacttagctctgccaacactgtctccgacattttgacccttgacacaggaggtattcctacctttaatgctgttctttcccctttccccctttcttctcctgctgagtaaatctttttaaggacctacttaaatttgaactcccctaggaaactttccctaattgccccacttgtagtagctttgctttcttcttaagatttatggcattgtttttgtttgtttgtttaaacaattcatttgatagcaagcactggctgatgtttgtttgtacttaccttatttgtgcacttatcttctttcccccaaatacttctaaacttagtgggctcaggtctatatctttaaactgtttgcattacccatattacttaatattcattgatttattgctattttatgaataataagtaaaaatgctcttcaagtaaatttcaaatctgtttgcttataatcaagaacatctggcaatgtctgcagaagatgcacctgggattcagattgggtactaacccttgttagatattttttttagagcaattaaatatggtatcagtaagttatctgtttgaaaggggactttgtgtatattttcagggaataaaataattttaagaaatttggaatcttaatttttttcctataacacagtatcagaacaatacatttgagtaacgatagtcatgtaccacatatcaatgttttgttttggtcaacaatggctggaccacatatacaatggtggttctatataattagaaataacttttttactgtaccttttctatttttagatatatttagatacacaaatgcttacccttatgttacattgcctacagtattcaaaacagtaacatgctgtacaggtttgcagcgtaggagcactaggcactatatagcctcagtgtgtagtaaaccatgccatctaggtttatgtgagtgcacactttaatgtttccacaatgacaaaatcacctatcaatgcatgtctcaaaatgtatcccatcattaagcaacccatgactatttttgttcatgtgctgagttaaataaagttagttataggaatgatatcagtacactgttgcagtgcttatagagattttattttgtctttaagtcagtcaagataaaatggatttgaagtcagtgatttactttaccatggtactacattttctctatgtgaaaataaaatgttaatgtttttgtttgaatcagtagtttgcccaaaaatgtttcttttgtctcatttctcatgccttctctagggttatgattagtatatagaaatattaaaagaaatatattgctcttaaaaacctatggagaatatttcaataacttttatgccctctgtcaaacacccagaaaaatgtcagtattatttcaaaaactgaaatggggaatatgtttatcacatgcacaaaaataaatggtaggttagacttttgatctattaattgtaagcagtgccttttttccccctataagctattattttacccattatttttggagaatctaattacaatgtaagttccttaagggtagagattttatacaggttgagtatccctagttgaaaactcttgggaacagaagtgttttggatttcagatttttttttcttttggattttgggatacttgcattatacttattgggcgaacaccccaaatctgagaatctgaactctgaaatgctctagtgaccaattttctttgagtgtcatgtcagcgtgcaataagtttcaaattttgaagcagttcagatattggattttctgatttgggatgctcaacctgtacttctttgtgtcctcaacatttaatcaatgttttacttcccagtacctcaataaacatttgttaagatggtaaagtgtctgttttttttttcttttgaggagtttgtttttattgtaggagaatgactatattctgattttattcaatttgttttctttttatagccccattgacaaaccttcagattctctcagtatagggaacggtgataattcccagcaggtaagatttgaatacagtatcacttgatttatttgccatactccgaaagcaaggtattccatgcaggtgaattttctaaaaatactttactgacacaatttaaaaacacttttgatgctcatctttattaatcatattataattagccttttccccccagaatatatagagcatagtttaacccttttttaatgactcagaattatcattatgaccagatactattatctttagagtctgctaatgttattggtctttttgaccctgtgccaaatggtcccaggctagcatgccttctgagttccttgcttttaagaattgtattcctaccacatactccccttgccccttgctctctactttaattttctatttcagtcaagtgtatttgtccctaacagtttcccttcttattttccccaaatgactatcagctttgaaatgataagccagataaactgttcaaagttgaatttactatgaaactgagtggagtgctgaccgttagagcatgctttatgtcatcttgtcttgttgctcagggaacttttttttttttttggctagtttttcactccttgagtttctatacatcttcttacattggtaaaataaatgtaatttagtatctcccgtaaagaatagccagtcctccacagtatttatgaaaaacttagagatctaaaatataatgcttttctaaacgttttaatgacacattttgtaaaagaatgtggaaatctgtatatccccttgtgtattttagttgcccattaacattttttacaggttaaaagtagttgcaaaggatgtaatttccagcatattagaaatattggtatctgaaaaatttaatgttttgatatcccatcataatgttttgatcataattatgttttattatcctgtcatccatttaaaaaaatacacatgctctcctttaacaatcagaagttttacattatttttttctctgtgaactaatttttctctttctgttattatagagttttatcttaatgcaatatagtttttgcttgaaaagcatatacttctcttaaaaataggcatataaatttttggattgaaataatgtttttgcggtcacagacttcaaatgccaatttttgtcttctgaattttattagtagtattgaggtgacactatacataaatgtagattttaattttaaaaaccatgaaacaaatagtaataaatggtaaaattatagtaaaataaatagtaaaattatattgaaaattcatctcttaatgaagaatagggccattttaaaattggtttgtatgtatctctagattaatgttacctattggtaaaagagccaagtttcagcagcaatctagtcgtgttttttatttttctaagatgtaagtgttgagataagatactttgttcatataaataggtagatggaaggaggagtattatatcagtaccactcaagtctttcaatttcttctgaattaaatacctaagaatcatacaaagatttattatacaaaattatttttaatgatgtgtttggaaacaacttaattagatctttctttaataatctagccattacagtcagtttctctcttatcaccaatccatgtatttctaataatttgtgtttggcctctggaaagttttcactcttgagcaaaatactgtagtaaaatcccagaatgagaaatattattttcttggtaaagtgagagaagtaaagttgtaaaaagagaggagatggccgggcacggtggctcatgcctgtaattccagcactttgggaggccgaggcgggtggatcacgaggtcaggagatcgagaccatcctggataacgcggtgaaaccccgtctctactaaaaatacaaaaaattagccgggcgtggtggcacgcgcctgtagtcccagctacttgggaggctgaggcaggagaattgcttgaaccccggaggccgaggttgcagtgagccgagatcaagccactgcactccagcctgggcaacagagtgagactccatctcaaaaaaaaaaaaaaaaaaaaaaaaaaaagggagactagtttaatcttttcaagcagattaatatttttttaaagagtatatatgtaagttaatgatttaattgattttctgaaacttcatgctttcattaaaacatcttcaagtaccagtttgtgaaacactattctaatacatttagttgcaaactttttaattgtggcttattaaaatgtataaacatgtagttattatttgttttccttttttattcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcaggtatataacaatagtaccaagtattagtaattatgctcttaacgtattgttgacagactaacatgaaactcattagtggatatatttttatcttttgcctctctgttctcttttaataaaaatgcaaatatttaaactacatggaattaggtggttaaatacattgttgtgtgacctagaaattactgtgttaaaagatttctccagaagtaaagggttatattgttttcccaatagtaaaaagcttattccattgggaattttttttttcatttttactttttggaggtgggggtcttggtctctcgcccaggctggagtgcaagtagtgtgatcttagctcactgcagcctcacaccctgggttcaagtgatcctcccacctcagcctcctggttaatttttaaattttttgtagagacagggtcttgctatactgcccaggtcttgaactcctggcctcaagtgatcctcccacccaagccttccaaagtgctgggattacaggcatgaagcactgcacctggcaaggacttagatttttaattagatttgtatttttatttaattagatttgtgtttaagattttccacccccagctgacaaagatgcaagttatttagtagtaacagttatgttactactaaatggtatttttgagccatttccatttttatccattctaaattctctcattactatgaaaggtggcataaaagtaacattgacaacagcacctgtggagcagaaaattccaaaaaactatgaggattaatataaatactttttaattaaattatatttttcttagtatagaaagcatgtattcaaaattatttgtactttgataaatacatttaaaaatcaactttactaattaaaatctgttatatttatttgatggaagtgacttaggttggttttgattatgaatggttgagagtataattggagtgtcaagtacatttttttcctttgattagcaaaatcagtctatatcattcagtttttgaagctagtagcttaagagttaagtaactgctagaagtacataaggccttttgtaattatatgatcttaatgtgctaagaagtcacatagattttgcacttacttaatttgtaaaatgacatgtttaactttcagtagcatggatacttattaagtatgaaaatgagctatgtatctgatattcatcactatttttcttcccaacagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtaggttcatttaaaacctttgagaatttttgaataactcatattttcaggttgttgggtggatagggaagtaactgttgaataacagagtactaatatcttggaaatgtctatgaaagattagtctttatcataatctaaaatatatttttcattagatggatgccttgtaatattgagctttataaggatggtggagtattatacttagttattgtttggaagcattttacttaataggataattaccaaactttcatatggtatacaaatgcaaaatgaaaaagaagaaaatggtctctgaagttatggtactataaagtccaacaccgtggtgaaaattatgattttatattctaaagtaaaatggttaaaaaaaatttttttaatgataattaatgagagcatgagggataaagccactctctacctacttttggcagttacttgttttgactgatacacatatacacacacatcaaaactgagctataaatatacttgagaactctgattatgaatgttttacaagcatatcatatgtctcagacatacaccttttgtgaaagagaaattgttcaaggaaagatactttcccatttgatctgccatgtttttatttctggggaaaaatatgaagtatatataaggtaatgtaagtttgatgccaaaatacttctggttttgtactgctacccttgaaggtttcagaacttttgggttttaagattctatataacattttttagatgaagtatcttctatatccaagggaattattcttgttaatagtgttctcgtttaactttggctttagagatgatgttaaaaaaagtttgttcctctcctgattctctcaagtgaaatagaatcatgattctctcaagtagaatacaatagtttctcactctgttagaatagttcttcacataattcatacaatttattgttatcccttgttagatatggcatggcacagtattattgtaataggatacttttatcagcagcaaggcggaagttcacgctcttgtttttagcaaggctgatagatgaatttacagaggtctatcaaagttctttatccctgttccctttgggaccgacaatatttcatgttttagacgagtagctaggttaagagaatatagtttgtggctgttgacatagtgaaatttaccgttgatacagtgaagttaatttacataagcctggtagcacgtaatgtagttatttgcacagtgttgggactcttatttgttcatttaattatggtagttagtaggtaaccagagtgacatttttcagtcctcttcttctacatgatacttacttgtgaaacaatgtgttcagttccaaatactccttttatttccttccattcaagatagcatattagaatgtaattttctttgattttactttgctttaatcattgagaaatgtggcattttaattactagtagtgtatctcataattgattataacattcattaaaagttaaagttaagttctcccaaatcatcaaaacatttaaagattagaccaattacagtgaatatgagggtttctatttgcccatcaatgaattaggacatgtgggacatattaaagaagtttaagatatggataaaatttccacatacttaaagtatagttgaagagactaaaataatgtgtgaaagtggtaactatatgtctgatactggaatctgagagacatcaatgtaccctgtaattcttggggaggcttcattgaataagtaggaattgatccctactatcatatcttagatttgggttagcagcaggggaagagaaaaggccttttatgttgatggaaacctcctgagtaaaggcatagaggcaggaattagtatgtcattacactgagaagtaatacagctacctcctataacaggaggtgcttcttaaattgtatagatataatggatgagaagatgagaaactctgacaatgaggcaaaatggcatggacttggtatgataggaagtaggatgcctttatgggattctagttattagctgtcttctttttgtgcttttatttgacttattacatgacgatctttgattttcttccaatttcatagtcatcatattatcccttaacactgaagagtagttttaacccatatatttcaaaccaatagttattctcagaatgctgcactggtaatgagaaatcgctgattagtgagtttagttgtccttgtgttagtcatttaaaatcttcgtctaaagtagatgctttatggaaaaaatgtgacattaaattatggtcctatctttggggattttgttttaatttttaaaacttttaccatatactcaaccatagagcattaaaacctttttttttcagagatgctaaaaatgtagtcaccaactttaggttctgaatcgttgtactatttggtagggggtgggagagtttattttggattttcaatttcaggctatgcagacttgcttggtatttaaatggtgacttatggttaagcttattattaggttatttttaaggctctgatgactagagaaattttagttttaatgtaccaaaatttaaaaatttttatcaagagtctcacacaccagaatcctctcatggattataaatatttggtagatgccccagaaaactgaatgtgctaagcctcagagcagaatagctgtgtaattgtagccagaagatttaggattttcagtaactattagaaatgacagaaagtgaaaatctggaaaactatatatacatcttaactatgtctaatttgaagcaatttaatacctaggtaactcacttgcacctgttgtaactcacttgcacctgttctaactcacttgcacctgagttgaactattggcaaggattcaactttgtatcttttagcagttatcatgataccttacacagggcagctgtcactaaatgcttcagtaatggagagagtacatacctgtttcagtgggacctgctactttaagatatacttagacaatattttaaactaattctacactctggaaaggcatatatatttattctctaaatatgtagagcaaaatatggtctctgacctgtaagagcaaatcagagatggcagtcacctacatgtcatacagatagaatgtctacttactatacatttgtacttaaatttttatttttggtttgttcagtgaattattaaagattgatatatctgaaacctatcatgggaaaaacagttgccagaggtttgacagaaatgcagcttcctttttttttgatctaattgaaaactgtttttgtgtttaaaattagtagttatttccttaattaggtgaaacctttttagcagcatttggtttactaagtttagaaatatttttgacataaatattcttgggggaaattttgattcgtgggcagttacagtaaattcattcagatctttttttttattattattggaaccatatgccttctttctacaaagtgatttaccttgtcctaaaacgtgactttgttttgtccaattccttcattttaggaatagcaaagctgtgttccagaaagcttaaataatttgttaaaggtcacatattcaattagtagtggaattagggtaagaacttagatctcaaattcaacaatggaaatgtttttgcactacaacgatgccctccttcataaatgaagatcactggcatgtgctttaacttggctttcttcccgtggcaattgtttttgctctcacacacttggaagtccctttttatcaacagtatcaactcatgagacaaattggcccagctcaggggtatatggcctattgttacaaaatagaataaagtgtatcgacttgatagaaatcagtctgtttcttagtccttattaatatcattttcttgctaagaactctagtctaaaatttgctttacagagcctcattgctatgttcttggggtttataagaatctttgccaatttactgaaaaactacaaaatcacctgttatatggattgacagactctttttctgctttgtcagttatccttccacatgtaattttgcagatttgttttaaaaaaatattctgccaagttgtttttattccatgatgttaaaaattatttggaaaacataagtcagtaagcattgttgtttcaagatatacctcaaaaaatatttgaaactgtttaggattggatttttttttcatgtttttgttaatttaaactttacttttgagagggcatttttctttaaattttctttgtttctatatgaactgttttaacagtgacttgattgaattttgagtcatgtgtgaaacaagtcacttgtagtcaaataattttcagttataatcaggagaaccgatctcattcatctataattctctgacctagaagtagtcatctcattttcagtcaattggatcattgtactgttaacattttactatttttcaattacttcaaaggtaaacttgaattttcagatgctgtatgttaatttactagttaatatttatagctttcatttttttctagtacataatttatgctttcaaaacatggatttgtaatttttctcttttaaaaatcagttttcacttctgtaaatcaaggtttaattttttcacaaaatactattaatatttaccatttactaggagtatctataagggtccaattggcttggaaaagaatggctttcctggtctttttttttttttttttttttggtagtatgtttataatctaaatctattgtatttgttcttatctctgaaacaatattactcaggatatatttagaatataactactttccaagtacttgataagtttatattttaaaattcatgtcttgtttcacacctggattccaaacattaagcatgtattttatatatgtatcagtattccaaatattgaaatcatttttaaagggactgttaacaaatctagtcacccataactagaccatgactgacttttccacaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagccttttactatagcttaatttaattatggttttcatttttactgtaagaggccaagacttcacttatgtctcctgtggagctgaggctcctgggccttgttattataacaaactctggctccttgtaatgatgcttactagctcaaagccttctccagcattcagtgttagcctttcattgcctggatcttcttacaaagccatagcaagtggttagtgccatttgctccttggtgttgagagatatacctgttaaatgaggcttctttcctttctcattcatagccagcgtggaaaaatcatcaggtagtttgcccagatttgccagagccctaaataaaatggcaaaacgatctccctgcctgcttctcctccccacccccacttacatgcacaccgtaaatcaagaaatgctttttgggcaattagactttatcttctaaatttttgcatagaatggctaaacatgatcttttgcctcactttgtaattcctacaccttccttgtaagcttcaccttttgcttacctaatattttatttaaacatggttttttaaaaaacctgaagctttaaaatcatagtcataattaattttacactaaaggacagaagaaattatacaacacataaaagaagccactacttcacatagcaagcaaattgaaatcaaaatgacagaagaatgagaaattctttaaaagcttcaggttttttttgttgttgttgttaaattcctgcatgatgcatcatgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagttattagatttgtgaaggatttggtgatccccttctcccatcaaaaaaaaaaaaaaaaagaacagctgccttgaaatgtttttagtgccactttagggaatagagtcctgtactgaatgattttagttgtatgatgaattataagtgcctctttattttctctaagattgcattagaaaatatttttttctgactaataatgctttccttttcattctattattgaattttggttttccatgtgttacttttgtgtactctccccttatttcaacaaagcattaattaaatatttgagtacctattctgtatagtgacttgaactagatctttagagatacaaggttgaataaaatacagaccctatcatcaaggataattctagtgacaattatatttcacattatttctgtcaggtcttgataatattttaatcacaggaaccaccatagcagtccagactcattttattatttatcatctctcagtaactgctccgacagtggcaacaaagggtattgaatacttatatttcaaattttaaaatttatgataatttggagggaggtgaaaaaaccttactaggaaagacaaacattcattattctacgtgtgtgtgagctcatgtctcttactcttagcatcctgggaattaagtacagccttctgtgtaggtgttcctttaaagaaaacaactttaatgcattttacctctgcacatttccactgacatgactcctatttgtacagtgttccgagcactgtcaagactgccagagctctggcacaggtccataggtactcccacggaggcattgcctcagaaagacaagagaaaggaacaaattgcagttgctttgaaatcttacagtggcctataggggttgggatagggcagtaaggagatccagctgaggtattcagggactggtaagcttggataagtgtgtttaaagccttgaaaaccagaagaagagtttagtcttgatgtgaatgtggtcagtggtagagaactataggttcttagcaaaaatgtagtttgaacatagcattttaagaacagtaatggggtaatagatttgattgcaattaggaccggttagaaagtaattccagtagtatgccattgctggccagtgcaaataagttggcctagactagcacagtagtggttggaatggagaagaactatgaattagaaattggaaagcgtaagagctgagaaaaggccttcagatttggttagatctgtggtgatctttaaaaatgtaactttcatagaaaagtacagaatggaagcccatctttttaggattaatgaggaaatgtcaagaatatgtatgcagcaatcattgactacttagtgttaagacatttgacaacaaagttgaagagacaaacaagatgctaactagatgggtggtagatcttagaaggcattgctttaatataagggagaagaagaacctaaatatttaaaggcagaccttacagagccaattgagaggaagagactggcagtgctgaagagaagataggctcattcagtaggataatagatgtcgttgggtggtgggaagagataagctcctgagacgagcatgtggtatagcttaagagaggtgggtggccaggcgcggtggctcacgcctgtaatcccaacactttgggaggccaaggcaggcagatcacaaggtcaggagatcgagaccatcctggctaacacggtgaaaccccgtctctactaaaaatacaaaaaaattagctgggcgtggtggcgggcacctgtagccccagctactcgggaggctgaggcaggagaatggcgcgaacccaggaggtggagcttgcagtgagccgagatggtgccactgtgctccagcctgggcaacagagtgagactccgtctaaaaaaaaaaaagagagagagagagaggtgggctgtatcttcctctgtgatttgtaagagcaagaagaacctggggaaagagaaagatgagaattgatgaaatggctcatatcagtaattattaaaatgcattattgtttgaaaatgggggtgaaagagtggaattgggagccttttaaaggagattaaaaaaaaaagtcttttgtgagaataagcccagaaatgcattgtaaatagttgcttagttgctgtgtaaagataagagtcagcttaaagatctctaaagttgaaatatatgtggttttgtatgttcctctggtttagcacaaagcataggagtggaaaaagcaaatattgagtgtttggttaaaaggggaaaaagacaaagacatagagacattcaagaagaccacattgaaatgtataatcttgtgccaagaagagtctattaaggcagtttcctgtgaagaaatggtgtgagtgatgtggaagggagttgaatgattttagattttgatgatgacaaagaacatgttagtgttgctaagggaatgataactaggagactgtggtcactgtgataaccactcaatgctaaatgatgattgagaaccagagaaaggagagggttggagtttggaaagaagcttgtcttttgtaaccgtctatatactctctcctccagtcttttcatgagtgtaggaagtcaaactatgtgagagagaattgtagaaagcatggaagcaattccatgcatccgcagatgggcacctggggaatcctgggtcaggtttccggtgagttgaaaatgatcaaaggaaaacttccttcctcaaagcatcgtaggaggacatggaagcagagtgctggggaggaccaggaaaagccagggatgagatgagacagctataagtaagcaagccccagtgagtgtgaaggattggtagaaatgttactgatgatgtgaaagatttagacagagggattaggtatggtgtatgatgagtttggtagttgaggagcccttattacaggtaatatagcttctcccaagctcacttgcaaactggaaggcttttttaaaaatgggcttccacctatgaagggaaagcatctgctcttacatagttggattaggtcattctgctttatttatatatcaaataagaattaaggtactggtgaacagtagagataaagtaagaattttattgtaacaggttataaaaatattttgataatttcccccaaagagaatgtactatgaataaataaaatctacaaattattgggctaatttacccttgtttcttatattttgtatacttaggaggtgacctctaggaaaaaattgctgaagaggtagtagagcagggtgaagataccgtatactgtcatccctaggtatctgtaggggattggttccacagattgcaaaattcttggattctcaagtcctcgatataagacagtgtagtatttgcatatgacctgcacatatatgggaggccgtatattttaaataatctctagattacttctaatacctattacaatgtaagtgctatgtaaatagttgttatattgtttagagactgacgaaaactgcatgcttaataaattacacaattttttaaaaaaattttctattcgatgttggttgaatccacaaatgtgaaaaccccaggtacctggagtcaactgtgtggtttttttttttttctcctagtcagttaataataaatattcctagtttggaagcaaccttagttttctaataaagtatttttaaactcactccgtatatgtcagctgaaatatcagctgtgacatttaaaaaggataatgcttcaaagtacaaatcattgctcaagaatactatgtttgtgaaaccttgttgatggattgagaagccactgctccttggacctccttatcaccctgtgatttgcttctgtgagttgtaatcgagccacctaacattgctggtcatactagccttccacttcttagtcaggggctatttccaaagaatcactcttgataatttgagatgcattaagaagattctactctgttttttggtcttttagagagtcttctctgggtttgagttatagagaaatcgagtttaggtacctagaactgagagcaagcctaagtaatctaagctacttgagaaatggactgaagtacccagatgttccataaaacagcttgaagttgttgaccttgagaaccatttccttttctccaggttcctcttgaccacacttcctaaggcaactattgacttcactgtcttagcccactttacctttattctaagagttcctggaagctccaagctgaccctggaacatactgtgcttataacaattttgttattccagctcctgttgggtgctcagacccactattgtgctgttacaaagcaacatcccaaaatgctttttcccctcatataatttataaagcctttaatgcatccattacctttctttcttttttatagcgggtgaaattcacataacgttcaattaattattttaaagtgtatgatgcagtgacccagtaccattctttaattatctcaatggtaaaatagcagaataagtaacctactctgctgtaagaattttagtctgtttcttgttggggctgtgtggtaatagctgcttctagactctgtgttttacccagtaggctgaaaggcaaatgttaaacctttaaatattccgtatttctgcatagcagtactactgcaacttaagcttgtgaatcaagcaacttgtatacacccttttaaaaaggcagtggggggcagtgcaaggagctctaggcaagagacacttaggagatttgcttttctgagtggtaaaaatgtttgaagcaactctaaatagctttgaaatgttagtaatagtcttactgtcttcatgacatttaattagccttctgtaagagtttgtttagcaaaggtaaaccataagcctagccctctatatgcatgtgtggttgaatgtgtgtgtgtttttatataaagcaattttcagttaaatcttccacttaatgaatgtagtagaggaagatgtctcatgtcattttggtgaccttgacctatgtctattcatgtatttattcctgctgtgttccaattcatatcttcaggataaatgctgtatctttattgtctttctccaatttttttttgaaggaaccaaagaccctatttaaatgcaataaggttgtaatactggtgcccacttcaccctggtcatgttttttctgaacaaatatttcatagcttttcctcatcaaattccagtcccactgctaagatacccatctatgacacagtctttgggaaaacccaaggaaaggataacttaaaaatgatttgtattggaatcatgacacttcagagctatgaataaataaatataacatagtctttaacaatccttttaaagaccgaataataacaatgatgataataaacaaggctccgaaggattgtgatttgtctatagtcacattctaacaacaatttgaagtttctttagccctcaccatgtaaatgtgctttcatgcttgaaactcagtggaggaaaaaacttttaagattcagaatctgtctcctctaaacattattgtgtcttacagtttaattacagtaggtctctcaagtcaagggcttacaactgtgaattcattgcaaacaatgaatttgaaggctttcaaaatgaccaccagctggcagctgttgtcacagatcctgtaggttttcaaagctgccctgtgttaaatgtggcccagtgatcttggagtaactttagcaggggaaaaaattgtaaccttgcaggtactcttaaaataaacttatgctaactacaaaattaccagtgtcagaactaaaagagtaaaacagaggtggagtttaatttacccaggatttttctgcagtaccaaagagaatttaggggacaacacacataaccactagactggtgacatctctaatattacaaaatggaaaaaaacttatagtaatggcaccaagatgtattacatacacactaaagatgtgatctccgattcatctttgaagaagagctactctgtgttacaccatatagaatgatagcatatctgctgggtttttttgtttttttttttttccccaatcaaggaagttgttgttttcagcataaggaaacagggagagctccacaaggatttaaagatgataatgctatcactatctccaagaagaaatgcaagaaatctgcaatcaacttttgtagcctagcactgtttcttaatatagtgagatcttggcccaaggactgcactagcatttacactctgttatcagacttgcatactgaaataatgtattgatggaacagaaagtagtgatctagaactttagtggggtgttctaaaacattgtcgtgttatatgttggcatttgcaagaagtctgacaactgtatatttttatttttttcctttattacatctatatgtttagtatccagctaaaggtaaaagattgcctgggttatgacttcatcagccaagtaggaagttttttcattggccttaaactgaatgtttggttacagccatagttccacttaggttttctctgttaaaaatgttagtttctattaaaattcatgattatggatggctgatatatatatacacacacacatatatatatacacatataggcacacacataccctactccccccaatccccatttagagtaagatttgctaccagatatgtttccttttccttctaaactgttaacatttactaattttttccttctgaactgttaacatttactaattaatctacccatagtcttcccctggttccagacaagtgtaacatatcttgatttctagtctgcccagtgttgatagatgtaaactcctaagacctcacctgcattttaaatggtagatggctatttaattgaaacgaagcatattattaaaataaggattttatataatctccaaatacacaagccctgcaacctttgttttataacacgctttcaggttttaactattgactattataagtctctttccggtagcttgtgttcacccctctaaccagtttctttttctttggacaaaggagaagtttctttctccatgtaatttaccacaattaacagggaagtcatgactaaatcttaatgtacactacctatatgattttcctactggattcctgacaggcttgaattttcccttttcttcttcttcttcctttttttttttttttttgagacagggtttcactgtgttgcccagattggagtgcagtggcgcaaacacggcttactgcaacctcgacctccctggctcaagtgatcctcccacctcaaccctccaagtagctggggctacatgcacacaccaccatgcgtggctaatttttgtattcttctagagacagggttttgctttgttgcccaggctggtctgaaactcctgatctcaagtgatccatgtgccttggccaccaaaagtgctgggattacaggcgtgagccaccgtgcccggctaattttccctcttcaaaggagagaagtctctctccatcagtctactgagtgttttctcagtctttttactcaattaccagagacagcagaccctctatctgcccaataactactcttactcacctgtcagcttattccaaactgcctttgatcctaaacgagtatattcttgttttttttttttccttctctctatttttattttgtttgagacactctcgcccaggctggagggcagtggtgcgacgtcggctcactgcagcctctgcctcccaggttcaagtgagtctcctgcctcagcctcccaaatagctgggattacaggcatatgccaccatgcctggctaatttttgtatttttagtacagacagggtttcacattgttggccaggctggtctcgagctcctgacctcagatgatccacctgccttggcctcccaaagtgctgggattacaggcgtgacccactgcgcccagccttctctctcttttaaatcaaaacaacacatttaaacagaaatcattgtctggattttggagcagattggggaacgactaatgcactgtaaaattttgaatcaataaagatttttgacattgtaaaacttgggcattactcagttcccccaacttctaaggcaattctagctcctataaaaagtcacttaacacttctcaacaatatgactaaaattcagagttttacaaatgtgtttttaaataaatttttttcagtaaaacagttctagttcagtatacagcactagcatatctgaagtaagaatattgccgtttctgatttgtatttgaaaatattttcatctagtcttcttttttgccttccttcttttgaaataagattcaatattgactgagaattggttctgtcaagattgtctctggcaatctgtccctaattcaactataaattattgctaaggatgaacacttaaataactatatattttaaatgatttttaaactacggccccttagtaatgtgatgagcatataaatttttgaattcagggtcttttgaaactctggagtatcatatgtatgtataggtctggaaaagatgtgttcctattaagacttaattctttttagattgagacaccatttgcaaattgaaaacaaaaaaagtttgtatttcccctagtatgtgaatatactgtaaggaggaataaaaagcaaaatagtctttttaaaacatagactttaatttttagagctattttaggttcacagcaaaattgagtggaaggtacaaagacttctcattatattccctgccccatcacatgcacagtgttctccattatcagcacccccaaccagggtggaacatatgttacagtggatgaagccaattgatgatctgggtggtgaataggtggaacacagaggagtttcagggtcatttttagaaagtacagattagttttaaaactaatgtagctttttcagattgtcttcttccacttagtaatgtgtgtttaagtttccccagccttaatttttaatcacacattttacatagctaaaatcattgagtttcagagtatcaatgcttattttaaaaaacagacatttattttaaaaacaatctgaaaaccttaataaatgtctcttaatgagaaagaactcttaaagatgtatgcttggtctgttgtattggaaatgtttatcaccataactatatccatctccatttcatttagttttataaaataatgaagttatatcattttctgaaataatttttcttctgaaatgaaagtaaatactcttaatgcctaaaaaatactttctaaaaatgaagctcataaccagattatgaagaatctgtcaattaaaatgatgtttcagaaaagtgggaattttattcttatttgggatttttgttatgttgatttaaatgcttaagacaattcgatgctgataggagccatcttttagaaaaagataagactgactgatctttactattgaaataaagtgtgctgtgtaatcaaatgcagtaaagaactgggtttgatgttttaaataacttttagataacttggaagtcttttaatttggaaaattatgaacatcagcaatcttaggaatttcaataggtatataaccataaagggatttgctgtataggaagcacaatactttcatctgaatgtaaacctgaagagagacttctgccccaataaaaatattttattgctactaaacaatcaaaagctattactgacttcatttggaatggccagtcccgagtgatctgctaagaaataagcagaacttcacttgactagccttaaaaaaataaaaattaaaattaaaaaaaagcagaacagcatggtttttaggaggctgttagagaatgtcatagcatcaagctccagagaaaatggtacagagtagacatgcaataaatgtttgtggaaggaaaattgatggttgagagtggtgtcaattcggaggcctgcaaagcatggatgtgttttgtgttaatctggacttttggaagcatttagtcagattcatttgcatatgagttataattcattttttggttcttttctggcattgtggtgttcattgttaagattttcccccctacacgtcacccactgactatgtgattaatttttcttctttcttttttttttttcctctgaacttgggaaacctcagctcttggcttttccttatttttccaacaccccctgtacacacatacacacacacacacaccccttttgtatatttttttgagacggagtctcgcactgtcacctgggttggagtgcaatggcacgatctcggctcactgcaacctctgcctcccaggttcaagcaattctcctgcctcagcctcctgactagctggaattacaggcgcccaccaccatgcctggctaattttttgtattttttagcagagacggggtttctctatgttggccaggctggtcttgaacccctgaccccgtgatcctcccgcctcggcctcccaaagtgctgggattacaggcgtgagccaccgcgcccagccctaacacacgccttttaaaaaaactaacacatttttcttaccaggcgagtcctcatttttgatacccataaatctatatataaatattggtaaatcttccgtgaaacacatacacacagtccagaaagtctctctaatacctactttttcagaatgctttgtgtgtactcctgaggtgttttaggagcttcgtactttgctaggtagggagttctttagggtaaaattgttagaaattttttatcttggttaagccaaaatcttttaccaattgaacttcttaggtgcattttgttaaacacatgaagaccacttgtctgttaacttctggatgtagatcaaacatcctcacttctttgaaccattccacacttaacatgattttgagttctctctcagtttaattctctttacacatattttgacttgacgttgcctttcttaaaatatgaagctcacacttgaatataataatccacatatgatcagataatagatgtcttttattaaaacttgttactaatatttgtattttcccttatgtttatagagttcttttataaaaatatcttgtagggtagttatctccattttataaatgagaagcagagtggttatcattcgtgatttgcctaaggtcacacaattgctaatttagacattgcacatctatttatatggtcttaatgttacttttttaggcgttccattacccagttgccagaccaagtatcataagcctatttaagtaaaaccactagaccttttcccatacacgctaatggttagatcttttccattctaccctttccaaatgcatttttaaaaatctaatgtatatctgttaaattgtatgtgtttggatttggtattgttagaatgtatcctgtttgtatatccccatcttagaagtttgtcttatgaaagaactatgtgattataaagtgatagatgcatgttattaataacactattaataacatttgtcaaagaatgtaagagttttaatttaagaatagttgtagtttccactattctgtcatctgtagaattggctttccgtttgcatatttaaatgaactttgtggcttttgttaagtataataaaaagcatggagtcaaatataagccaagagtattacagagacttttaggctgactcagtatctcaagttctgtgtagattcatctaaacactgctgttatccatgctatactttaccatgttatcccaaaagggaatcatcagcaaattttaccagaaactgctgaattcaagatatattcaatatatattatacttctgacatcctaggaagcctatccaaagaatacattactttgatagaatttgttctttatgaaaattcattttgactctcattgataactttattccattttgggggaggactgaggagtcagtgggatgggaacagagctaactacaaagtctttgagtttagatgggcagcagaaggggaaaggaagtaggccgtgggatatataaggacttttccaatggaaaacaattgtcagtggaacctctatgactacttgttcaatttcagaattaaacttcctgtatattttaggtggaatcaagctgagttctagtcaaaatgctacgcattatttcccatgaaaaatacccccaaacacaagcagacagaacagtggttgataaacccatcatattcatttctgaagaaatcatcaagccccaaatctgttttagaaatttctcaagaactaattctagactgggcatggtggctcaggcctgtaatcccagtgctttgggaggcaaggcaggcagatcatccgaggtcaggagttcgagaccagcctggtcaacaaggtgaaaccccgtctctactaaaaatacaaaaaaaaaattagctgggcttggtggcacttgcctgtaatcccagctactcaggaggctgaggcgggagaattgcttgaacctgggaggtggaggttgcagtgagccgagatcgagcattgcactccagcctaggtgacagagcaagacttggtttcaaaaaataaaaataaaaaaataataattctaagcatgttgcttccagagtctgccatttcttccatttttggtatttttctaacagtggttttgtgctctcacctgtgaggattaagagcctgggataaaactcattttcagtctaaagatttaaactcatttgaattgagtagatgcttttgtgatgtctgcatctctcctgacttaatagttcccttcttcacattacttaatctgtccttttggttagaagatcatgctcttacctaaagatagaaggaagcaaaatgaacatggaactacattgccctgccttttctcctgtcaaatatggcatcaggctgagcagtggcttttcctgatattccccttattcaaaacatagctttgtcttgctttcagcatttttcactttcctcagatcattatggattctgactttaatccgtaagaattatacttttatatacaagtaggttatatacctctacccatcttttctaagctttctttgcaaatctagtcccatcagattctccctgtgtaacaaccaacttctttagatttcctctaattttcttttctttatagatttatttattattgcatagtcaaaatgtcatgttttagcatcttctgtggcctgtgaatcactgctctctataaccatgggaccactcccacccatccttttcccgatctttttttggatagttgttttcttaaaaaatctggaagcaggctgggtgcggtggctcacgcctgtaatcccagcactttgggaggctgaggctggtggatcacgaggtcaggcattcaagaccagcctgaccaacatggtaaaaccctgtctctactaaaaatacaaaaattagccgggtgtgatggtgtgtgcctgtaatcccagctatttgggaaactgagataggagaatcgcttgaacttgggaggcagaggttgcagtgagccgaggtcgcaccattgccctccaggctgagcgacgcagcgagactccgtctccaaaaaaaaaaaaaaaaaacatggtagcaaacgttcagggttatatgtttgggaaacatacagtacctactgaagttcaggttcaggcattgtctactacatagaaatgattaaatcgaggtccttttcctagaggagctcaaagtctagttgtaaaaagtgaacatgtaaacaaatgattgcaatacactgtggtatttgcaaaatagcgaggatgcctgccatctaagaactcaagtataattattcccattccctgcttttgtaaatcctaaaattatgtcacgtcctcctagggtttctgttatttttgcagtagccaaccagttcttcgttggtcagaattaagtccagaataaaagttttcttccttattttcaccttggaaaagagagatcgtcagcaaggaatgttttatcaggtttattttcttctagcagatttagacttcagagatgttagggtggttgacaccttccatgtctctgcaattttgtcatttgttttggggaagtcatattgggtgaatattctggtgatctgtgtattgtctccttattttacattcccttgaccatctttggatctcctcacagggctttgttcatggtcactgctcagttttgtgctcacttaaatgcttccctccaggctgctgctttgacattgtaaagatcttttatatgaatcttttttgtcccttgccttcatttagcgttgcttacatattgtggttcgggtctcatctgatccagtctgtgatgcttctaagggtgtatgtatcttttatattcaaatttgtttactttttcctctttttttatataactttgcacatgagtattttttattttttcttagattctgattccttagatccttcataaagcagccatctagattcttctggttctcattaatctgattctccttcaaaacagatttatagatccttataggaacattctagaagagaataatatacattatgccaaacacatctacttatattttgaaatgttcccactgtatttttttatttgctgcctgtggcctgtgtgtccctgtgttctctatgggatgccctttccctcttccacatcagctgcttttcctctgatgttttcttatttgccgtttatcctatatgtagaatgcaagaattattcacttccttctttatgccccacaggtctttgctcatactagaatagcatttattatcccatgttgtagttatttaaacacatttacccttcccttctgttagcccatgagtcctgcccaggacacagactggttggtagtatgcttgatggcaagaacaaatgctttggagtcagactgattttaattgctgactgcaacactttaactccataacctgggacaaattctttaaactacagtgcctactcagcctcctcatttgtaaaatgaacctactacttaacctcattggattgttgatactaaagtaattgagtacataaagtgcatagtgagtgaaggaatagtggctgaagtagaaaaatgggtagaatatatcttagagacttttgtttaatatcctgtacacataatagtggagtatttgtttttaataaaacattccttctttaaacagttttgatgcgttggactttttaaaagtatatttgcttgtgttttggcatctgaaatgctattaaaaacatatcatcttagtggctcatttccttcagtttacatgcagagaagcctcttggaccccaaaacttaacttactcctcctgcattcagaaagctttgcatctttttggagagaaccatctgttcacagcattatacagataggaattaaacagattttgttggggaaagtcactttccagctcttctcaagtcagaccctcaagtctgcagatatcttgatgcatgtaacatttctaagacactgagctacatgctgaagaatgtacaggatgtccccatcaggcttttcagcggagttgtgagaggtgaagtatgagtacatggaaaggtggacagtaactgcagtcgatggcacggcatggtgtgctgccagatgaatggttcagaccctaagtgctggccggtggaagagaagagacttcgacttttggaagattgaataaaaactacttgaagacaacaagaaagcattctagacaaggagaatggagggaatagagtttagaaagcacaagtcatatgtagcgtgtctggatttttctgtttatgtcatttctactagtataaacaaatattgccttttttgttgttgttgttttgactgttactttgttcaggttgtttctgctcagaactctttttttatttgggttcttaagattttccacttaatccaaattctactttcagatctattaaacccttaagattttgtctgtgacctagtggagtattggtgtgtcttgcattataataaacatagttgtagaaatttgagtgtaaactatttaactagaataacatttttcataaactgattttataatgtctgtaacaattcatttactaagaagtcattttctctgcatattttagttaataaattggaatgatttttgtgactgccctgatgtacagtacacttatattatgaaggctttcttttaaatttcaatatgacaaattttgtctgctctttgaagtttagttcagcataaatcatttgtatttgagtcacttagagattcattgttgaggtttgaggaagtttagactttgttcaaaccaagactttgttcaaatgaagatgcactccatcccaaaactggtaggagatcacttataagagggaggggtgtgggggcaggagctaagacaggttattccctatgtccttctaaaaatgcacaaaggtttgaaagtctaaatggcaaagagttaatcatagtaggaaccaggtttctgatgtgtagccacttgcaccaagaaagatttgtttaagtaacctaaccactggagcctgtggttttgaactataaaggacaagagtgaagatggaagacaaaagctttttagaaaaacaaaatcaggttgtattgagccttttggtaatgaccattaaatatggctcaaaaactgaagtgcagaatgaacacttttaggtgtattttgtgactgggtctctcagtgactgcttcccggtaagggtgtatttattatttaatgagaagaccttgaggagggggtaccaaaaataaagtagaggcaggaattccaagacggcacaatatcctgatttggtggcacaaaaatatattcgtggaaacaaatctactggaattgtcttgtttgggggcttgttttacatgtgttttatctcactatgttgtcattatgcagaggtcttctatgtctttacccttttagcagcagatcttatttttcaaattaaatctcacatggtaccctaatacataaactacatgaaatcaaggtgggaaggaaggatgccttgtcctggtaccctgcgccctcaacttcctccattctttcaggtgaagcttttatgccagctggaaaaacccattggcttgttgccagtgacagcttactgttaggagcaggttttcccacattttgctatttatagttttacatttcataataattaacatattgcagttaacctggagaacagaaagatacccactagatgctattaatgctaactgtgtgtgcttgcccaagcagtgttctgtgaaaggtctgatgtcagaattcattctgaaatatagtctataatatagtcattgtttaaatgcctttctgtgtacttcctagtaaacagttggactagtacagtgttatgcagaaatactaaagatagttccaacctgttgtgagattttcaggtttggtgtgggaggagggggagaactatgtagtaactaaaatggcaactccacgaatgctactgttcttcacccaccaacacgttcccgtacgtgtcccaactggcctgtctttttactgaacttatgtagcatattttaatcatataccaccttggcatttcttctgttgctttttcagatgtagttgttgaacttttcatttattttcattgtcccactgtctagacttttagccccttgaaaacagaggtcatggtttaagtgcttttgtgtttcatgtacactgtaggcattcagtaaagagttgctttgatttttagcttggtggtcttaatatatgcattttatactgattttttaaactgttgttgttgctgaaaactagatttgtcagcttgtttagtgcatcatgatccgcttactatggattctgctaccttgaccagcaaggtagcagaattttaactataatttcttctttaataagagattttctgaggcaggtaaatgaagtatactgatacttcttacacagtggaatatgaaagtgtgacacgtcgcatcttgaaagtactttaaattgtgtgcctttgagttctacactgaaaaataaaactactaccaacaacttgaccccctttcctgccctcaaattgtttagaactgaagatagtgttttgttgtacatatttatattccataaagtaaaattttttaacatcagaaaacatctaaatatattatcgattccttaagaataaacactcattccctgatgtattatactattactaattactttaaaaataaaattagtattgtttttaatataaaatgtttggtaacttgatttttattatactttgcttgctcttttcacatcttatggtaagtttaaagtactttctgatgtcttgtctttgtaatgttttagtgataagaagactcattattagattgactacacagtacctctgagaatgatgagtgttattcctaagttcctaaaaggagactagtacacagggctagttcctggcagtaagaaataccctgccttagctttttggaaaatttactatccgttcggtattgaccaccagtggagcatttgttattaggcatttagcaagtaatgtgctccaaattgcatttccttctcttatttttatccttatgagagagtaaggcaggtgttatttttagttataaattaggtgtcctgggatgtacatgcctaaattatattgacagccagttgtggagatgccttatacaacctatctacaatgttttctctatgagacctgctgacttatacacgttgaattgtactccagtgtgaagtcctgtataaagaaaagaaaatgaacttgcatcaggttgagtcagggggcaaagtcctggtactatttgaaaggaaaatgtgcattcaagcgagatcatataagagccctagaagcaaaggaatcgacttcctttgtgtcagtggttctcaactggatacaattttgcttccctagaagacattttcaacgtctaaagacaattttggctgtcaaaactggggagttggtacccctagcatctagtgggtagaggccggcaatgctgctaaacctcccacagtgcttaggacagcactccacaacagagaattatgtagttcaaactgtcagtggtgatgaggttgataaaccctgctgtatgtgtttcaaagaatggaattgccagaagccctcgcagccaagacaaatttgggtcattgggagggaatagggaatcaaggaggtgacttcaggtatggccggactgagatgagctattttgatgggattaggattaagctgatttcctttctctcaccttttctttgtgccagcacttggcatagcaatagtggaaaaaacagtgaaataaacttcttttcttctaagctagatggaatatgatcctattccaagagctaaaagcatcattctacttccctgtaacacttgcagctttactgtaagccacatccatgctgtcaggctcccaaaatgtcaaggcacatgattttttggggggaggaggggtgtcaagattgttgcattataaactagctaatttatttcccaaggtatcctgtaatcatagtgcacctgggaggatctaaatttctcactgtttctgcatcatgtgccatatgtgaatttctttggctaacatacccttgcttgatttgattagtctacaattacaggaacaaatgtcccttaaaacaaactttttttagagtagttttaggttcacagcaaaactgagtgggaagtacggagaattgtcatataacccctctgcctttattgtcttttgactttattactaattttcaaataagatttatgtaaatgcaagtgttattctgttaatgcaaaattaaatgttcctcaatttcactgctcactaaatggtaaagcaaaagttaggagcagattgttctgagttatgggatattctctctctccctattcagtagaagagggaggatcatttgcatggacttcttagggatattagccactcggtgtaagatcatttatcttcctgaaaatgttcccatgtagttatacatcatctttttatttctgggggattttatttttcttataggaagttttccctgtttggcttttgcctaattggaagctattttaagttattcagcatgacagttggactgctttaaaagttagagtgtaccatagccgtaaaccttactgtgattgagagtgttctaggacttatatttatgatcttgtttgtgtctcatgtagttagggagccagggggaaactagtgattgtattcttgagcagaatttttttctcctggccgcaaagtccagtttcttcctttagtcacaatatctctctgctaatcatggccagtggacacactataatgcttctctgtttctcttttgcctcctttcaatcatgggtcttcccctgggctttccctttaatatttgaccctttaaaaaattaatagtctgtacagagtagatcgagagagtaagcttgcttgcttttttttggacagggttcaggttcaagttctcaataacaagttttgtgaacttggggaaattattcctgagtctgtttctttatctagtaaatgcagattatttatccttgtctgcctgcctctcagggctgttgtgaagatcacatgaaataattgactatgagagtgccttgtaaaccatacaacacaatacaaatgtaaaataatatgcaaatataagaaatgtgaggtttagtaaattacatcaattatgaaatgaaagtagggttggagaatttattttcccttctgttgtcttgttttgtgtagcctagagtgctttttcttcatcttaataagttcagagatgaccttcgttcagtttagttgtagtattttatctttttataaataaggtcaatggagttaaatgcttcacttgttgaaacatgatataatttggcattgatcagtggttggtgcaaagcaaaatttcaaaaagaaaattctgattttgctaagcagcatagatcgtgcctgttagaacatcctcctcctccttctcagcgttgattgccaatcagttctgtagaatcagaaatatttttctatgcttttttcaaaaactccagtttgtaatttgacttacattgctattttcaaaaataaaacaactatctaagtatttgttaaacaattaggtagttgttatacttcacccttttccccctgaccagttagttatactatgtggattctggatggtagtagatcaagttagtttagtcacaatttataaaaagccttttctatgttgctagtgtcttctcatgtttgatactattcataaatagacccagaaaactgtaggactccgggactcaggctgtgaatgattggtagaactgttggagtagagcaggcagactgtgttggaaattattccatctagaaggtatcagctcctgcctcctcggccttagtgactaaatggaaatacattcttttcaaattcaaaagcctgttcattactgcttttctcttctgaagcacattgccagttttataatgaagaaggacttaattatttttctttttctattgcttatgtttattcttcataaaatgacttttcttccatttgtgggctgagaaataagctcctatattggactttgcagacttggcttttttatagcgtaaatcagctcagctggctaaatgcctcactaagtgaaacttcataatgtagctggaactaaattgtgctctggagcattgagtctttaaactggattattgatttacaaacccataatggtgaagaggctatagagagacaagaacctccctctcctgatccttgagcaagtttttcctcacttcaggggctctgagctcacgagcaaaatcctaaccaagtttatcttgctaggacaacccattttaaatgctcaataaagaaagaataattcttctcccgcttaaccactaaagaacaacatatgtttctaacgtagctttttatttttttttatctttcatttttttgttggtaaatctcccagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtaactttctcactcccttcagctacactgactgccaacagtttggtttttagcacagattaaataaaaaccgagatctcttcaacataagctgcttttcacaaagccacaagtgtggagtggcttgtttcgttctcaggggtcatgcaagtctcatttaacctgtcggcctagttgtgtattaataagaaggcatttggtgcctaggttgcttcttctggtttaagtaggtgttaacatctggcaacatgtgtattttgtaggcctcaaagtacaaaaggatctgacttactcttcttataaggaacatactccactttttgttataaagctctctattataaggctgtcttgttacgtatccctgtcagaggaggaaaagcacaattgggaaatgccatcaggcagttctggggaatggtgttttgcagctctgcctctgtgacagtgggggactaagtctagttcaagaggaggcatgggtttgtgtgccaataagttctttgttgttgggggaggattggtttaaaaggtcttatttggaaggagtttaaaattgtaatctcttctgtctttccttttggttttgctttctaaatttgtttgacgaccttattctttccacacaaactcaccattttccctcttttttcttttctctccttaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacggccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatgatgacacttgggttgtccttgtttttgtttttctgttttgttggatgtgagtttgaaaggttttgtgacaagtagccatcagatgtttccatttgattttacatcttcaacagtggggagggaggatggtttagaagaagaaagtggaggagaaacaaccattttattgacagtcaatggcatccttgacgttcagcccatcttgtcctcaagaatccctcttccagtgcctttcagtagaagattcctctttctgctattgtattatgcatgccaagccttcccaactgagaagccttatgtgccagtaatggagaggttattgacatgttgagatgttggttctctttagggagacctggcaggagcagcagtcactatgtcacacaagtggcatctctttgtgagtgccatgatgggaaagagatcgggaaacactgatgtagatgatccacagacacatcttttatgactgaccattttaggaagtacctgttgatggggcaacgatcgcaccactgaccaaaagagggtagaggatgaaagttacctgttccccaacagagcaccaggatctgtgtggtttgtatgtcttgccttgggctgcattcagaagcccaaagctggaactggcatattttcagccatgtccattaagggatgtgatgtaggatcaactaaatagatctagatcgtacgttctgtgctttcaggtgggtttttttcgtccttacctttatgctgtactttaatttgttaaaatttcaacacaatttttagaaacttaaacatgatattctcaaataaatgtcaccagaaatagatggtgatcaagtggatagtaaattgttttgtaaaactaacaaaatttccctggataagaggagaggactagaaatgacaggctctctttgcccttgaacttcacttcagtctcctgaaccttcacattgtactgcaaagtgatggaccaatgcacaaataatattcagatggcagtgaattgtaatcaaggctttttgcggggatgcggggaagtcctgagatgggcatatcaataaaaatgttgctttttttgtaaaaggagggaactcctaccttataaggctgtgctgtaattgtgtgtgtgtttaatcagtcatacagaagagtttataaaaagcatgactttataaaaagtatgaagaataaaaataataatgacctgtgtgtctaccaccaaggttaaaaatagaggccaggcatggtggctcatgcctgtaagctcagcactttgggaggccgaggcgggcagatcactgtaggtcaggagttcgagaccagcctggctaacatggtgaaaccccatttctactaaaactacaaaacaaaaattagctgggcatggtggctcgtgcctataatcccagctattcgggaggctgaggcaagagaatctcttgaactcaagaggcagaggttgcagtgagtccaggtcacaccattgcactccagcttgggcaacaagagtgagactccgtctcaaaaaaaaaaaaaaaaaaatagaacctctggtatcttaaaacctctatttgcccctctccagttagacttcattttctttccttatcgtttcaaatagccattattttaatttctgtgttaatcttcaagagttttgccagctatgtatctatccctgaatagattgtttagttttaaaaagctgagtaataaacccaagcctagctgtagaaggaaagggtgatgttgtcactattagattaagacttttaggagaagataaactaaatagcttctggggcatagtttggctttagcgtctccgatcatttatgaaagcctcttagaagtacagtggccaaggttatgagtgagtcctggaaaacagggcttgccagttggggtaggtcttgtcaggtaagcacagtcccgggtgtctggcagaaatatggtctacaggatcagtttgctgtctgtttcctgtgtcaaagctcaccatgg

SEQ ID NO: 12952 - DNA, 24993 bp, Human
aaaaaaaaaaaattaagtacagctgacagctgatggaacgaggttctttaggagattgggtgcttagcattgttgaagaggagaaatgctggctttgctgggagtgccttgagggtaggaaccatgttttcttcactccccaacaccaagcagtaggcactcagaaaatgtatatacaaatgagtaaagattttacttcttagaagtagtcttgattgatattgtagaataccaaaaaacctcactatttttattccataattaccattctgtattatactgtgtgtaagcaatgtatttgtgaccttctgttctttgaaataaaagggaaaaatcacaaatcaggtggtattgaggtagtaatcataatcacttagtttgtctgtgcctgctacgtatttattaaattctgcctccgcatcttgaaatgtgtcatgtccaaggctctctgcttggtgcatgtgatgtgcacttcattggaagaggcagacatgcatagaaacagcctatgagagacagattctgtcctgttattccacccagggacactgtcagctccagacatttgccttaaaattggttattttttaaagtttggaaaaagggaccaggcgcggtggctcacacctgtaatcccagcgctttaggaggccgagttgggcggatcaccaggtcaggagatcgagaccatcctggctaacacagtgaaaccccatctctactaaaaatacaaaaaattagctgagcgtggtgtcgggcgcctgtagtcccagctacctgggaggctgaggcaggagaatggtgtgaacccgggaggcggagcttgcagtgagccgagattgtgccactgcactccagcctgggtgacagagcgagactctgtctcaaaaaaaagttcagaaaaaggacacctttttaattttctttaattttttgtaggggcaaggtctcactatgttgtcaggctggtcttgaacgcctgagctgaagtgatcctttgatcactgcctcagcctcccaaagtgctgggattggccagatgtggtggctcacacccataatcccagcactttaggagactgaggtgtgcagatcacctgaggttaggagttggagaccagcctggccaacatggtgaaatcccatctctaccaaaaaaatataaaaagttagccgggcatggtggtacacgcctgtagtggaggctgaggcatgaaaatcgcttgaacccgggaggcggaggttgcagtgagccgggatcgcgccactgcactccagcctgggcaacacaacacgactccatctcaaaaacaaaagtgctgggattataggcatgagccaccgtacctggccctctttttgattttctgtgttaaattttgcctaccgcaaatatttctaacattaacaaagactgaatttatagacagcttttgattctgtgtaacttaattctttcaagtgtattcaaaaagaacaaattggttaggagaggtagagtcagctcatcacagaccatatttcagggtacagatggtgagagaattagtgtgggttgtatttggctgtgccagttacagtgttgtagatggaaaaccccaaacaaatatgtggaggctcttctggttcacatttttctttctactgcttataaactagaatacatattgatatgatctcattttatattacccttttttccctaggttcactagaaaacgttttgcctttttttcttaataaatcattgccagtgaaatatgttacataaaatatgctaagcaaatcaaattagcgtatctagaattcacttacgaggactgtaatgcattgatttaaatattgattcatcgttctaaataaaattgcttcatttgatgaattgcagcctggagacattgattgattggaacattatttggtcttcagagttttacctctgcattttctttttttttaacagtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggtaggcatctatcctccctttccctacatttgtagcatgttaaatgtgtatggatttggggaaacagagcttgactggtccctgacaaattaagtatagaaagtgtatgtccacttttaggccgggcgcattggctcacacctgtaatcccagcactttgggaggctgaggtgggcagatcacctgaggtcaggagttcaagacgagcttgggcaacatatagaaaccctgtctctactaaaaatgcaaaaactagccgggtgtggtggtgcgcgcctgtaatcccagctactcgcagggctgaggcaggagaatcacttgaacttgggaggcagaggttgcaaagagctgagaacatgccactgcacttaagcctgggggacagagcgagactctgtctcaaaaaaaaaaaaaagaaagtgtatgtccacttttagatgttgccgcagaatttttattgtatttttagaagagtttcagtctgcagcagttaggaaatgtttcaaaaccagttcttctccatagacactttaagaagcactggcatttagtgaactctgagtcaagtcttattcaatccattcacttatttattcacttattcattttcggagactacaattaaagaaaacctggggatctttagccgggcttcctattacttgggagtgcattcacaaaagaaggaattcagctttttcctggggctgatttacataaaacctattaggactatttatgattttgtcgtaacaaaattgttcacgtttcttgtattagtttctataactggggaaaatgattgagcttattattttaaagattcctttagttcatttattatttacctagaaagagagtgtgtgtgtgtgtgtgtgtgtgtgtgtgctttgttttgtttttccccgtcatgacctcacaaaaggctataggtcttagtcccacaaaagtaaaatagctctgccactgggatgtgtcttccttgttctgagctttttctcaaaaccctatcactggccctttagttttcagccgatgtacccaaaatatttcccttcctatgactttcttggagcagaacttcaataccgtttaactcaggacatacttgagtgcctacggtgtgccaggcgctggtgccagttgcttcaggggatagagtgtgagtcatgcagcttctgcctcatggtgtccagccctgcagcagaatcaaggccaggcagcagggatgacaagcaattatgttatcaaatggaatcttagtgcctttagaaacacttgaaagtggccgggcgtggtggctcatgcttgtagtcccagtactttgggaggccaaggcaggcagatcacgaggtcaggagttccagaccagcctgaccaacatggtgaaaccccgtttctactaaaaatacaaaaattagctgggcgtggtggcaggtgcctgtaatcccagctactcaggaggctgagacaggagaatcgcttgaacctgggaggcagaggttgcagtgagcggagattgcgccagcgtactccagcctgggcaacagagcgagactcagtctcaagaaaaaaaaaagaaagaaagaaacacttgaaagaacagggccaggcgcagtggctctcgcctgtaatcccagcattttgggaggctgtggcgggcagatcacttgagcccagggtttcatgaccagcctgggcaatatagcgagaccccatctccataaaataaaataataataataatttaaatagtgcgttgaggtaagaaaggaggaaggatcacagccagttggaataaaagatctcacagggaggtggcattggagaagggctgtgagagctgggtaggattttagcagggaagggaaagggaattttggccacggggaacagaatgagaaaagagctgaatcgggagagtgtgggccatttcgggagtagcaagccattctgtgtgcttagcacatagctgatatttggccagagtcaggagaaatcggactagaagagtgagtatgcggccacccagcaaaatctcatgaacatctagctcaggagcttgtccttttgtgggaaacggtcggagggtttctgagcacagagcggccatcagagctccacgtcaggaagctcagcccacagcacgtggatggcagagtgatgggagaagagggcagagcagggagccagggagctctcggattgcacccgcctggagatgacccaccccaagcggagcagggaagggggctgcactcgccaactttgtgtctttcagggttgtttcatttacaaatgctatttgctttcccaagttcagtcataatttagacattttgaaatcatccttttgagtttcatgctaagagctctaagtttttatgttataaataagttaaccttgttgtttattgttgtaaaaaaccagatgaattgccaatttatgttaaaattatatatgtaggaattctctcaagaaacgtcacaatcttttctatttttttgtttttttttgttttttttttgtttgtttgtttgttttggtgagatggagtccttctctgcctcccaggctggaaggctggagtgcaatggcgcagtctcggctcactgcaacctccgcctcccaggttcaagcaattctcctgcctcagcttcctgagtagctgggattacaggcacatgccacaatgcccggctaatttttttgtatttttagtagagatggggtttcaccacattggccaggctggtcttgatctcctgacctcaagtgatctgcccaccttggcctcccaaagtgctggtattacaggcgtgagccaccgtatccggccaatcttttctatttcaaccttttctttttaactgtagcctgggaaatttttaacctgcaaaaagggtgggtccttgttgggtttcattttttaaaccatttggggattatatctaacgtaaatttatactggaaatcatcccagcagaaattctaataacagcagttcagcggacttcctagtaaattgtatttaatacccttaacagtaatatctgaaatgacaaaatataaaatgtttatattatggttatctatagatcatcagttggatataaaatatggacagaatcaaggccagatatgatggctcatgcttgtaatcccagcactttgggaggccaaggcaagaggatcgcttgagaccaggagtttgagaccagcctgggcaacagagtgagacctcgtttctattaaagaaatattttttaagatatgggcagaatcaaatgtttcctttacatttttcttctatcagtgtcttattttgttgtagtttctcctgaaatcagctgtttattcaggttatctatgaatgtgcaaaaaataaaacagttgcttttgttggattacaggcagaataatcccgattgcaattaaacactttaatttcaaaaaataatttctggctgggcacattggctcacacccatagtcccagcactttgggaggccgaggcaggtggattgcttgaacccaggagttcgagaccagcctggccaacatagcaagaccccatctctataaaaaaatttttttttcccagcttgaaaaagtttttgtctttataagcttctaactattggagtaagcttttacattcttccgaatagtagaataaataacacaggtgccattatcatgtaaatgtaatctttgctctagatcattagattttggctctatgtttttatcaatatttcttaaaaatagtgttggagggataataaatcatagaaaaataaactgtaagaaaaataggtggagaaaaggacttatctttcaatgtatatttctcagctatagggttgttaattttatgcatgtactctgctaatcaatagctccatcaggagtgcgacaggcttagtgcttcatttttctttgacagatttggatttgtcccaatgtgattgtatttgcttgtttgctgtctttaaccccagtttttttttttctctgtcttttaaaaaagcaacagggtcttgctctgtcacccaggctggaatgtggtggcatgatcataggtcactgcagccttgacctcctgggctcaagcaatcctcctacctcagcctctcgagtagctgggactataggcatgcaccagcacatccagctaatttattatttatttatttatttatttattttggagatggagtctcactctgtcacccaggctggagtgcagtggtgcagtctcagctcagtgcaacctctgcctcccgggttcaagcaatcctcccacctcagcctcccaagtagctaggattacaggcatccaccaccatgctcggctaatttttttgtatttttagtaaagacagggtttcaccctgttggccaggctggtatcaaactcctgacctcagatgatctgcctgccttgacctcccaaaatgctgggactacaggtgcatgccactacaaccagctaatttttgtatttttagtagagatagagtttcgccatgttggccaagctggtctcaaactctcgacttcaagtgatctgcccatctcagcctcccaaagtgctgttattacaggcgtgagccactgtgcctggcctgatgttttttttttttttttttaagagacaaggtcttgctatgttgcccagactggtctcaaactcctgggctcaagcgatcctcctacctctgcctctcaaagtgctgggattataggtgtgatccaccatgcctgacccctccagaagcaaattaatcttgcttctggtttgaacatgaggagttttcaaaatataatttaggtttttataacatgagaaatgggactgtttttttctgccttaggtcttggtgtttgaggggactcagtaaatgttagtgttagcagtcttctcagcaggacatcctgtacaaagaaatgcagtagaatctagtccccttgcaaagtactgccctttgtatataaaactgtttatctgacctcctcaccataggacatttgatttgtgtttctgattatggtggttgagggatattaagacatcactacttgttctgctgtcctgctctgtgatgggtgacactgagcatctcattgagttcccagtgcaaagcaacacctgttaaatgtttgttgaatgaatggattctgtaagatggttgttgaggcttagtgatgcaatgctatgatcgagaaacagaattgtgagctgagtgaggcaaaatagtacgtaggagatttaatctgaaattatgctcccagatacactggcctaaattcttttgtggcttgtataatcatatgcacaatttaaatcttcctttcaagctttgattctgtaccttccatttaaagaagtatcaaaaatattatttaagaaaagtaaatgatatttggaagctgagtgaagtgatcttatgatttttagactaaatcaattgtttgtacattctagcatagccttcagcccagaaaaagtagaatcctttaaggaaagtgatgttttaaatttgggaattaaaaaagaggattcaaaggaagaatatctctgttatagttaactgtgtttttaacagagcatgaaacatcctaaggtttcactaagtgtttgtttaattggttttatagtgctgttctggccaagaattagtaatttagttagctttgaggctcaattaaatactagagaatcatagtttagaattaagaaatcctagtcaagtctgtattttatacagtgggtttagagttatagacattgctacaaaacgttgttgaaagaaatttaaagaaggcacaaataaaggggaagacatccgtatctatggactggaaaacttaataacattaagatgtcagtacatacaccgtggaatactatgcagccataaaaaatgatgagttcatgtcctttgtagggacatagatgaaactggaaaccatcattctcagcaaactatcgcaaggacaaaaaaccaaacactgcatgttctcactcataggtgggaattgaacaatgagaacacaatgacacaggaaggggaacatcacactccggggactgttgtggggttgggggagggggaagagatagcattaggagatatacctaatgctaaatgacgagttaatgggtgcagcacaccaacatggcacatgtatacatatgtaacaaacctgcacgttgtacacatgtaccctaaaacttaaagtataataataataaaataaaaataaaataaaataaaattaaaagatgtcagtactacctaaagtgctctacagattcaactcaatccctatcaaaatcccaatgattttttttgcagaaatagaaaacctaccctgaaattcatatagaacctcaaggaatcccaaattgccaaaacagtcttgaaaacaaagaacaaagttggatgcacacttcctgatttcaaaactttagtataaagccatggtaatcaaaacagtgtggtactggcataaagacaaacatagagatggatggaattgaatagaaagcccagagacgaacctttgtatatatggtcaaatgattttcaacaaaggttccaagactattctgtgggtgaaaggacagtctcttttcaacaaaaggtgctgggaaaactgaaatccacatgcagaagaatgaagttgcatccttattttatatcaaataaaaaattagaatggatcaagctactcaggaggctgaggtgggaaaattgcttgagcgcaggagtttgaggccagcctggaaacgtagtgagaccccatctcctaaaacaaaacaaaacaaaaaaccaaagacttaaacgttagaattaaaactataaaactcttagaagatgcagtagcatcttcagagagaaggctcctctatgtgctggaactgtgctaccctctatggcacagctcataatagcatgcttttaaaagtatcatttaggctgggcaaagtggctcacgcctgtaatcccagcactttgggaatacaaggcaggtagatcacctgaggtcaggagttcgagaccagcctggcaaacatgatgaaaccccacctctactaaaaatacaaaaattagctgggcgtggtggtatacgcctgtagtcccagctactcgggaggctgaggcaggagaatcgcttgaacctgggaggtggaggttgcagtgagctgagatcgtgccattgtactccagcctgggtgacaaagtgagattctgtctcaaaaacaaacaaacaaaaaaaatttttttaaaaaagaaaatagaatattggttgctggggggggtggggaaaatatttacagtttaatgtattgagagcttgtatgggatgatggaaaagttcaggagacagatagtggtgatggtcacacagtaagactgtacttaataccactgacttgtacatttaaaaatggttaaatgataaattttgtgttttgtatatttgaccacaataaaaataatgcaaaaagagcctatttttcttgagtttagtgttcttggtaatatgtatataccaagaatatatttttaaatatacacatacatatatttatacacacacatgtgtgtgcggtatgtatgtattggacacctgtttggctccactttaaccctcttttcacctagtcattgctggagcagccagctgtgtgcaggtgtgacctcacacctggcctgagctgccgtgtctttccatcccagcatttctgtgctgcctgaacaaggatgctcagccttattgatgcatgcacagacttggaagcatgagggagttaaagtcccatagggtagccctcaaccagtggaaaactaaacccggtgaataagctcctctgtgttctgacactgaagccaacagttctcaggcaggttcttactggctccccagcagatcaagccccagttgcccacagaggtgaccagcttgaaaacgcgacctggagggacagagaatgggcttgccctccttcccggtgccactgttcccaggcctccacgcttgtctcatggggtcacttcccaaaacaaacactcagcgtgtgtgcctttgccttgcctctgcttctccaaggagcccaggtaaggcacaggtaacgcttccaagtttggttatggttattcctcttatgtaaggcgctgttccagactctcaaaataaaaaaggcaatttttaggttatgcaaaaaggatagactaatataaaaaacacccacgtgcccacccaatttagcaaataaaattttactaatacagttgaatcccatgtctcctcccagagataaccatcatcctgaactcaggtttctcattttccacgaaatctgtaaactttaataggttgaaccatatgaaattgctatatttgttggtcaaaagtggtcaaatatcagcatttcttctgattgagcctgatattctgtgtgtatgtacacacacttttttttttttttgagacagagtctcactctgttgcccaggctggagtgtaatggcgcaatctcagctcactgcaaccttcacctcccgggttcaaagagttctcctacctcagcctcccgagtagctgggattacaggcacctgccactgcgcccggctaattttttgtatttttagtggagacggggcttcaccatgttggccaggctggtctcgaactcctgacctcaggtgatccgcccgccttggcctcccaaagtgctgggattttaaattatctgtatttggagtcgacatgattgtctctttagaacggaatctacataaaagctgttagaacgaataagtgagtttaggaagattgcaggatgtggggtcaatgtccaaaatcaactgtctctgtaacagtaaacatttggaaattgaaatatctatggatatttcaaaatccctaaatatatatacacatatatttacacaaatatgtatacacacacatatataaaggtatatcaaatctatattatttctaatacacacacacacacacacacacacacacacacatatatattttttttcttcagatggagtctcattctgtttcccaggctggagtgcagtggtacaatctcggcccactgcaacctccccttcctgggttcaagcaagccaccatgcctggccatgaaataatgtaatatattttgagataagcatcttcaattaccttcaacgatatttgtagcttaagtatacattaacaaaatatgtgtatgatctgtatgctgaaaattatatgctaaactgtatgctaaaacactaatgaaataaatagtattttacatcatttaaaattttatatattggccaggcgtggtggcacaggcctgtaatcccagcactttgggaggccgaggtgggtggatcaccctgaggtcaggagttcgagaccagcctggccaacatagcaaaaccccatctgtactaaaaatacaaaagtgagttgggcatagtggtggtgcacgcctgtaatcccagctacttgggaggctgaggcaggagaatcgcttgaacctgggaggcagaggttgcagagagccaagatcgcgccacttcactccagcctgagagactgagaaaaaaagataaaaaataaggagttccaataagtcagagtttgtgtttataaatacagtagccattaaaacataaaaatccatcttgaatagctagcattccatattttcttgaattttaattcagttacaggtttctttctgatctggaaaaatgatgatggcaacataaataataaaggttatcaaaggtttttgcatttttcatatattctgctcccctctagcacttttgactgtaggtcccagaattttacaagtactcagattatcaaagtaaagtttttaaattcaccatgtctagctgtatgtgcacttttttctgtttagtaaagtccatctctctggctgttttagtcagtggtgattgatgagaaccaaaagcactttgcctacccccaggcagaaatggaggccttgcctttgatattagtggacctgcaggctctggacactggagaaatggaattttctagatcagatttacagaaagacgtagaatataaatctcttgccttaggatgctaaagataatttcactgctgaatggatcaagccattccttctcaagagtaaaatcgttcctcctactctgtttattttgttttcttttgtttttttttttttttttttgagacagggtctcgctctgttccccaggctggagtgcagtggcacaatcacagctctctgcaacctccgcctcccaggttcaagcaattctcgtgcatcagtctcccgtcctcccactctttaatgtttaatagaagtggtgggctcctcatttttttttcagtccaaagcaaaggtgtgtggcaaaatcatgttcccagtttgttcttcagtgaaacagctaaaccttgccttctccgaattgggatggggcaacagagtggagccatggtggatccagaaaggtcaggaaatacacacttggctgccatcctcatctgttgctccttgaaactgaccttcccatatggccttttccacttttctcctttactgatgcctattatccagctgtcaagcactctttcttaagttcccaagaaggttgatggttatgtgttgttcttagctattttaggtacaaggtatgtactgtcattttgatgactgactaactgcacaggtgatcttagcatatgaaggcagcttctggtctgtattttgtggaaaacctacttacatcataggaaaaagcctcaggcattggtttttaggctgcattgtttgtgttatgcctgtagacgttgtgctgccagagggggatactaagtgactacagaaaaagttaagtggttaatgatgatttttattttaatggaatccccattatcttttctcaaataaatatgcggccatcacccaacaggatgatgttaattttatatcattagagaattcagaaatttctaaaagtgagctatttctgaaataattctaaggagaaaaatagtcatttggtttttgaatgaacagctgcagatccttcctgtttatcgcaagtcattttcagtccattttcatagattatgtccttcccctgccgtctgcaatcttctaaatccctttcgtgctaatgccgggttatcaggggcagcctcaggaatctacatggggatgtctgtggactcacagaagggcaaagctaccagctgagggctcgtaaccatttttcacaaataggaaactgatggttttgcctccaagttaattctccaagcttccaaagcacctcacagctagaattcacgtatttcataaccatatttatgctacttcaaggggaaaatgggtgtggaggagagagaaagaacacaaaactcagtaaaagcttcctaatcggttcttgcatggcttcatttttgtataattctttttaagagagagagacagggtctcactctgttgcccaggctggagtacagtggtgagattgtggctcactgcggcctcgaactcctgggttcaagcaatcttcccaccttagccaaccgagtagataagactacaagcgtatgccaccatgcctggctaattatttaattgtttgtagagatggggtcttgcagtgttgtccaggctggtctcaagttcctggcatcccacagtgctaggatgaatgggccactgtgcctggccattttgttataattcttaatcctatcacaggtattggattttggaagagagagagagagagcgccgtataacccattgctgtcatctgcatgttacattcagttacagtgtatttctggaatttgaaaaaaaaattatcttgaagggaaatgggaagaaggatatgattatcaagtaactgtttgcaagatagcttctgtcatacgatgcgttggtactaggaagaattcgttgtggggggctagggataatacatgagccttttcccttgggcaaggaaaatgtttaatgtacagaattacaaagtactaatattttataagctattctttcttaattagttcttccttaatttccattgtgttcaatgttaatatttcttaactatctcacataggaattttagtattttcttaatgtttaaaatacatttaaaataagctaataccaagaaccaaatgggatgtgattttgcaaaatctcaattctaattctctttaaaagcgacaaagctagccacctttgaaatggatgctaaagaaactttgaaatgtatccagaagcaataataattatcagcatttaatatacttacatattcaccttcccttttaagaactgatatgctactttaaaatccttactatatctatataatattttgttatttatgtatattacttttttttgagacagtcttgctctgttactcaggttggagtgcagtggcgtcattttggctcactgcaacctctgcctcccaggctcaagcaattctcatgtctcagcctccagagtaactaggactacaggtgtgtaattttgcatttttagtagagatggggtttcaccgcattggccaggctggtctcgaagttgatccgcctgcctctgcctcccaaagtgttgggaatacaggcgtgagctaccgcgcatggctttctgtattactttaatatatggaaacacgatagtaaataagagtaggattaatcttaaaactgccccctgctggaagcagcttgcagtccactgaaaagccagactgagtagaaggtctgacataatatatttttttaaatgaattgacaaaaaatacatagtttttaggataaatgatgtttcctcaataatgaaggatatttgaacactggaagaataaatattggtgcacaaattattttatattttatctagttggagaaatgttgcaaagtggcaggtaaatgttcaaattgagagaagttaataaatgagggagtgtataatttgcacttcaggatcaacagatcattgaaagatctttacataggcgaagcaagaacaaagctaatttataggttccttttattgtgttaccattgccaagcctaaggaatatttctaaaggtattgagaagtttcttggatccattttattgcatttcatttattaaactattgcctaaatatgttttctgtaaagaaaatttaatgttgcttttcttctagtgattgaaattaggcttttcattatcccaattcattaataaatgggaaaataatttttttctcagcctcatgaacgactcaaatattgctctctttctttttctctagtccatctcaaaatactcaggagatatacacgtactgcaaattatataaaataatttgtgctcagatattcttccaatgcttttcaccccaaaatgcattttttgtggaattacatagtcccagtatgaattttgagaaaaaggtttgattgttttgcctttgtgaaagagaaactgtggctatagggagttaggcatctttaaagaagttgccaaacgtacattagcatctttcatgggaatttcattcaggggaggaaaatagagaaagagaaaaaatagttggaaaaaaagaaaaaaaaaaaaagaaaaaaagaaaaaggaaatgaacacagaaaatctgagacaaacagataaaataagatggtagacatcccaaaatatcagtaatcaacaatggactagttcctctagtgaaaagacagtgagtgtcaaactgtgtttatttacatacaggcacacacatgcattatacacacatgtattctttttatgaggcatatctaaaacataaggatacagaaaggttagaagtaaaggctgaaaattgatctccatgcaatacataatcaaaagaaagctacaccagctatattaatgccagacaaaatagactttaagacaaagggcattcctttatctggaagacgaagagggtcactacctaatgattaaaagttccattcaccaggaagagaaaaaaatcataagcttgtatgcacatgataacttagccttaaaaggtaggaagcgaaagtgaccaaatgtacgaaaaaataacacatccacctaatagtgggagaatctaatagatctttcctgataatagttgaaacagacccccaaaaaatcaggatatagaacttgtaaagcacaggagctggatatactgaacatgtttataatactgtaccaaacagctgcgcaaacacactctttgtaagcacatgtagatttatgaaatttgatgacactgaaccaaaagcaagcctcaaactgtcaaaggattactatcactgtggatagcctactccaatcagagggaaaatgagttagacattaaaaagataaaaaactcccatctatttgcaatttgagaaacatacatctaaataattcatgagacagggagagatcataagggaaattagagagtatttagaatcaactggcgcagttgctcacgtctttaatcccagcactttgggaggctcaggcagaaggatgcttgagcccaggagttccagaccagcctgggcaagacattgagactgtgtctgtacaaaaataaaataaaattagccaggtgtggccaggcatggtggctcatgcctgtaatcccagcattttgggagggcaaggtaggaagattgcctgagctcaggagtttgagaccagcctgcgcaacatagcgagacttcatctcatttaaaaaaagaaaaaaaaagaaaaaaagccagttgtggtggtgcctgctactcaggaggctgaagtaggggcgggtggcttgagcccaggagtttgaggctgcagtgaactctgatcacaccactgcactccagcctgggtgacagagagactctgtctctcttttttttttttttttttaggacagagtctcgttctgtcacccaggctggagtgcagtggcaggatcttggctcactgcaacctccgcttcccaggttcgagcaattctcccatctcagcctcccgagtagctgggattacaggcgcccaccaccatgcccggctaatttttatatttttagtagagacagggtttcaccatgttggccatgctggtcttgaactcctgacctcaagtgatccgcctacctcagcctcccaaagtgctgggattacaggcttgagccactgtgccctgccttctattttaaaaaataaataataaaacatatcaaaactgttcaggtgctgggtgtggtagcacgtgcctctactcccagctatttgggaggctgaggcaggaggatcacttgagcccaacttaggcaatatagcaagaccccatctcaaaaaaaaaaacaaaacaaaattaaacgaactggtggagaacagctgaaacagtacttagaaatggatgtcttgctgggtgtagtggctcatacctataatcccagcactttgggaggtcaaggaggatagatcacttgagcccaaggagtttgagaccagcttgggcaatgtggcaaaaccccatctctactaaaaatacaaaaaattagctggatgtggtggcaggtgcctatagtcccagctacccaagaagccgaggcaggaggattgcctgaaccctagaggttgaggctgcagtgagccaagattgtaccactgcacctcattctgggcaacagagtgagactcttatctccaaaaaaaaaaaaaaaaaaaaaaagacagtcacacacaacagcaagggagaacctcaggagcaagatctaagcaaaaaaagcaagttgtggaagaatacctataacatgataacatttttagagatacaaatagatgttgtaaactctaaagaaaagcaagggaatgataaaattccagaaatgacaactttgaaggaggaaaggaatgtgacagagggaaaaaccaaccttgtcccaccagggacatcagaacaatagcagtgttctagaattgggcatgtttgtatcattctcttatatcttgcattcattttataacctttgaatatggacaatatttaataaagttaattacatttaaaataagtgcacgacccagcttggtggctcacgcctgtaatcccagcactttgggaggcccaggtggacagatcacttgaggtcaggagttcaagaccagcctagccaacatggtgaaacccatctctactaaaaatgtaaaaattagccgggcatggtggccggcccctataatcccagctactttggaggctgaggcaggaaaatcacttgaatccaagaggtggaggttgcagtgagctgagatcacaccactgcactctagcctggataacagaatgagactccgtctcaaaaaaatacataaagtaagtgtaattgctaaattacaggatacctgttcttgtatatgtgcaagaaaagtatactttttttggagaaaaggttaacttataatgagttcttaattaggtttcatgatttaaatttccccttctgttaaaggtttttcttttttttttttcctccccttccctttgccttgctgctccttaattgtaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtacttcaccgtgcagagaacactgttctctaaacttgtttttctccatccaaaaatatttttatttcaccgttttctatattattatagcagaggtgtgtagagtgaaccatctcaatcagcaaataatacaaaaatattttccctttattttatagatacataatttcgtgtatttattaagcacatttacctcctaagttgttttgctgagactagtagttgaaggagttgatttttctggcagctttgctcaactgggactctgcgtgggttacgccctgacaccctagtgttcggaaactaacttctctcctgtgcatctagaatggtatacatgaaataagacatgaaatccttgggaaaactgagaaaatggtctcttaaatcatttccataattcatatgaggaaccagggaggtcacggaactgtacaaaagggctgtcttcgactttgaaattgcagaggaccctgtagggtaccaaaaattggctacgcttagtatattctaatcctgcattggtgtgactctctgagaaaccaatttcttctgagaagagtgggcaaaatcaggagattactcgtgtattaaatgcactgttttattttcaaaacatttttttcagtctcccttacaaattaaaaaaaaaaggtttgttttcttgccttccacgtaaaaacctaaatgaaagagatgtcttgacgtttcttggtagagtctcttgagatggagtacaaataagtccatataacctaatgtcttctaagattggaatttagtagttgctgtcgttcatttctctcttcatccatttatttatttatttattatttttatttttttattttttgagatggagtctcactctgtcacccaggctggagtgcagtgatgcaatctcagctcaccacaacctccgcctcccaggttcaagtgattctcccgcctccgcctcccaagtagctgggactacaggcatatgccaccacacctagctaatttttgtatttttagtagagatagagtttcaccatgttggccaggctgatctcaaactcctgacctcaggtgacccacccgcctcggcctcccaaagtgctgggattacaggtgtgagccaccacacctggcccatccatttattttttatgcagttaatattcatgaagcacctactgtgtgtggccatgtgctgtacactgagtggccagtggtgagccaaacagacccagtcccacccttttggagattatagactgtttacaagaaataggccaggcacggtggctcacacctgtaatcccagcactttgggaggccaaggtgggcggatgatgaagtcaggagatcgagaccatcctggctaacacagtgcaaccccgtctctactaaaaatatgaaaacaaaattagccgggcgtggtgacatgcacctgtagtcccagctactcgggaggctgaggcaggagaatgtgaacccgggaggtggagtttgcagtgagctgagattggaccactgcactccagcctgggcgacaaagtgagactccgtctcaaaaaaaaaaaaaaaaaaaaaaaaaaagaaatgtttaattttctacaaaaagatggaacagtcaacataaaggtgaaaatgaagaaaacatagcccggtttgcaaactggctttgagcgtctcgctccctgcaggtgcagatgtccggcgaagtgcgggacaagtcctatctcctgccaccccagcctgtcaagcagttcctcatctcccctccagcctctcccccagtggggtggaagcagagcgaagatgcgatgcctgttataaattatgatttactctgtgctgtttccaaattgggaccaggtaataaacttctatttttcctattttcttccccaagaaacttttgtattgaagatcgtattcagcagtgtgcattgtggcagtatgattagagcagaggataaagtcaaacacacctgggttcagattccagctgtggcatctgcttgctctgtgatcttgaacaagttacttagcctccattttctgagcttctgcttttccatctataaagcagggagaatcatatgcaccattcagtgtggttataagtactaaatgagggccaggtgtggtggcccacgcctgtaatcctagcactttgggaggctagggtgggcggattgcttgaggtcaggagttcgagaccaacctggccaacatggggaaaccccgtctctactaaaatataaaaaattagctaggcatggtggcgtacgcctatagtcccagctacttgggaggctgaggcaggagaattgcttgaacccaagaggcagaggatgcagtgagccgagatcgtaccactgtactccagcctaggcaatgaagcaagactctgtctccaaaaaagtaaaaataaaaaattaagtattaaatgatgtatagataatactcagtaaatgtaactaatttttactactacagattttgctagtacttgataggcagttagtgaatatgaggtgccttctctccccagccccaccaagtatcagacaaacaacaactactttgaatatattacaaggaattggtggtgatatcatctcactccttcaatatttttgtcatttctttttcatttcctttttccttctctttactttctctacctctcttccttttaaaatcatataagaaaccgatgtgatgctggttcagacagttgtccacccaagacagagttatgtctcttgtaggggaataaaagaggcattttgaggaagaagtgattcagtgctgtttttagacgttagagctgtgtcttagatatccaagttcctataatcaagggagtgcctatgctgcctggatccttacaagtatctcccaaactgaaaccattatgatgtcagagtcacttggctggatgcggtggctcacacctgtaatcccagcactttgggaggccaaaacaggcagatcacctggggtcaggagatcgagaccagcctggccaacatgataaaaccccgtctctactaaaaatacaaaaacaaattagccgggcgtgatagcgggcgcctgtagtcccagctactcgggaggctgaggcaggagaatggcgtgaacccgggaggcggagcttgcagtgagccgaggtcgcaccactgcactccagcctgggcgacagagcaagactccatctcaaaaaaaagaaaaaaaaaaaccatctcgactgaaaatacaaaaattagctgggcgtggtggcacacacctgtagtcccaactactcgggaggctaaggcaggagaatcgcttgaacctgggaggcagaagttggagtgagccgagatcgtgccactgcactccagcctgccgacagagcgagactccatctcaaataaataaattaattaattaaacagattaactcatattattcataaaacaataattagcatttgcattttaactcccaagacttcagtactgaaacaacattttatacaagccttaaagtatcaaatctttaacaccaaaacaagataaaatactctaacatagtatttaaagatttaaagaacaagaatcacccattaaaataggagtagaacaaaaagttgcaagggacaaaagagttctttttgctggaagtgatgcttttgtcatggttattttgtttgcctctgcaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactcagcattgtgcccattttttactgcaagatggaccctgtatgccaggagacatgtattatcaacaattgggaattttttgaatttccttttaggtaatattgattcactgtaattttctaagtgatcaaaacccatgagattttgttatttggcttggctttcattctctgcctgcccattaaagaatattctattcctaacacataaaacattttacagtcaagcagtgcaaattacagtgcttttctattttttttttgagagccttgaataaattgaagaaaactttaaaccaaaattagagacgagtcatttaagcttttctgaatggaaagtatt

SEQ ID NO: 12953 - DNA, 46492 bp, Human
  misc_feature (1)...(46492): n = A,T,C or G
aggggaggcggacaacggagtctaagtgacccggagactgtcatccaggaccctaatgggccgttttcaagactagcttttacttcatgaaacttggagcccctacagacaagctgaggaatattttacttcggatggatcactcagctacctggagaacacacaaggttaggaagaataggagacaggcaacatggccactaacccaggtgagccacgagagactgctctacagaagtaggtagcaagagactaaccttgatacaaccttaagcagaacagacctttcagagaagcaggaaccgctcacagcgtgggtttcagagtttttagctacccgcaagtactttggtttctcccacttttaccaccctcctagcccccagagccccaatggaaaacttgtacccacgctactgaaagacgagactagaagcttggacacttcacattccctgctctcccttccacaattgagccactgccctggttttagaagtggggcttgttttgctctgaagtaacccttaacgtccttagaagtagcagctcccctacccctctccccacgcctttgccttttaaaaaccttaacttttgagagagagaaacagcacaagttcaggcccagcagagtaacccctacgttgttgccagcaactacttcaagggcagctaaccgtgcttaaaagacgccaaaagcatccatctcccgcttacaacaacatttagctaccccccacccacgtactttgctttctcccacttttacaaccctcccacccccagagccccgagggaaagcttgtacccattctactgaaagatgagactagaaacttgtacacttcacagcgcctgctctccagctgagccactacccgggttttaaaagtggggcttgttttgctttcttaggaaataacctttaacttccttaaaagcagcagcgcccccacccccacttttgcctttcaaaagctaaacttttgagaaaaagcacgagttcaggcctaacaaagagtaacccttacgttcttgttgccagtaactacttcaagaaaaagcacttaaccgtgcttagagaaagacgccaacagcattcctcttccacttacaacaacattcagctacccgcccgcaccccgccaaatactttgctttctcccacttttacaaccctcccagcccccagagccccaaggggaaagcttgtacccatcctactgaaagatgagactagaaacttggacactttacagcccctgctctcccgccacaactgagccactaccctggttttaggagtgagacttgttttgtttaggaaataacctttaacttccttaagaccgacagctcccccatcccccacgccttttttgcctttcaaaagctcaacttttgagagaaaaagcacgagttcaggcccaacaaagagtaacccctacgttcttgttgccagcaactacttcaagcaagggcacttaaccgtactttaagaagacgtaaaaagcatccctctcctgcttacaaaacccgagcaggaggactggcggctgggcaacgcccgggaccggtcaaaaaggagaggccggggagcgcccgccacgcaacgcggtcacaggtacagagaggtttttccagacccccaccaaagcccgccagtactttcagcgtctttaagacccccccgcaaataaacttcctacagcccagcttctcctacaagctagcaacagaaaggcacccaccccccgactcccagaagcattctgacgcggctgcttgtctgcgccgccttttcaagggcccgcggggcgtgctatacgtcacttccggggcggggcgagcaaggcgggggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcagtaagtgccgcggcgcggggcccccgagcggccgccgcgctgccccggccccggtccccggcccctaggcgccgtgcgggtggcgggggagtcctcggcgcgggggaggggtgcgggcgccggccggaggcgtggcggggccgccctcggtggtgcagggcgggacccccgacggggggtgcgcccccaagttggcgccgtgggccgagccggaggagccccgctgcccccaagggcctggcccggggcgcggaccaggaagtcgcgcggttcctggcgctcgtggaaagtggaggccgccctcccggcgcagtcaacaggtgaccggccgagaccggtccggggctccttctcccttctgtccccgccgtccccgccctgccctgacatgccccgccgcatttgtgtctccgcagagaaggtgttcgccagcctcccgcaggtggagaggggcgtctccaagatcatcggcggcgaccctaagggcaacaattttctgtacaccaatggaaagtgcgtcatcctaaggaacatcgacgtgagtaccccctaccccgggcgcggttctgctccggagccaccttgggatgggataattcgccttcctctccacttctcacctcctgcccattggccgggggagggtgagggcgccacgccccctctaccgggagccacacctcggagccccggaagccggcctcagattcacccaggtccttgtctgctccttcttgatgaggaaactgagtcttagttcgtttctgtctacggtcatagcaccctgaaagcgccggatcgcctctgatcttggaagctaagcacggtcaggcctggttagtacgtggatgggagattagattagttcattccttaaaagcaagggctccggatttgagggatcagactgacccggtcggccgctgcgtgaccttgagaagattggcgatttgggcatctctgagccccagttttctcgtctgtaaaacagatgatgagatgatgaccactctcgcttcgcctgctggctgggcagatggaatgaatgagctgctggcgtccctcaagcccagcggtgcctggtgcactttgagcccttgctgaatggaatggcactcagctaactcgctgttaataccctggtcttccagtatggcagagcccggaaaaacacccgggcctctgggccagccagatctgccaccatggatctaagccccaaagcaaaaacaggaagcagtgttttcccatgaatcattctctgcaagcctccggtacccaggctgaaaaggcttctagagccagctccttgggaaatccttgcaaattcatgttattcctctgtaattgttggggtgacccagtctgtcagtctccctcccttcctgggttacacgcttaaattttgcttttcccttcctcagcctgagtgatggaattggtggggtgggagttggaggtgccggcccggccattgggtgatttctcctgtgctgtgcttagtgggggcggctggcacaaagatgtatgttttgattgatgccataggcatacaagggttgtcaacttaaagtcagcctgatttcccttggtaggttgggactgttgatcggacacacttgccctccaggaggccagcaactggctgagggaatgaaggggtctctgggtctcagtttccttctctgtgaaaggagaagcctcttggtccgaagagctgctggctctgcccgcatctgtctcgttaacccaggcagtcgctgctgttcctctgctggaagacagagctctacctgccctggattgctgggcccctcaaatgagggggtgggcgggtgtgaatgtgctttgaaggtgctaacaacttgctagtcacacagattcctagaaagccgaagggccttgcttagaactggagaaaatcaccagggatctaatggtaatgatctggaagtctccgaaggcaggtcctgaggcttttgagaaaataaaaattgagacaaccctaaagagatatttagtagtttggcaaataaaatccactaacacgtcctcggatacagagcagtaggatatttcgttttgcccctaaccaggccttccctgtcgttgcagtccacattgacttccagggagggggcctcacataaagtacctgctgtgcatctggccctgtgatagcttcttaaactgtagcatctctttccaccccacatgggtccgttactctaaagaggagtcagacttagcaaggtgaggcaggccagtaactggagctgcttctaatggagtggtcattcagggacaggcacccctttgcagaaagcatttcccagcttgtgaaacccattctgcctgtttctgagctctgtattcttaccccttccccgtggtttgccattttcttctcaggggttaccctgtttcccttctcaattatttttaagtttctgcaatgccaggtcagcacgagatgctactaatatagccctccctgggctggatgtagatcaggcactgagtctcttgttagttggatgggtggactgggtactcaagtaaaggtgggtacgattttttttagggcaaagtactcttggaaaaaaaagtgacatgaattggcatgaccgttcaggaaggatgatggtctgtttggaatgcaggctcagggagggaagagggaagaaatggaggaccagatcatggaagatctaacatgtctcattgacatctcagactcaacatacatactccaagccaaatttgtgtttcccacgtgctcttcccctaaaagggaacaccgttcctccagctgttcaggccccaaaccttggactcctgtttcactctctgcttcgctactgcgccacattttaattttagtaaatccttctgactccacattcaaagtatcttcagaatctaacagatttccctggcttcctctgcctccacccacgactaagctatcttcccccacctgaattattgcccccagactcccgaaaaccaaacaggtctccttgctttcacccttgttgccctgggggtctgttcacaacactcgctggagtggctgaaacacaagacaggcctctagtggcttcccacctcggtgaaagccagagtccttaccgtggcctcggctccagcattcttgcctccttgctgcttcttgaacatgccacacatctgtcttggtacctgctagttattgcctttgcctggacattttctcagatagctgcaagtcttgctccctgtcttctctttggtttttcttttttaatttgaggtggaggcttactgtcgcccaagctggagtgcggtggcgtgatcttgggtcactgcaacctccacctgccgggttcaggcaaatctcctgcctcagcctcccgagtagtggggactacaggtacgtgccaattcacctggctaatttttgtattttttagtaggtaatggggtttcgccgtgttggccaggctgatcttgaactcccaacctcaagtgatctgctcgctcgccttggcctcccaaagtcctgggatacaggcgtgagccaccacactaggcctttccctttggtttatacttagatgtagtcaccttagtagaggggtgtccccggaatagaattttccatccccggccttctgtctttctcattgctgacaataagtaggaagcaagctaacaagcagcaggctacggctgcctacaagtgtacataggtatctgcctgtccccctaactgggcatcagctccaggccagcagggctttcccctctctttcagtcactgccgtgtcctcgcctaagagagtgtctggcacgcagtaggtgctcagtgagttactcattgattaaaaagcctggaaaaccaggctgtgtcgtgaagataataggcagccactgaggtcttactgcatgagaacaaggaaagctcagctcagtgtagattgccggacctaaattttgtggaatcgcctttcatacctaagaggcgagcaccgttgccagctttgcacttggagccccctctgtcatttattttgttgacttaaaagctgttttgtgaacccagcataatggcacttcttaaacttgtagaaaaagggtgtttcttacctgtttatttcaacacatctcgttgcctcacctggagaggcaactctcctctgtagagtgaaagactataatggtggccatgtagaaactaatattccagaaggagagagctccaagaaggggattccagtgaaccatatgtacactgtgtttgagagacattagttccccacggagaagggatggatagtctgtgcttcgggggtctaaggaaggcttcctgcaggtgctggtacctccttaggtctggggtggttccttctaagtttccttaccctgcctgcatcacctctgcctcttatgacctctgtgcaaagactgggaagggtcacccccaatggctgtgaacgaacctgtttgtgattctaaacagggcacgggaccatcctacaataaaaattacccagcctaaaatgccagtagtgccagtagtccctgtttagaaaaagaaaaaaaaaaagcaacttttgcctcacaacagaggccctcttgtgtgctgccaggcagccagcagatttgctatgcaggcaagtttggggcctggtttttaaagtatccagttcctagattccagaactaaaatacacatttggaaaaatgatgtctataaaattgagtttccgggagtgcaaggtttatagcaatttgacactgctgggaacccaggcgcagtatcagtggacttttctccttgaacagggggcagaccaagtggggggttggggagggtattgggctcactcttggtttcccttggtgtgagctgccaccattcacatgcagaggactcacctgtgtttcctgcgggttgggggtaatggtggcatgacagagggcttgaggactgacctagctgcttctccggaattggacgcctgctgactacctgcgtgtatccagatggccattggcctgtgggggtgcaggatggaggccctgcccacatggagctcactgtcctgggtgggagtgaaataaactctaggtggcagaaggaagtggtgcgttggattatcacctgggtgcaaacgagctggcagcagcgcctgccaggtgcagagccaggaacctctaggccttcagtctgaccacctgacggcaggggaagcagagggtggtggggggccttcatctcaggagaatctgagtggctgcaggtgccagtcaggacgctgggcttctgcagatgggaccacatctgggaggaccgaagggccgggtgcttatgggctgttactgtggcactgagcgtgaggggagtggacaggacccaggctgagaagtgctggtgtgcagtggtggcaggtggctcacacagccctaccatagcgcagccctgctctgaaggccactggagccattcagaggtctcacagacaagtaatcagatccagcctacggtaaggagaagttctgtatctgagatctgaggcagggaagccaattaggaagctgctcaaagatgaaggcggcgtcagcgcaggttccgttgcgtggtgcagccatctctggctctcacgtttcccacacatgttcactaagcccctgtcttggcaagccataccctaagccacagaggaccaggattaaaatcagtgattttcagggaggggtaatttcccccacctcattcccctgagggatatctggcaacgtttgcagacatttttgtgccactggtatctgaagtcagggttgtggccaaacatccgacaaggtacatggccgtccttccacaaagaactgtccagccccaaatgccaggggtaccaaggttgaaaactctggtaaagaaccttcgaaggcaccaggttaagtgcttcaaaagaacaatgccctgggtgctctgggaatgtgagggaggagccagctgtgccacagagcggggacagctgctggagaagtgccacatttgagttgggtcttgaaggatgaataagagttctccaggaggagcgttgagacacacggcagaggtggggagaaaccaggcaggaaacagcatgtgtacctgggtcctctcagccccactgtggcctcctgtgtgttgcttttggtacatttcttgccctgttggaggtaacgggagggatactgaagccatctttgaggtaagagaagaggtttagcctcatgcgtaagactactggagagatggccttgcccaagagtagttggagatgcttctttggagagtgacctccaccttctgcaaggcccttgttagggacagctgtggacacaggaaagggccctgtgtgcgtctcttcgccgtctcagtgatgggcaggcactccctgccctggcgatgtgcctgctccttagacctgtgggtccttagctttggtcaccttgcttgtcacttctacgtatgggtcctgcctgctctccagggaaaggccagcatcccacccctacccccgccccactgtccaatccagtgtatacccctgagcacctctctgttctttgttgagtgtattttgtgctggtctgtggctgaaacttggtgtgcttgcctcttctgtttccatgcctgcgagagtgggaggaatgttatcatgggatcagtgtaagatttaacggagctaattcgtaaagcatcttcagaaggttgtctgggccctggcagggacctctgctcttgtcttcatgactgccctgttgggtggataccctcatctctcttttgagaggtgaggatgctgaacctctggaaggtgctggaatttgaaccctgggagccacccccaggtctacctttgcaactcatcagttaaggccctggtgggccctgggtggggagtaggagaggggaagactgaaaacggaggtggtggtgtcccgctcacacgtagtccaatgaggggtgctgctgtgcagggccacacggtgagtacccccaggcctgtttcaaggcatctgaggctgagctgggaggcaggaggggaaagtcgttcagggcatggcggcctgtgagtgaccaccccgtcctcagccagctcaaggagctgcctgtacactgtttggaagcacacagctggttggccagtgcagactttattctctgtattaaagaatcacactaacattgagaccaaccgtaaggaagacaacaaaaccacagggaggagtaaaggccgccacatatggtccctgatttgcagtgacgtgacctgggattgtgtgaaggtgttgagcatttgttacctcccttgactcaccgtgctgttagttatatgctcataacccaggtgagtcagcaactggccctgagttcaggtctggcgctgccacttaacagctgggtggcctggggcgtatcgcccagtgtctgccttggtttctttgtcatgtgggattatgaggttaccttccttacagcaggtgttgtgaggtttcaaagagaatccactgaggggcccacccagggcctgtctgagagtgaatagtaagtggccggtggggatttgtttcttgataaacagctaccaggctccagccaagttctggtctttgtcggtatttggcagctgctgtggtgaatcaagtgtgaaccttccccactctggtgtccacgtagtgcagaaggcaggtggggcacaaatgatgtgtagtccaaggtggaaagtagtgagggcagtggggtgggagtcagggaaggtgggggttcagggtgggagagatgatttctagcttggagcatcagggaaggctgcttggaggagaagccctttgcctgggccttaaaagataattaggagaaggcgttgtgttgtcgcagaagtttacattcctgctttggagctgaggttttttgctgtcattcagccttggccttagttgtagtcaccagtgaacataagggccctggccagttatatttgcacaggtcagttacagcagtaacagctttcagcctctgttgcttgcaggaacttggagtatttacaaagccagtgccctgactggaagctcacgctcacttggcctgggtggaccatggaggacgcctgagactttctctggggttcccggggacagttggcagctaaaggagggcacagcaggccccttcatcagtgttgtgtcgtcatctgctgaaatgttttttgcttgggcaggtatctccaaccttctagcatgttccatcaggttcactgtgggccaggagctgagataccagtggcaagccttgagacccaagccccaggacccagggtcatcacagcctacctgtaaattggagtagtgacctctggcccctccgtcacccacctgagactgggaggacataggaaagtaagagagctttgaggggctcagggctcactaattgtaaatgttgctgcctggggcataacagagttacggaaatgtcgcttctgtgtgcttgtttgcatgacctgtgtattatagcgagtctcaaaggcggcacagacattgtacaggtgccgggggggagtatgtttaggtttgccattcaacaggattctcagaaaaagaccagctattcctgggcaggatgcctcagtgcacaggtgggaggtgggggctggtgggacctgagcatagtgtgacagagtagaatggcctcccgggtcaagtccaaagcttctgcttcaaatgggcaccactgggccttgaaccaggccctgtgttggcagggctgggtgctgttacatgctgtcacttgccgaagtccgtgggtcctgggtctgctcgcgtgtgtgactccttgattgctggctggtgtccttcatgtcctcagaggcccccggactcctccaggggtggtggcagaattctggggcttgtctcgaggtcttatcccagccccagctctggccctcacaggccctagcccccaggtgtggaggccactggggaaggggtctggggccagcaaggtagaggggctgcacctgttctatcctcaagggttggggtgaggggccatgggttggggtagtcagcccaaggagtggctggcaacgtcagggcggcagcagggtagcgatgagtgggctgaagcctggagggagctcaggaagggtgggttgcaagccggaccgtgaggtaatcagggtcgggatttgaagactaccggcttggtggagggtggagatgcattccaaagcagttatcgctcttcccaggaggaacaggaggactgcattgaaaatggtggaggtaaaagagaagatgggttgggagttggcaaggaaaactgggcaggcctgtggtgaggactgaacggcagcctcccactgccagagctggcccagcctgcagcagcatgagaagaaagcctgggaggaggggtgtccctgagtgggcaactccaaggctgctcatggtggtctcccccaggcccccagggagatggggagacagaacttttgcctacagtagcactggggctcctggaattggcttcctgccctccctgtctcgttttccccattccagagtttttccccaaataagcttctcaacccccaatctcattcttcttccccaagatggaaggagggggaggaggctggggggagaggggcacactgagggtgtcaaggtgccatctcgacccagctgatggggacagagcctcacaggccgagtgacacgtgggggtgtgaggtatctttctgggtgtagtaagcagcctccctctgcgagctgaggagctggggaggaggctgctctgactcagatgtaagtcattatctgcagtttggagtatctcagcccccaccgctgacccagttgtatttagaatacaaacgagagtgagtgattcatcagctggcaggattctgttgccctttggggtttttacacacagccctgaccatttaggggaaggaatttttaggggcagaacttcctctcatgcccctgcccaggcatcttccatctctggatgccctccccagcggaaggcccatgggagccccaccctttctacggcagcacggcctggggaggaggtcgtccaggctgggagagcccacgaggccatctgtctggcgggatgggcaggtgcccctgtatgtgagcgtgagacctcccccatccccagtcagctgtgagtgtacaccgaacagggtcttggaggggctgcctgttaagtggatcattttcttgccaggtgctttgggtagggatgtgtcagtgtcagaatatgaaggactaattggagtgggagagggttggattgggcagacatttaataaatagccagcatcttagttttattgaggtgtactttagatacagtagaatttgtctgtattcagtgtgtggcttggatcttgacagatgacctatatagtcccataagcaccacccctgtcatgacagaacattcctgtcactccggagggtgccccccgcccccgccaccccttccaccctcacccccagcagctgcttatctgctttctgtcattggggttgccttttctaaaatcttctttcatatgaagtgagaggcaatgtgtagtcttttctgtctggctttttcactttgcataacatgttggcgattgatagctggtgttgagtgcatttgcactttgttcctttctatcactaagcagtgcggtgtgttgcctgtttctctgttcacctgttgatggatatttgggtatttccagtttttggccattgcaaagaaagcttctgtgaacattgctcctgtgtcttttggtggacacatgcttccatttctccagggcagatacctaggagtggggttgctggtgtttggtgtgagtagtgtctgtttaggtttataaataacctgcccaactcttttccaactgtaccattttgcatttccaccagcagtgtgaacattccagtgtccccacccctctacccttgccagcacttggtgatgtcagtcttttctttttattgattctagtgagtatggagtggtattctgttgtagttttgacttgcatttcccaagactaatgacactgagcgctttttcatgtgcttacttgtcattcgtagtatcttctttggatagacaccttcatacattctaatttcactggcgaacgattatcccaaaatggattaatttatgactggtgtctattatatcacataatgctgtgttaagtcttagggatgaaagagaaggtctgtgtgtacttctttttttctccccaaaaccacttattgagatggctagtgagataaaggtcatgttaagcagggcacagcagagttggaggagatggacaggaatgctagggactatgatgtgtgttgtgccatcccggtggacatgttaaatgatctggaagcacagaagagttgatacggatagcttgggccatacttggaggcttcatggaggagggaacgcttccgttaggcctgatgggtgagtgggtgtccgtaggcagggagaggtgctggccaagggcacagactacacacagacgtggagcttaaacaggatggcagaaggtgggcaggaatcagggtctgtacttctgtggtctcagtctcgtgagatgggggcccctcaggtcttgaggaggggtctaagggagatgaggggtggggtggcagcaggtggggtcatgctaggggtgcccgggcaccctcacaggagtctggtgtgtcctaagcctcaagctggcgggaagctgcctctttcaaagagcacttggtttgtaaaaagctgacagtaggtagcagagattagatggccatgtctttattccctcctgaaagaaagcttcactgtggagacagattgagagcagcccagtgtgtgtgtgtgtttctgtttcactgaggccctgcgtgtgtgtgtatgccgggagggaggcgcagggatctacttttagcacattacatgttgaaacctcattgctgaagatgcttctagtctcaaatgttggccccatttttgccacaaagtccacccagcctttgatctgtgctatgcaagggagtggggaatcgactttcctttccaaacccaagtttttgatagagagggctcccacagcgtgtcctgctctgctcctgcacagcacagccaggcgctgagtttggggtccaacattgattggcagccaggagagctggtcctaaacacggaagagaacagagcgctggaatgaatgcagcttcccacaaatgggagggattagaaccagggcttcttgctctaatccaccttttgtgtatgtgtttcactgatatatttgttctgtattatggaaagtacagaaaagcagaaaaggaaaaaaatcaccttgttgtacagtcatagactaaggagaacgaattaaagtaacatgaaattctatcacccagagataggtaggcaggcagtagatacgtaggcaagtggtatgcttctgcgattttcttcacggttttagcttcagtgtttctttgtacacccctttcaccccatatctgttgatgtggagagctggaagcttgactgcttctccattccttctgttcattccggggtctcctcctgcagaacccagcccttgctgacatctacacagagcacgcccatcaggtggtggtggccaagtatgcgcccagcggattctacattgcctccggaggtactgtatgggggcaaggctcgtggacacctgtgggggcctgggtggcgctcagggcccagggcgaagctgggcttctggccttgggagagtgggaggagggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagccatggcatggtatgttggagcccttgtgggccgtgtgtgtgtgtgtgtgtgtgtgtgtgtgtgtctgtgtgtgtgtgtgtgtgtgtatgtgtgaatggatgttttgttttgtgtcatctttacccgctgctcctttcccagtgctaccacaatgctggcctccaggccagcgctcacgttttatttgtacactgggcctttgctctctgcagcctgggcttttgtgtggctcagtgggaggctaggcagaggcaggggtggagagatctttcctcttgaaggatgtttttttatttacttagttctttgacgcagagcttttcctgtacacagatgggaacaagaggtacaggagtgagagtggtaccccttctagaatggtggcccactcattcattcactcactcattcattcataagctcaacagatacttactgcctgccttgcctagccatctgcagcccagggaggccaagtgagtaagctgatgtgggcctcatcagcctctctggagagtgacagctatgaccaaattgctgagagagctaagcaccagtaggggagggcgggactcatgcacgccgtggccctatgcttgtaccatcctgcgtgtgcacagcagcctgtcctgaagggtgtatgggagatggtaggccttggggttggggaagacctgggttcggctctgtcttactctgctttgtgctcacaggctgggtaatttacgactaacacaaatgtattggctcatagttcttggggctgggcagttggacagcaggggccgttgcacagcaggggccggtatctgtcaagggccttttgctgtgtcagtccatggcagaagaacaaagagaaggtgagagaagaagacgggctgggcttgtccttttattgggaagctgctcatgtcataatacccattcctgagggcagagccctcctggcctaatcacctctccataggccgcctctgatgcattggggattaagtttccagcacatggttttcgaggtcacactcagaccatggcagcctcttactggtggcgtagccttagttgagtaactcaccttcctgggcccgaattttctcttccaaactggggctgctagtgcctgcctcttagggtgtgaaggagccagtaaggcatggatatgcccagcatggctgttgcactaatgggtacttacccctgggtgacccgttacctgtcacaaaactggggctctgttctgatcgagccaggcggctgggtgagctggctgactgctgttggcggtcagctgaggtcacggtgaagggttgggcccggagtctggctcatagtaggcatttaatggtttttgtgtttagatcttctccagctccatctgtaaaacatgctctcatttacatcccatgatttatttagctctgtgatttattttttccccaagccctgcttgccagcaaaagtctcttcatttaaagccccaagatttggcccgaatgtcttttacatgtttaacatggagccgaatgctcttagaagtgtcttctcaggagaggaatgcagttggcaagggcctccgctcctgcctggcacattgtccgtgccctgtcagctgcaagctgagaacctgcgggcccaggcctgccctgtccccagtccccagaaaggtgtccaatgagacagaattcaatggaaggctgttgcggagactgttgcaaaggacagaccacataaataagtggccatcgtgggacgctgtcctccctgaaaagtgccctgattttgtagaggagccaagggagtttggggccatcctcaggtccaagtgttcttgggcgagatcatattttatgtttctaatacatttctttgaatagagcgaagcaattgttaaggcttacattggaacgtttgctgcagagatgaagtggggctaaaaatagtgtggtaggggggtggtttggagaagggggctgagaaagagccgtgctggcccactaagtgggttgcctggcagctggccccagccctctgcaggatctttagaccctgtcagtctgactggttcatgactgctgaagtgttgaaccttgggaagggctgcgcacctgggagcctccggcactctgggagcccacattcccacggggcagtcctcagtgcacaggtcatttcgggggcaggcccaggcctccttttcctgaggttattttcatgatactgttctgtctgccttggcgctggggccgtggttccaggctgcccttgggagtcggcgagggccatgtgacaggcgtgtggtttggccttacgtaggcccagggcaggcttcctggaggaaggcgcctctttcagggtgggacgccctctgccttgtcctgagagcattgtcttctccatggggcagcatgggccctggatgggcctgagcatagcagaccacgtggtcacatgtgcatgtgtggacatgtgtgcatgtgtggatatgtatgctcctgagtgtatctgcatgtccttcctgcacacacagtgctcccctccgatgctgccagcctgtggtgacttcctcttctgaccccttcttcccccccggcctgttttatcagtgaaaggacttaactaagcagatctccaggtcacctttggaactcagctcaggtagcacagcaggtggtcttcctggaccttgtgcagagaactgggcccttctgggactccccttagttagtgctgttcactggatttggcatcacctcttgcctgtccccgcagctggactgagagcaggacagtccttacgtgcatctccctcatctcagaggatggctcagtctaggctcgggctgtgtctgcccacaagcaaggcatcttcgtggcctgtgtagagcctccgttaattcgtggactcgttccacctgactcgtaacgagctcttgctgtgcactgaagactagttggagacttcgcacgtgttaactcgtggaacctacagcagccctgtgagtggctctgttatttcccctcttctggataaggacacaagccatgttgcttgctgagccccacaaagcctgtgtgtggcagaggctggatttgaacccagggcccctgctcccaaggcctggctcttagctgctgccctcctttgagctgctcagttgcagcaagaaaacaaaagctcttttcactggaagcagctgtagagctgtggtggttgttaacgtgtcctgacaatcctcttaaaaaggcgcctttacctgcttagcagatggggctgaggttttaaagcgtgaagccttgagagttagtctagaatgctcccatttcttcacgccaacacagtgctcatttggagagggtgtgtcgggattgggacttggtacttggtgacaggatcgtggtgggggattgggggtacgtggcccccggtgttgcttctgttacaattggctgcccacgctccggtgagaagagaatcagcatcgagttctgtgtgtaattctccttcccccgcaacacccacctgctactctcacaaaagaatcttacgcttggattcctgtgcgtcgtggaactgctcggtgtgtgagtgaggctgctgatttgccaggcagcagcacgctgttgggaagctgcacaggaagcccggtctgcaggcccaggtggaggccgccaggccacgctgaggcatcgcagtgggcagcacgctgcaccctcacagctgtgcacctcgtttccagaagtcactgcagcaactgcaaaggagaggcaggtgtagccagtgccgtcccattccacaaaggtggcctgaggcccacacgtcattctgatgcccctacaagaaaagaaacacagtgagaaaactaaaccacttccgggcatattggagtttaccatcatgtgtccctgggctttttctgatgcctaagcagggtttgttatccagatgatttctggcaagatttctggcaaaatgcagaggcccaaatggcaggcctctggatgccacgggctctgacttaagggtggctgaatattgttgccctaagacacgttctcttcactaggccttttcctctagaaagcctaagcaaccagacatggttctgagtgggcctatggccacgtggccctggcccggcagtgacctgtggctctccccctgccctttaccccaccaccgcctccccccctcccccgcccgctgtgccccacagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtgagtcactcctctcagcccctccctgccctgttgctgtggctcatgcgtccatgtgctatgaccctgggagggggatgcgctgatgtctgtactaacttgcactcgtgagggttgagctcccagtaggtgccgggccccgtgagggctggctgcagccccaggtaaggtagaactccacatcacactgggtttgtcaccagggcccagcactcatgtatctcctctgacgtcctgagtgccttgcctgctagaaccccagctctcatgcccacctgcaggcagcaagaaggggacagagtgaaagagcaacagcacttctattcggggtccctcacagcagctgccccatgaagctgccagggaggctgaactgtttcttccagctgggcacctcccccaagggtctctgatggaggagggaggggcagtggatgctggctgggtggcactgggtggctactgacctcaggggcctagtgactggtgaggttggtgccgaaacccaggtttttttaattcaagagagtcagagtcccccctgcagcaccatggctggccataaccccttgaacttgacagtggcatgtctgttcttcactgaatggcactttctcgtacatgttctagtaggtgtttttccatggcttctcaagtcattcctgttggtcttaattccttcttttttcagtagcaaatagtaactaaaacagtgtttttgttgaatgtcagccaagagcagggcatctcattcctgtaggggatggtaactgttccctcccaatagaactgtaaggagaatggtgaagctgtaaagatagccctgggccctgtggcgtggggccccacagacacacacatgcatccccttcccgaaggcgccggcttgccccatcttgttcttgggtcctttggacaaatgccttgtggagccagaaccccagtgcttccctcatttgtccctgtggcgttctgagctgcctgctgacagtcactccatcctctgtgcactggcagctcagctatcagattgcttaccagccttctgggattgattttttttttttttttttgtcttccacctgtgtcattgggtcaaggtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgtaagtgaacttactttttgggtgaaatttgtggtttgtacatgaggctagcagaggctgagcctgtttagatgctgatggcagagaccacagcacatgccacgtatgccatgatacacagaagtgggctcccaggggtgtgcagagagagggagggctcccccacccagcactcgtcctccccaggccctcagctgggcatggatggttcccacaaggaagggccctgccctaggatgatgtgtgcctgtcggggattggggcaggaatgtccctgaccgtgtaaccaggcaagcatctggggctggaggtgctcattagagaggggagcctgcagggcctgctgttagctgagccaccaaagtggcagaggaagggagcttgcgggacatccagattggtctctcctagagacagtgagggcagtgatgcgcctgcaaagtgacaaacggttagaagactgaaagatactttgtggaagaaatgtgccagaaatgcggcaggctttgggtgtagctggcagcatctcagaggcccatgccgtgcatgcgccccgccttaggcacccaggccttgccaagcctcctcacttctcccttctgcaagacgggggtgtgccggggccagcagcatctgagggttttgactatgaatttgaagtaggagagccacctggcaggtctggagcatctgtgatgcccattttcctgccccagctttgtaggagtgaggggaggagcccagcagccagtctcagcacaaccccacggctctgccctggctttccccatcccgcttgtgcttgcgctgaggatggacaagaacaatggacccggaaatgcacattttagggactgttgatgtccttggaggaggttgtgtttgcagattggaccaagttctcgggactccttctcttggaaccgtcagtggtttcactgtctgcctcatggaggattaatgagatcatgtccttaaagtggctcagtgaggagcactgtccattttagtgacatcatgccatgaatcataaatagcctgcgcagtgcagctggaaagggcgaggacgggacccacaaagtgagcagaatttccagagactgttcttggcttagggtacaggaggggctttccaaggatgccctgttcgtagtgaaacaggcttcattttgtcacggaaccgcaggctgagctgggcctggctgggcaggtgaaagcatagggaggctccctgtatgcagctgaacacgcggcagctctcagactctgctcttgtggctaccacctaatgggtaggtagtggagacctggctattttgggagctgtattgaaggctgtggcttcaggccatgtttcttcgctagggtggaggcactgcagagcagggtgagtaatgctgagtcagctgcacaccccatctcagcccagggcaggaggaagcagctcagagacttctgtggtagctagaagccggctgtgggtgggggctccttggcctgccctgggagggatcatttccactctgcagctgtgcattaaacccagcacagggtgctcagcagggtcaggggcaccagtttgttccaggggtgggctggagcctgtcttcttcaccaggctgctgtgcccctgtgtgcttgcttggggacttgtccagaacattctttctctttagttgtcctttctaacttcagaaaggacttcaccccactgccctggcccaggagtgttgggtacaaatgtctgcccagctagcccagctccagggtgggtaccaccatgtgtcttgaagtcttttgtggaacccacaaccatgggccctgcctgaggacctgggagaaatagaaagggctgtggcctggcacagagctaggtggctgtgcccccctcgggtgagtcatgcctctgggccctcccggaaacagggtgacagtgacccttgcgtgctgcaccctcagccacagggagggtgtgagaggcagcagtgaccatccacatgctcaggagacatgtgcggactcaactgcccacgcataggaaggacaggaagggtgctcagggaccccacacctgcccccaaataccttctgagttgcagatacactttggtgtgtatctgcacttaagccctccggaccccagaggaaagctgcggtcgtgctctccatgaccaaccccaagacaaagggagcgcgtgcaggctgggggaagtgagaggaggtgtgagtgctaacatgaggcccagccacagtcagctttgaggacatggtgggctgagcatcgctgggcttcctcccgtatgtgggctcttctgatgcggtcggaaagcctgggatgtggaagttctcaggaattaattgagccttttatagtaaaagattttaaaactatatgtgggcattttttattttagagggaattaagttccacttgctgtgaaatccacatagcagtggtcttttttccccagatctttcattctgcagcacatgacggctgagtctgggctgcctttgcctccgcaccagcgctcaggccttggtggccttgcctgccgcccctcgcctcctgagaatgagcagctgtggtggcaactcgggcctgtcttcatctgcgccttctgcacccactccctgcagaggccccctgtggccgggaccaggaagctgccctgagcttgggggtgcagcgctggggtggcaggtgcttccctagttacccaggtgggagagggactggcgtatgactgcggagggaccagctgggtcgtgttggagctgctgccttgaaaaggaacaaggcatgttctgaaggcgtttcagtacaagctgaagcagaactccatgatgctgtgcctgagctgaaatgcaagcagcattccctgtgtgcccctcgtcctgagggaccgtagcccagctttggtcttcatttgcctgaatgaggctccaggaagatgggagtggaggaacatttggcctggaataagcctgggtgccggctcattcctacccagtgacattgaagacgcggtaggtgacctgcggaagtaacttccggggttacaggagaacggttctgaaaggagaccctgggctccgtggtctcgggtctccagcactggcattttgcgaacccaggggtaggttcccctcagagggtctgaccgtggcctgaaaaagggagggtggcgagaccatctccttgccttcccccatctcacccatggggatgtcttcatgccaggcaggctcctgggataggtactcctggatgggtttaaaggccccactgagtttctctctgttgtctgccttcgccatgcgcattacttgggccaggttctttgcctctctggccatccgcttcctccggtcgggtgagcagttggtttggtggtctaggatgaccacacgccccctctggagtgtggctcacagctgtgtgcatgtcctaggtcccaggagttggtggtgcactggatagtttgtgtctaatgaaatggttacttagagcagcatgtcgtcctgggggctcagccttatgatgcagaactgagaactcactgccagatctaacaagctgtgattgtaggtggaaaaatgttcagcacggaagacttctggcttccctcactggggtgccactgctccctctgttccattgcctctgccctgcggggacctcatacctcacatagttctcccacttgaggctggagccaagcagggctggaaacctcagctgtggctgttaccggaagtgctgccttcctgatagataaggaaaatttgagctcaaaacaggcaaggtttctggtggtttttctttttcatatttcctcactcaagacagggcagagagcagatgtttcagcccttctggcatgtatggtggctgcctgggccatgcccctgtgatgggcatgcaggaccgcctcccttgtcttcagcacgcgccacccctcctgtcgactggccttgctcttcactgggctgatggctgactcctgaaaactgggggctgacagcagggagggtgacctggcccaggtcacatggccagtaggtgccccaaggacggttagttaggatgagcctcttgtcccttcatatggtccttgttctccagggaacatggtgactgagctgacccgtcccgggtgacgggagaggcagttgggtgggtagctccttcgtgcccctcagcccaactaagtggaccgggctgcagggctgccccagggcactttgcagggaagtttgctgcgggggatgggtgggctgaaggatggtccagagccagcctcgcaggtcacggtgtaaaggtgttttgggaacacccattgaccaagggtcgtggaggcccgtgctgggcttgtgtggggtgggactgggcacaggggaccgagagcctgtccccttctaccagctcgtaggcatgtgaacagcctaagggtgggcttgtggtcctcttgtgtacagggtcagctgaggctggggggaatggggtgggctcccagagggttcctgagctgactaggtaggtagtgagcgtgtgtgtgctggagacaggccagctggggcctgcagcgctctgtcgctctgtgatgttgacatgggtgtggtacttaattatgacctcagtgcttcaagcctcggtttcctcggtggtgagagggagcatattggtgggagggagtgaggactgtggggaggggggctcgttgatacaggtcagtcttggctatgtgttggctgcaagggaggacaggcaggagtgtggaccggacaccgtcagttgtccaccagggatgaggctggactgagactgctgcagccccgctggttggctggggtggggcagaggcagggggccggtgagggcagcctcaggaagctgctgcccctgaactccccgggaggttccccaatccctctccctctttgttcactggccgggcctccgtgtggaaagggctatttttagccctcgctttttttggttaatgggcttttcgcggcttctctctttgaaggggctatttcaggagcagacatcagtgtctgcatttggactccttggctcgaggtgcaggaaaaggtgatggggatgagctactcgaggggcatctgtgtccctggactgtgccgggcccctcccttgcccctgctgggttctggggccagggagggacacatgacagcaccctgccagagcctgtgggaggcgtcggcagaggtgaaccacagacttggatttggggtcctggggtttgcgcgagcaggaatgtcctcgcttctgggacctggaactggagtaggaatgtccatgttttgacctcagggagccactgaaatgggcacttgtgacaggttggaattgaacagtggctgattagtttcctccattttgtagcaagagccatcagcgtccactgtcccacccactcatctgggcttgggtgattcgggcatttggggtgagctcttttctcttagttcttaactcattcgtcagaaggacccaggggtcagccaggcccagccatctccctggcccactgcacttcaaggaagctcaggctggcttggaggagccagtgcgaagtcagcggcaaggcgaggctgtgctggccaaggaagcggagttcggcagcgagagaactcgatgtgctggtcagaggtctaggattcgagctgtggttatgtcatggtcaaggttgtgtggcctcatctggaaggagtagtggtgcatacacccctgtccaccccccgcccaacagggggtctagaagtgctttgcctcaggccctcccaccactgccttcactgcagccggctccttcctgcagctctctcgggaactgccctgtgaggccctttgacacagggaatgtggaccctatggactgacatggacaagggaccgtgggccatgttgacacagataggaggtggaccccatcggctaaccccgacgggaacaggccctcagtgcatgacggctccctcatggtgggtaacagcagaaggggggatgcaaatgggcctgcggagttagggatctgacctctgggatgactctgggctggagcacccccaggcttgctgagcagctgcccaaggcccaggagccagcgcagctgagacgagagctctggacaggaaactggagaccagattcgtgcaggtgatgtggctttgagttacccgctgctccaggcctggtgttctcctgtgaagaatttgcccgcaggctctccatggcccctcggggggtaaagcgtctctggagggccctggagccccatctggaaagttggttttcactctcagcagctgagtggatcgggccttctggggaaactgctttccccaacttcacatacctagaagtgctagaaaacttagaacacagaccatttaagcaaagaagaccagccttagaactagtgaaaaaggtacaaaaggaactaaagaagcaagatgcagaactgcgcttaaacacaaggaagggtgacctctagcaccatagccagagacgaccgtccagtcctgtgttccccgttccatctcctagtgagccctgggcccgcctgggtactgcacgccttgtagtttggcactgccttgcctggccaagccttgcagcacccaggtgcggggggcaggcaaagggctcgccagccccatcgctcatgagctgatcacagacctgagcccaagttcagactgagccagcctggtgcttccatccctgtcctcttgggcggtgaccacaacctacagaggacgagctcttcagtcatagaacggaatgcaagcaccatgacagcactccctgaaatgaggcagggaggacaatctgctcatccactgggatggaaacgtgactgtcgtcgccctcagtagctcccgaggagcactgggactccccttgtcagaatgtgtgatttctccggctttcatctaagttaaaacacgggtcaatgaggtgggagatcctggttcaggtgcagggccagggcctgctgggcctgtgtccagcctgaccccagccgtgagcaggtcttggcagcaccctgaggagggcttacctgaggcaagcaagtttgggttgttggctggaggaaatggtttaatctttgaagtgcaggaagcccagggttgcttttgtgccacaggtctggggtcgcatcactcttgggcctagagagatttctggggcggggagtggcctctctacgagaactgcctgccctggggacattgccagactgaacggtgtctgtatcttctgctgactctgacggactttgtggggacatcgatttccttgagtgtggcccttgggacccccaggcacctgattcctctttctgggcctatgtttcctcattggtgaaatgggcacagctcaccttggtgggttattacatgagtgtcagaggcagcattgatgacatgtgttagtgtgccgcagctgccataacaaagtttgttaagccacagattgggtgccttaaacaatggaaatttattctctggaagtcagaagtctgtagtcaaggtgtgggcagggacgcactccgagtccttccttgtctttcccagatactgacagccctgggggttactttttgtgagcagaactcccatctctgcctccagcttcaccccaactctgtatctgtgtccagatttccctcttaaaaggacaccaagtcctgctggatttacagcctgccctaatgacctcattttaactggactgcatctgcaaagaccctgtttctgaataaggtctcattgggtcccagggttgggacttcagcatgtcttttggagaggcacaattcaactgaaaacattacacaatcaaacacaggcaggtcccccacacaggtagctcatgctttaaaattaagtccgtgatttacttagagcgcggggcagcttatccgccttggggttgaattgcttttcctgaaggttagtgttcgtacctgctgagcagcgagcccttcctgtgccaagagagttgttagcactggatgtgcatttgccgggttagcgccgcctgcaggtgggcagcaagagggcagggcaggtgttggcagctttacaactgcttatttaaggatcagtctctgatacaaactcttgttgactgcggaaagaatgcattcatttccttattcgagtaacagagtcgcccctggaagtcatgtcatttccttttagtcgctcaggctcttgttcttgatgaaggtcataatcattaactttgtttaaaagttaattattggccaggcgcagtgacttactcctgtaatcccagcactttgggaggccaaagcggggaaacatgaggtcaggatactgagaccatcctggctaacaaagggaaaccccatctctactaaaaatacagaaattagccaggcgtggtggcgggcacctgtcgtcccagctactcgggaggctgaggcaggagaatggcgtgaacccgggaggcggagcttgtagtgagcagagattgtgccactgcactccagcctgggcaacagagccagacagggctggtgcctccaggaagaggcctcctggtctcagccatcgtgaagcttaaggattggggcttgagctctttcagagcccagagggaagagggcggctgctgggggcacctcactggggggggcataactggaggtggtctgccttcgctcgggctaatcagctttcccagcaggtagagcggtcagcatggcaggcaggctggagcagactcctgcccctccactaagggactgcccaggatgtttttttaagctctgaaattttccagtggactaacagttcacactgatgaacagctggagctgcaagctgtgtttcatagagagcattcttgaacctagagtcaggcctgcggcccctcatcaggcaggtaattgttttcctgcaggaccacagccgctttgtcaactgtgtgcgattctctcctgatgggaacagatttgccacagccagtgctgacggccaggtaagaactgggatgggttttggggtggggaatggcttgtctgcctgctcccgtgactgctcagagccgcaggctgcctaatgctagtcctgacatgcagaacttagacgtcgccctccccacatctgcagactcgtcgtcagagcccagtaaatgcatgtctgcttttaaaccacactgggagcttagtctgtgagccccggttttctacagccacagtccatggagaaactgcttactccagagggtgttcacacacacatgacccacatgtttttatttcttggaagatatacatctatgacgggaagactggggagaaggtgtgcgcgctgggcggaagcaaggcccacgacggtgggatttacgcagtgagtatgagcgtgtttcccggcctagtggtgggaatttggccgagtccacgtgtcagtccatccacactcactccggagttagacaaaaacttgaaatgaggggctataagtcggggcggttttatatctgcccagaaaagctttaaggtcgcaataaggtgatgggagaaggtagtggctggaacgggagacctggaggcgggtgttgtccttggcctcactcatgtcccaccctctctctgggctccttctgtcctactcaaacagtcgcagtggacaagctgctttttggggtctctctccagtctgtagtcctctggcacatgacacactgcttttttctgaatagattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaaggtaaggcctgccctggggaaggctctgcccgctgggtggacagggaagagaccagagtggccagcaaggaaggggaaccgaggggaagccaggtggaagctagagaggtgtcctcaggcctccttggcccttggggttttggtggaaggctgggatgctggttgctttcttgggacatgagtttagccatggtggcaggccaggtgccaggttccccttgagctactgtgagaactggagagtcagggcctagtgattcggggcagtggccatcacccccagctgttgagagcggttacttcctgcagggctctgccttccctgaattgggagtgcacagcctgtgctttacccgactgcaggcaagagcagaagctcactgagcaccagggcaggtgacggggcatcgctgaggtccaggggcaggagggaggagcgagagcaggtggccttgggcctgggccttggcgctgcctggagtttgaatgtggtgggcagggtgtgaaggagatactggagttccataagggagcgatgggagcaggaggaaacggagttagaatcatccatgggtcccaggtgtgaaggccccaaatgccaacctggggaggagcaaggtgcctgcttctgaaccctaacccggaagggttcacttgagccaaaggctccctgtgttccattggctgggggggtcctgccttctccctccacccacaccagccaagttgacgcctctgggaatctcgcagctggacaggagccagagcaggggtcccttctgtatcctcaggtcctcctctcacagcagcgccctcgcctgcttcccacactgcatctgctgggaactccaagtcaggttcccccagcgctggtggcccagggtgggtgacccctcctgctattctaagctgtaatatcaaggcaggtggacaatgcacttcatcccagcagcccttctcgggctcctgctttaagccactcggggagacaaaccctagcacttccctcacccattgcatcctgctgccgtggagctctgggggaccagcctctgcagagggtctgaaccctgcagggctagtgtgggccagcctggagcagcccccgggcctgtgcactcggcccgtgctgtgctgtcagtggctccttcacaccacggcttctaggaggggctgctagaatcaccaaatccattctacatgggagtttgcccacgaggaaggggcctcgttaacgttgtgtgtgtgactcctacggaccaggtcacctcaacgctcatgcatagagtcacggttcctttgtgccggggcagtgggggcagcagcactgctgagagggggaaggctgaaccataaaggttcactagacgtggcctcgaggatagaggggaatcgggagcgcctccttgctgggcttacagcccagggtgatgagtataaaaaggaaggcacgcacagcatggggccgaggaggttgttgcctgggggagctgagggctcttgtcgagaccatgctccagtgggcctccaagtgggatggtgagaaattgtacacgggtgagtaaggcttcgctactgcccagaaaaacagtttcccatgagccatccccgacagtgttctccaggtgtcagccctcaggtctgccatcccgtttctgttggcagggctgccctgagagtgctcttcctaataccactgctgccaactgtctggggccagtgcacccggcctgccaccgtggctaaacttatgtcccaaaaaagcaaccagcatcccacccttccaccaaaaccccaagggccagttgtcaaaacccccatgtcccaactctcaaatgccacacctgtgtgagtcacgcagatgctgatgttcggtgctgatctgggctgcagtgggatggagcagcaggtatcagcccaggctgcgtgttagaaccacctgggagctctaaaaagcgctggctgctgacgcccccagaggcactaagtttacagggaagtctcagggcagcaggagcttgcaggcctccagaaggaacacccgtgggcatctgggcatggctaggagtgtttctggtaagttcaaggcattgagcctgcacacaagtctcttggcctcttgccgagtgcacgttctgatttggcaggaaggtgggcctgagccctgctggtgggggctgtgctggtctgaggtccgcgctgtaagggactggtgggatgccacattggaaggaggccgcccagctcagtgtctcttactggggcatgtgatgatttttccccacgtctctgtggaaaagatgaaagtagctgcattcgttgcccattctccagtcccactggtaactgtgtacctgtctccaaggagacctgcatccaaagatctatgccatattgtggcaacatgtggcataccacagagatcaagaattcctgcggaaaagccctgagctcagaggagaggggccagccaggagctggcctccctttgcaggagaaaggcatgaggagcctgcaccctagctgttatttttgtctcaggctcagatatggagggggctaaacgccgccctctggaagcagctgtctggttgtggaccagccttgtgtgccctccactgcagcagtcagggaggttagggtaggagcgtcagcgttcacggacagccttgggcttttacagtgatcagagagacccctgccctcagcagggccagcactcctgggcagggagagagaagaaacctcacaaaccagggcctgaagcgaatgtggccagcgaagtcctcctggaccgacccccttgtggctccccgcgacgggtgctggtcggcggggtgcaggccacgtgtctgcacacgttaggtgctcaggtgctgacgtgctgggccttggttagacgcaggtctgggcccaggtctgggttaggtaccttggagggaggggaatgaagggcagggtctgtaggtgactgggtagctttggaaaggtttcttagggctcgtgggccgtgcattcgggcagctggggctactggggcctcagagcacctgcactgccatggattgaggggcgtctgccccctccattacccagaagcttcgttggtggaaagcgggtggcagagggcagggcagtgtgtcatcagcttacccgcccagtgtgtctccttcacagggtcacagtaaatcgatccagtgtctgacggtgcataaaaacggcggcaagtcctacatttactctgggagccacgacggacacattaatatcctttgactcaaagagctggctccggagccgctggctctaggggggagtttcctgttcccatgatgccagaggccaggccagccaggtggctccagctgcagccacagccacacgctcttctgacccgtgtggcttctaggggtggcctgtctgtacatggggacaggcaactgtcccctggagttgtccttggcaactccagggcttatgctgaggaaaagccatgggcggctccgacctgatcagtcccttcttgtcgtgcaaccctgagagtgtggcttaacggccctgagcttgggctgccactacctctgccaatggcacctggcgccagccttggccctactccacatggtgggtttcttgattcctagaattcacaagcacctggacacccttacgttgggtccccttgttttaaaaataggaaaaccagagcccagagagctgatgtgcccgccccagagtcatgcagcctgtggtccacagagccagggctggagctcctgcgaggtgccttgtggcccttcggtgatgttccctggaggtgtttgtgtcccccttataagtccttgtctgggtttctttaaatgagtcctggtttctccctgatgatgggggcttctgttgtgtttttcctgcatggcctggggctggtgacaccctgctcacgggtgtgtcttgaaccttggagccaccatctgcagagtgcctgggcagggatgcccacacacgttgctgatgatggcacctgctgtgcgttgttctgctgccctccctgagcaccgtgctgtgttggagactgccttttgtgtggacagctctggtccgcatgtgctgtacctcccaaagggactgtccgggacccaaggaggtccccccaggctgggagaggagggcagacatgccaccctctgcccccaaaacataaagaaatgtggggttagagggttgcgcctacccgataactagtagcagaggagacgccggagcctccccagcttgctggtccccagtaggccttcagcacggctccctttctgcctcatcccaatccctgtgtggtgcacccacacttcagataccccttcctaagaacgtgtcaacagtggacactgcaggcttcccagggggaatggttatgtccgtttgcggcgagattctcattcttgatgtaaatggagaatcttaggactgaagccacacctgagaacacccagcagtcctgggagccgggcttttccttaaccccaccctacattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacaggtgagagcactcgggtctgcgggggttccggatgagcctcagctcccctcggagggcttgtgccctccagcagttactgttctggaggacgcctcacttgctcctttcatctctcccaccccgtccccagcattgttctcctgttgttgggccctgagcccagcactgtgttacagatccaggtggtctgggtaatgctcttgcccacagacaacgaccaggtgtggactctgccctggaagcaggggcagcagatcacagccctgttctccaggaacctgctgcggtctctccctgtgtccctttcctcatcagtaaaggcgggtacagtggagcctgcctcaggctgttgtggattaggtgagcctggcacagggcaggtgctgagtacaagacagcattccccttctgctcaagggtgagatgggcacacagtgatctggttaaaagacaatgtcttgtttgtttttggtcttgggcctttgattggcagtcagtggagctaggagagtagcagtttgcaagtgatctgaagtcctaaatgcagttggagggacttgaaagagaaatgttccaggacctgacgaggccactgcacatccagtgtccccatgcccaggtctgacccctcctctggccctacatttcttgtgtagacccctttgtcacccggtagtcctgcctaagtcgtgttgcctgggagatggggactcctggggcctgttgatgggagcctggcacagggtgcagcacgcaactcctagcaggtgtgccgtccttgtaggtaacacaggccctgcctgcctggcagactgggcatctgtaggtaaattgggcctcccgatgagtggcagaagcggccccagagcccaggcatctgggccctggtcctctttctactgccctgtggtgaccccactcttaacacgtcccataaaagggtcttccctgggccagataacccaaggcaaggcccttacagagccagccttggcctggtgaccttgctgcagagcctttggggatgccacacttggccgagtgacacagaaatttccttgattatctcagttttcaagaagtttgtgtgtatgagtctttctagaacaagttttgatagcattggccaaggctaaaaataacatgattttcacccattaaaggtaacggattcttaaaagttacccatccattttggggagcagagctcaattctgtctgtgctcagtaaactccagtctttagccaacagacagggggacaaaagccacatctgggtgtaatgagggcttaccacagataaataggagcataatcaacgcctttcaccgcctcccgcccctccttccccccccccccacccctccccgggcccccattatgacttataatctctttgcaccagagtcatggatcgttttttcgctaccatcccatattttagcaagtctctccagtataggtggcaatagaattgccttctaaggagcaaaactgtggtttaacagtaaatatgtatgcatacctaccctgagctgctgcattgtcgaagtaatgtgcttcctttctctctaacagcggacaaggagttgtgaaactggacgttcagccaaagtgcgtagccgtcggccccgggggatacgccgtggtcgtgtgcattggacaggtagggacctggcttagtgtttgggtgggagcctgcagctgtgtggtgcctgcttgctgaatttgactcatgtcccgtttgacagttgctctagccagtgttttggttgagtgctcatttgcactgcactaagggatctcacatatttaatcctcaccaccatcacatcagttgtacagatgaagaaatggaggcacggaatggataaattggttgtccaaggccgcagctggtcggagggcagagctgggatttgtctctaagcctcagaccacgctgcctgcctgtcagcctgtaaagtctatgagataccctgtggggtgggcctgcctttgctcctgttcacatcccagccctgctgcattgtagctgtgtgacctccggcatttacctcaccctctctgagccttagtttcccatccccagcactcacagatccaggtgattatgaggaagtacatgtaagtctccttacaccatcttggttcctcttacagatgaggaggctgaggcctagagcagcttggtactttcccacatgcagaagggtggcacctgacttcccggcctggcttctaaccccagacagtggggccacctgcacacctttggaatatctggaccaaagccacctgagacccaagcctgacccactttatacagaattctgccctgcagaagatattatctgttggcgggcctaggcttgctggcatgtagaccggggaagtcaaggggcacctgttggcacgagtggcgagccctgctaaagaaagctgctttcagcaccctctggccctcctttgccttgtgaacttaattgcgttagggacagtggatttctctgtgtcctagataataagaaatccctgccaagtaattattgcaaacagcctggacagccagtgggggtggggaggtgcaaagggaatccacacatggagcgcctcggggcctgggggaaacgctacaaagcggagttctagaaggctggcaggtggcctatctctgcacagcagggctcttcccagccaaggggtctgcacatggggctttgtgggtgaggggatgaggcctagggcagcgtgccctgtgtctccagacccaggtttcctcatctgtaaagttgtggtcatcataggccaccctttcccctgaggctgagaggatgttcagactggcccagctggcgcctgctgcccaggaggttagaaaggaccccggtaaggttgtggtgtgcaggggacaggctccaggtctctgcacctcctcatgtggcatttctctgtgatctgctgttacctgatcctcccagggcatctggaacccctgctctgggtcagaattttctgcagagctccctgtcaccagtcaaagggttaggagggtgctaggaggggcctgggattttagatcaggaaacaaccaggttcaagtctcatgtcggacgaagcttcaggcaaatgcttaggccctcattcttcacctgtgagtaggtaaggccacctccagagccgggcagatgacagaggtgcctcttcagtagtaggttttagtcagggtgctgctaccattcatcgcgatccacccacaatccacgcagaaacagaagcccagacggtaggggcagaggctgccttccctcatgacagctggtggcttgggtaggggcacactgggataaaggcaaaactcagagatgaaggccactgtctgggagcagttgagtaagttagaaccggaagaattgacaaggaagggagatggaaggaaggcccctgctgcagagcctctgctgcatgtaccagaggcaaaggcccagtgcgggtgccgaggcttggattctgggcgagtcccggctcagcctgtgggaactggagccttgggcgtgcagcataagcaccgtaccccattttcttctctgaaacggggaacccgatccctgccttgtggggctggaacactcacagcagagcgctggcacgtgcccaggggctgtcgctgtttttgtttactgttgttagtacctttcttaccctgaacgttgattcccatcgaggccaagtgactttccaagaggtggtgctgtggtgactgccttggaagtaatgtagtgatgacagtaatggtcacagttagttgtgtttcctgccccacctgactggctagagcaactgtcaaacgggacatgagtccaggtggtgtggctcagagccccaggtggccctgcaaagaggttgggtatggagccaaacccagctccagtgagccccgacagggacgcgcccctcctaccactgagggttttgtcccgaagggctggaccgcctgaccagctgcctgtgtgtgccacagattgtcctgctgaaggatcagaggaagtgcttcagcatcgacaaccccggctacgagcccgaagttgtggcagtgcaccccggcggggacacggtggcaattgggggtgtggtaagtcgctttcctctcccccgtgctctctgtccttggtatctgggtgattgggggacagtgtgagctgtgtgagtaccggggctgtctcagggaaggcgaggggtcaggggaaggatgggggcagtcggggcgtgggacctgctctggggcccagccacgccatctcctgccacccagggctggagccttcccctcccctcctcggcacttcccccacctcactgcccgggtgcccacaagactgtggacagtgaggtagagggagtgccgaggagggcacagctgtgcctcagagccagccccatgagtggcggcaggaggggagcgcaagagggtagcaggtcaggaaatcaaggaatggcatcccctggggctgggctcggctcacaggttgaaggaagagtgacagaagtttcccagcatcttcaaggtgcggtactaaccagacattttacagtttcccttgagttctgcctcggcataattctcatgcccttgaatttgtgtgtgtggtctggtcacagtgtgcctggccaagtcctgagtgctctgtagaagagctcatttcccctctccagcccaggagggcagccctctgataacccagtcctgcagcaggcgtggcagtgccctccatgctaggggctgggtgggtctatgtgctgccaggtccttcaggtgccggatgtgaccagggcatggagtggcttcctccaccagccagcttgagggcctcatgagaccagcggtgccccgaggtaccaacagctgttttcatagagctgcgtaggtttcaggcccatccacgggaagagccatgcccagctcctggcatgggcccagcagagcagcagtcagtgggaacggcacagtttcttaagccctcgacccccccttcacaaaggatgggtgtggtgtgtgtgttcaggggtggctcacttcctctctgtccctgccgtaggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggtgagtggcggcgggctcctcctctgtccccgtgctgggcggtgcaggtggcagtgggaggttatctgtgacttggtgaccttgagctgagcctgtctgagctgtagttttcttgcctctacaagtagcaggtgcctcgtgccatgcttctgaggagtcagtgggtttgcaggggtcgctggcatagagttagcgcgtgagaaacctcggtccttattgtcgccatgagggataagcgaggtgatatgggcaactgcggcctgaacctgacctgccacctctcttgttttcaacctgcaactaggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaaggtgacttccgcccccaggccttggcagggaccacccatggttcggggctccatgggccacctcacaggctgtcccctggcttcagtccccagggctaagtagcctctgtgcttctagacaggtggcccggaagagttgtgggtctccttccatccagcaaacaccagctgcgctgctggccgtactgagggaccacgggggccccatgcacaggacacctgctgagctgagtgaaggcctcacttttgacatcttcacttcccccactcaccccttaaatcccacctgggaccagggtctccccctccctaagacagccacgtccagtgtataatgtgagcctcatgtggcgttgaaatttcctggtagccacatttaaaaaagaaacaggtgaaatgatttgtaacagtaggttttatttagccccgcatgtcatcatttctccctgagggggttgtgatgtccccgcgtggccatgcacgtattgtaaggcagctctgtgttgtccaaaccctcccctccccgagtgcccccctaccactctcctcctagtgtgtagtcaagtcccctcatccattctccttgaagacatccttttgtgttaaacattaatggggccctttcctatttaaaaatgtctgagcccacccccagagcccattccccagctgcaggcttcaggtgcaggacaggcaaagagggaaggcagcccggtctggaagggaggagagacaaagcaggtttcaacgtccgtcctggtttataaggcaatcgccagtctggtagtgagaatcaaacaagttcatgaatgaaatggatccagaaaaaaatacagcaagagctagtcagatagagattaggaggtcggggtctgtgtcttcactgtgaggtcacaggccaccaaacatgaagtgacctcagcatcgggttctcgtgcagatagttgagttctgcatctggaaaagagccagcctggtgatgtggacagagtgctaaagcctggcctcacagccaagtcatgcttggtggttgaaggcgctcctgggcacctgtgccacccgcaggccaaggcttccttcatcaggatgtatgccgtgccaggcaggggtgggggctgaatctcaccctgtctaggtggggctgcagatctagaggctgggggccacccggacctggggagcagagagctggtgggaacccccttgcctgcagctgggagcctccctgggcttcatgggcagagctagccacagaggagccataagcgcacaggcaccgtctcactattggcatctcggttgggtggaggcaagattatggggaatcgaatctgttcacccacggtgtgactgtcacagaggggaaagtcagtggcccccccagtcctgtgtgttccagcctcttactggttgtcatgcctgccccattttaatagggcatggatacagtgtagctgtttgtgtggtgtctgcatgtcatcgcttttatacataagaagacattgttatttcactcctgtggaacttggttgtcaagacttggagagagggagccactggcatctgtaggtggagccagggatgctgctaattaccctgcagcacacaaaaaagaggtacccggccccggggttcaggagtgtcacgtggagaattcagccacactgccaccgtgccaggctcctgagttacaacgattcgtggccattttcttggccctggagatgatttaggcacaggttgttccatcttcctagtccaagatgtacatagttgcagagaagtttggcttttcgttaaattgcaccctttcttcccagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatggctttagaggtcttaccagtctgcagcctcaggcaggaaatgtttggaacacaggattgtcagatccatcatgtggtggaagggaagccccagagaaggggctggaaccctcggttcctgctcccaaccataccgccagatcaccctctgacctgggtcacatccctgcccttctctgagcctaagtttctttgtcaactgaaaacactggaccagatgatgtctgcatcccatctacttctcaaattcttagcagcctgtatagctttcaggtaaggaatagcatgcatttagatgttaaaaatcaaattcccaaacatccaaattcattgcaaagtgaaaggcactgttctttgaaactgccttttgtacttttgtaacaattgtaaagttgtctaaatgtgcaatcccaattaaaaaaaaagtcttcgaagagtctaaggatactgcttcttagaaaagtcaggggataaaatgttagtctctaacatctgaagctggggctgcctcttaataattaaaagtccacaaatgactttgttcctatgtgtattttgggttaggaagaaggtacttttcacatcaatgggaatggtgaaccattcagtaaatggtgatgataaaactgggtgacaaaaatagtcttgcttaccttgtctttgcagcaaaaaccgtaagagggcaagaaaatactgaatttagtcacacaaacgctagtgtttctaagaatgacaaaaatggtagagaatagaagtgatatatttgactatgtatttttaaaatctgttgaagagggaaaaaccaccagtcccaaaatcaaaaaagacaaatggcacaaaaactttcaacatgtactagaccaaagggtgtgtttgtttaacacctgacataatttgtctttaatacaggttaaatttttttatctttagtacaggttaaatttttttcatggatattatgtccatacatgggaaagttttcaaaatatgtgattaaaaactaagttacagaataatgcagatagtgtggctccatttttgaaaaaaagccacagactcaaggtacaaacaaggccctgaggcttagaagatccatggcagaagggaggtacctcttgttccttcatgcaatgaaattaaaggcttaaaaaaatctctacccaggatctgcatcagtttcagggaggaagatctttatattcacaagtacactttaaaggagaaaactcaagccaccttttatccctggagagagaagaatgcaggcagcattttcaagctaatcgtttattggcaatctgtgatcacaaggttgagcaccaaatcggagtcattttgggagaggagagaagctggactccaggcatgacccagacggagctgatcctcacacctccgttgaaggcagaatatctttgtgcacatcagcttcattctgcagaccagctttggctacctggaacactgttcaggattccaagacctcgggctgcagtggaacaagacattgatctgagattaattagcaatgaccagcaaggatcaacacctgtggatggagaggggaggggagggtgcaggcatctcctgtcatgctcattggtcagcttagagacttgcagacctggcactcgccctagaggaagcagtgtagtgagaagaaagccagacttaagggatgttggcttctgtttccagctctgacacaccgaccttttggttagaagaagctcaactagaagacttagatcctaagagcttcttggggatgtagaacaaagtct

SEQ ID NO: 12954 - DNA, 46492 bp, Human; identical to SEQ ID NO: 12953
  misc_feature (1)...(46492): n = A,T,C or G

SEQ ID NO: 12955 - DNA, 23445 bp, Human
atagccaacaaatgggataaaatggaatcataataaatattctaattaatccaaaataaggcaggaaaagaggggaaaaagaacagattgaacaaatagcaggatttctatagaatttgaatggaaacccaaccatatcaataatcacaatgtaaattgtctaaacgtttcaactaaaaggcagagattgttagactgagtaaaaaaaagcaagacctaactatatgctgcctataagaaactaactatagctatgaaaacacatatagattaaatgtgaaaggttggggaaaaaatgtattatgcaacactgatcaacagaaattgggaatggattgttaatatcagacaaaataaattatagggcaaaaaatattaccaggaataaaaatggtcattttagaaagataaaggggtcaattaaaaaaaaggacataaccatcctaaacttgtatgtatctaataacagagttttgaaatatgtgggtcaaaactgatagaactgaaaggagaaatacacagttatatacaattatattcagagatttctctaccctcaataattgctagagcaaggagacagaaaatcaggaaggatacgaagacctgaacaacacaatcaaccaacttgatctaacagacttatagaacactccacccaacaatagcagaatacacattcttttcaagtgtgcccagaacattaaccaaggtagaccacatcccgtatcataaaatatctcaataaatctaaaaggattcaaatcatttaaagaatgttctctgaccacagtgggattaaatgagaaatcaataatagaaaaacatttggcaaatccccaaacatttggaagaaatcctggaaggagaagacaagagcagtgggcacaggaagaggggcagagtcagtgggaagtggtgacaactgggtacagaggtgaagaaaaggggcaaatctgagatgacattcatgtttctatgctcagaggcatccaagaagtgagtttaagggatgcatggagataatttttttttttttgagatagagtctcactctgtcacccaggctggagtgcagtggcgctatcttgggtcactgcaatctccgcctcccaggttcaagcaattctcctgcctcggcctcctaagtagctgggattacaggcgcctgccaacaggcccagctaatttttgtatttttagtagagacgaggtttctccatgttggccaggctggtctggaactcctgacctcaagtgatccacctgcctcggcctcccaaagtgctgggattacaggcgtgagccaccgtgcccagtgcatggagataaattttatcagtttttattatactgagttgctgtataacttaaaagtcagtttgatttttcactgtaatactgttcacatacagcctccagcagtgcacttaaataatatttaagatactgcagtatcttaaatgtggaactcagaaggctgtagtgaagagtcaaagcctctggatcccacgctgagtaaggtgaccaatcatggtttgcccatttgcctcctctgccagcatctgatgaagaagctgtgccctctgaatgactcccagtagtatcagattcatgtgtccactggaggagggacccagggagggcagaagtaccaggccatgggctgggtctgggttaatggggaaagctccctcattattggagatggggcagtagaagtggagagccaaattgggggaacactttctgtgggtactcggaaggttttcaacctaaagacatggtggagcaccttcaagaacaggttttggcgggactgacttctctccaagcccccatttcggggactgtctcatcccatcctgatgctgtggcttcctgtgtgttttgggctggcttccatcttgctcgtcgggaccctgccagctcctttgttttgtagttttctgctcgatgcctacagtgttttcagactccaccttggtcccttgtgtttcagcccgagaggaagtttggcgtggtggtggttggtgttggccgagccggctccgtgcggatgagggacttgcggaatccacacccttcctcagcgttcctgaacctgattggcttcgtgtcgaggtggctcacaatgtctttgtgcttcataattcatggaaagcccagtgaggcggattagctgcaggacatggagattttccagacccagggcagggagagccatctcccaactgagaactgtgcttagggtcagccccataagatctcaggttgggatgggtctgggaactgaagcttgctgggcctgcagctgggatgcacagtaggttggcctgggagactggaagacagaggcaggagggtgagctcaaggctgacagttagagaaggggcacagaaaacacatgcatggggctttggcctgaaaggctttcggtgtgcaccggggaatcctgacatagtcatcatgacagccatcctaggtggtcctgggctctacatgtgatatttccttctgcgtagtgttattaaccccccagtttacagataaggaggctgaaccacagaaaggttaagtaatctgcctgaggtcacacagctggaaagtctaagaactgaagttgagcagaagtctgtttccaaagcccatcttttaaacaccatgtgttcttttgccattggtaattttgagcctcacttttattattattattattttttttgagacagagtctcactctgtcacccaagctgcagcgcaatggtgcaatcacagcgcactgcagccttgaccgtctgggctcaagtgatcctcccgcctcacagctcaagtggtcctcctgcctcagccttctgagtagctgggactacagacacacacaccaccacgcctggataattttttttttttttttgtagagacagggtctccctatgttgcctagactggtctcaaactcctggggtcaagtgatcctcctgcctcggcctcccaaagtgctgagattataggcgtgagccagtgcacccagcctcccccttttctttaaggattcatttatctccagtcaaaatcaaacttatcaccttgtttcttcttcccccatgctcaaattttccactcacccctgtacacacacacacacacacgcaccactcaccagactaatcctgtataacatcatttgtcaatattaattgtgaactagatacaggcaccagactaatcctgtgtaacatcatttatccatattaattttggactaggtgcaggcactgggctgggcctgaagacatggtagtgagcaagttaggcaactctttttctagtgctttagagacatcagataaatatttacacaaagcataagtaacaattgtgatagtctatgtagaaattttttcatgttttcattcatggggccatcctcttccggcctgtctcaaaacatggccccacttttaaggatttaaaatgggcttggaagcaccagggagacccagaagtgctagaatctgcccttgggccagccttctcctccccataagattccaagggagctgcacacaaatgggagagcaaagttaagatcaggcagcaccgtaacccccatcgcacccctatctggagctgggaccacacacagcacttgggcgcaaggctgaaatgggacctttccttttcccttaagccccagtcctctgccagttggcttccagggtcagctcagtgggaacacctacactacccaggttgtatgggaggatggccaggtcacacccctgcatgacagccctgccagtactcacactgtttccctcttcacatacccttcccttcctgacctacctgctaagttctacctcctccccaggaagcttttctggtgtattcctttcccaccctgagtctccatctcctacttccaagcaccacatttctcctggtagtcttgtggtagtggtatgtacgtgtgtgtgtgtgtgtgtgtgtgtgtgtcttcctctagctgactgagctcattgaaaggcgatgattttaatttgttctccatgatttctcctacagcgcctagtacataataggcaaacaataagtattgctgaaattgagcaatttagtttgggtggccccattaaagaaacctagcataatactctttgggagctaaattttcctgaatgctttctgcctgctgcagctcagctggagctctgagcgggctgagggccttctgcttgctagctgtcccacattcccccatgactgccacccttagagggctactctcctgccccagccgctgcactgggaggtgtacggactgctggggctttggctcttcgaagactgcagctcccccatgctctagaagagtcagaaggccttgggttcccctcctgcttctgctcctggttagtcaaggctatcactgcctattatgtgctaggcattataggagaaatcatggagaacgaattcctcaccttccaatgagctcagtcggccagagggaggaagacacacacacacacacaaacacacacacagacacacacacacacaaacatgtgtgcgtacatactactgggcttcgttagcttagctataaagtagctcgaagtcgcatgccagtttgcaccctaaatgtgttaacgtattggatttggattaggtttggtagtcacaatgtttggccaagtgcttggaactggaagtgaccatagagatcacttctcatgagataaaagtagattgttccttttatttttatgttattttatttttgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggttttcaccatgttggccaggctggtcttgaactcctgacctcaagtgatccacccacctcggcctcccaaagtgctgggattataggcttgagccaccgcgcccagctgtttcttttgttttggagatgaagtaattcaagactctcccaggtcatacacgctgtgaatggtactgttggcactcaatgccagatcccctgacttgaactctgaggctatttttctcactccacaatggaaaatagcctggaagtgggagagaagaaactcatttcttcatttctggcagcagatcaccaggacctgtcgggaggaggggagaaggatggtgctcctttcttctgtctaccattgagttccatttctctgttactctgaaatagaagggagctcgggagcattgatggagtccagcagatttctttggaggatgctctttccagccaagaggtggaggtcgcctatatctgcagtgagagctccagccatgaggactacatcaggtgggttttccacacaggcagtccttgccttacacagcagtgcagtactgcaaaaatgagcaagcaagctaaaacaccctgcaaaggagtcagaagagccagtgagaaaattacaattgctctgtgaccaatcacagaagtgtcaaaacattaagaaattcttattgctggttataaatatataaggaagtgaaaaatagtaaaattaatatttagtatgtgtaatttgaaacattagaaacattcagaattaaagtgttttatttctctgtaaaaacccatcgagagtagttttcaacagtagtggcctccttcttctcaccagacagtttaggatgtggagccggcatccttggcaaattatcatactcccttctcagtttggatcagcttccaacgttttctcctttgtgctttcaatgtcataaaataacggttgagttcctttaaccctcaggacctggcagctaacagggaagtgccagctgccttcctcagtctagcttccttctaggttcttacagctgctcccaccatgctgtttcccacgggtaagatgcttcctctttatcagtctagctctagagtagacaaaaacacctctccttggctttccttaaccttttctggcaccagagtgtatttccttaagaaaagtgattctgacataagtcccatgcttataaatatttgtactctggtatccacagaatgaaatctgaactgctgagcacagaattgtaggtccttcacagtcaggcccccagctacttttccaacgttattatcctccacggcctgtagtccactcccctgccacactgaagtttgccgattgaacaaagccccacaaatgcccaagcccctgcatacgctgctcacagtgaaatatactcacatgttgcacctggaaaatgtctgctcatactttgagacccagttcataggtccttagtgaaatcttttcagactgcctcaggcaaagctagccgctgtgggttttgtagcctttatagctaccatgtggtgataggaaatttatttgttaatgtgtctttatttctcctccacagtaattggtaaatagtacttagttgaataaatgaatggttgaatgttcaaattaacacataaccagaaagttgatctgtcacaggatagtagaaaacaatgtgggatacagttcttcctccatatcccgtggcactgactcctacccccagtcatgacacattcacacacagaaactctcatgcctttataacattctgttctctattatgcagagcatttcagtgaagcttattcgaagtgttctttctctgtatttgtctcgtttaccaaaggcagttccttaatgctggcaagcacgtccttgtggaataccccatgacactgtcattggcggccgctcaggaactgtgggagctggctgagcagaaaggtaatgtatcttaccaagagtttctgcctccaggatttctgtgatatcatctttatgcctttaaaacttaaccccatttcagatatctcctcctcctggctacactggcactgtgggctcccaactgcctcctcacccccacactgtaaacacagatagtggagggcagaaggatgggtgggaatttgcaaacttttggtcaaagcttatcagcttattttactcactctaaggaaaaaatatgaattagttttcacctatgcttatgtcatgatattattttggctttattcatgtgatacttatattgctaaatgctgggatatcctaaaaatgctcaaatcagagaaactgattgtcttatttgcatagtttgtagtttttgttgtttctaaacaggaataaccatttattaaatatttagtatatgctaggaacttggaaactctgctaagcacttcatatgttattttgcttaattcttctagaatcccttggaggtatatattttctctagatgctgtatagaaaaatatggctcaaagaagttaatttgtgccaggtcacaaagctaataacatgactactaagtgggaggtagagattttaatcaaatcctacagggctcttaagttcacatttgttcccctaagccataccaccctccagaagggagaaattaagactttcccaggccagacgcagtggctcatgccctgtcagcccagcactttgggaggccaaggagctcgggacaaccctgggcaacataatgagaccctgtttctacaaaaatcttttacaacttttttttttttttttttggtggggtacagagtcttgctgtgtcacccaggctggagttcaatggcaccatctcagctcactgcaacctccgcctcctgggttcaagggattctccttcctcagcctcctgagtagctaggattacaggcgcccaccaccatgcccagctaatttttgtatttttagtagagatggggtttcacgatgttggacacaatggtctcaaactcctgacctcgcgatccacccacctcggcctcccaaagtgctgggattacaggcatgagtgaccgtgcccggcatacaaaatttttaattacaagaaaaaaaaaaaaagactcagctgggcacagtggctcacacctgtaatcccagcactttaggaggctctgatggatagattatttgagcccaggagtttgagaccagcctgggcaacatggtgaagccccatctctactgaaaatacaaaaattaactgggtgtggtggtgcataccggtagtcccagctacttggaagttcacctgaaccttaggaggttgaggctgcactgaaccatgatcgggccactgcactctagtctgggcaacagagtgagaccctgtctcaaaaataaaaataaaaattctttaaaagacctacccagacaaacaaaaaccaagtgagttgatcactactagacctgccctacaggaaatgctaaaggaagtctttcaagttaaagtgaaaacactagacagcaacacaaaaatattgctctctggtaaaggtaaatatatagacaaatacagacttccgtagtattgtaatgttgacatataaatcactttaggccaggcacggtggctcaagcctgtaatcccaggacttggggaggccgaggcaagcagatcatttgaggtcaggagttcaagaccatcctggccaacatggtgaaaccccatctctactaaaaataaaaaaattagctgggcgtggtggcgcttgcctgtagtcccagctactcaggaggctgaggcagcagaattgcttgaacctgggaggcggaggttgcagtgagctgagatggtgccactgcactccagcctgggtaacaccatgaaactctatctctaaataaataaatatcactttaaatcctggcatagaatttaaaagacaaaaaaatacaaactatgttaatggatgtatagtataaaaagatgtaattggtaacattaatagcaaaatggggggtcagagatataaaggagtagaattttgtatgtgattgagttaagttgttagcagtttaaaatagattatgcagtcgggtgtggtggctcatgcctgtcatcccagcactttgggaagccgaggctggtggatcacctgaagtcaggatttcaagaggagcctgggcaacatggtgaaactccgtctctactaataatacaaaaattagctgggcctggtggcacgtgcctgtaatcccagctactccagaggctaaggcacgagaatcgcttgaacccaggaggtggaggttgcagtgagccaagattgtggcattgcactttagcctgggcgacacagtgagactccatctcagaaattaaatacatacataaataaataataaaaatagattgtgcctgtaatcccagcactttgggaggctgaggcgggcgaatcacctgaggtcaggatttcaagaccagcctagccaacatggtgaaaccccatctctactaaaaatacaaaaattagccaggtgtggtggcgcgcacatatagtcccagctactggggaggctgaggcaggagaattgcttaaacccaggaggcagaggttgcagtgagggagatcgcaccactgcactccagcctgggcgatggagtgagactctgctcaaacaaaacaaaacaatacaaaactgacaagatgtaatgaaagcagtactaagagagaagtggatagttgtaaatgcttacattaaacaagaagaaagatctcaaatcaacatcctaactttacatttcaagggactaggaaaagaagagcaaactcaatcgaaaattagcagaaaaaagcaagtaaagattagaacataaataaaatagagagtagaaaagcaatagaaaaaaatcaacaaaaccaagtttttttgaaaaaaatccataaaattgacagaattttagcagattaagaaaaaaaagagtcggccgggtgcagtggctcacgcctgtaatcccagcattttgggaggccaaggaggacagatcacaaggtcaagagtccaagacctgcctggccaaaatagtgcaaccccatctctactaaaaatacaaaaattagccaggcatggtggcacatgcctatagtcccagctactcgggaggctgagacaggagaatcacttgaacccaggaggtggaggttgtgctgaggggaggttgtggtgagccgagattgcaccactgtactccatcctgggcaacagagcgagactctgtctcacaaaaaaaaaaaaaaaagaaaagaaaagaaaagaaaaaaagagtaaagactcaaactaaagtcagaagtgaaagaggagacattacaacaaatgctgctgaaataaaaaggattatatgagactacaatgaacacttatacaattgttatactccaacaatcggataatctagaaagggataaatacctagtagcatataacctactaagactgaatcatgaagaaacaaaaatctgaacagatttataactagtaaggagattgaaccagtaattaaacacctcccaataaagaaaagcctaaaaccagatggcttcactggagaattctaccaagtgtttcagtctcttcaaaaagtggtcccaggaaaacaggatatccacatgcaaaagaatgaagttggacacttaccttacaccatataaaaaattcactcaaatggattaaagaactaaatttaagacctaaaactgtaatattgttagaagaaaacatgggaaagcatcaagatattggatttggcaataatgtcttacatacgacatcaaaaacacaggcaaaaaaagcaaaaaacagacaaatggactaatcaaacttaaaaccttctgtgcctcaaaggaagcaatcaactgagtgaaaaagcagtctatgtaatgggtgaagatatctgcaaatcttatctttgataagagatcaatatccagaatgtctaaagaactctacaactcaacaacaaacaaaccaaataaactgattttaaaatgggcaaaggacttggatagacatttttctgaagaagttattcagacggcaaacaatcatatgaaaagatgctcaataccactaatccttatagaaaatgcaaatcaaatccacagccaccgtcagtaaccaccagcatcagtcagcagccatcaacatggaagcaagaccttccttcagcaaaaagatggaggatcagatggtagcattttttgtttgtttttgttttttggttttttaagacagtctcgccctgttacctaggcttgaacgcagtggcgcaaacctccgcctcctgggttcaagtgattcttgtgcctcagccacctgagtaactgggattataggtgcacaccaccacacacagctaatttttgtatttttagcagagatggggtttcgccatgttggccaggctggtcttgaactcctggcctcaagtgatccgcctgcctgagcctcccaaagtgctggaattacaggcatgggccaacatgcccagctcaataacgtatttttaaattaaggtacgtacgttgttttcctaaacatagtgttatcacatacttaacaaactacaatatagtataaacataacttgtgtatgaaccgggaaactaaaatattcatgtgactccctttattgcaatattcactttattgtggtggtctggaatgaaacctgcaggatctctgaggtatgcatgtaaccgcatacaaccatcaaaatctggaaattggcattggtacattacaacaatctaatcctcaaacctcattcaaatttcaccagttgtcccaataacattctttatggcaaaatgactgagttcaaaatcatgtattatcttttattgacatgtcacttttagtgtccttcattctggacagttcctccatcttttcttgacaattatgaatattacagttagttattgtgtaaaatgtccctaaatttgaatatatctgatgtttcttcatgattagatttggggtatgcatctttcacagaaatagtatgcaagtggccaggcatggtggctcacacctgtaatcctagcactttgggaggccaaggcaggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaaaggaaacgatgctgtttttcacattgtgttctgtcaggtaacatccaatatcagttcatctaattactaatgatatcacttcattaggtggtgtctgacgggcttttccactgaaagttactttttttccctttgtaatcagtgattattttgtgagaaggtagtttataactagttaaatatccattctcatcacactgtctgatattcatttattattttatatcagtagaaactcatagctttgttttgtttttctattcagtgctgttgttactttttattattcatattgatgtccacattgttccaaatttgctcagtggggaacctcttcctgccagctcccttgtcattttgttatgtttccattattctttgaattcttgctttctggcacaaagtggttaaggctcatcttgtactttctctgcctcagccttggaattagtcagttctccaatggctaataacgttttgatggcaagatttggacactgcttgtgcttatggctttgggctatctctgcaagccctttcagtgaacagacctgggaatatatggatacggatgtgtgtgtgtactgtggttaccatgtgtgtttatcacaatcaggcattgagtgaacgacaggaaaacaaccaaagacacagctggaaaatacatagtttctttaataaccatggatgtggaaacacagagactgttacatagtgctggggaaaatataacatgttccccagagtttcacggtggggtggggggcagtgggcgaaactacctgtgaggagaaaagcttgtacttattgcaaagcattttgtgccatttagttgttgcaaagccattttgtgccagaaagcttctacttatcacaagaagttccttttgccacattcacgtctgaaggagtgggtgggaaggaccccatcctcccacacacctgacatttctggagactcctgcgacagacatcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttatttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttatgctgcactgcctcctcctgtctagaacagtagctaactgtctcctggcccacagacacatccctgatctcatcttgcctttggacacaggtagataccatcttgttctcttagattttcatttcatttctcaggttttcgtttcattcatttctctttttttctttttctttttgaaacggagtctcactctgtcgcccaggctggagtgcagtgatgcaatcttggcccactgcaatttctgcctcccaggttctagtgattctcctgcctcagcctcccaagaaggtgggcttacaggtgcccaccaccacacctgggtaatttttgtatttttagtagaggtggggtttcaccatgttggccaggctggtctggaactcctgacctcaggtgatctgccagcctcggccttccaaagtgctgggattacaggcatgagccaccatgcctggccttcatttcattcatttctgttgtaagcttagaagtagcagcctcttcagctggggtgggtgacagtggtagggaggccatcctggccatgtgcccagggcagttatgagtgcttcatgtcttgtgttaggggatgacagagtaccctctgggatgcacacctagacacaactgacgactgccctttttattccatttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatattagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttttgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcattacagaaaggagaccctgacatggcctggcatttttgcacggtaaagccactgatacatagtggaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgaaatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaatacaggcttgcagggctaaaatactttgattcttctacttttaccagactactttaaatcactaaagaggatatatatatatgtatatgtaggtatgtgttgtgtgtgtgtgtgtgtgtgtatgtatatctacatatgtgtacatagatgtatatattagaagcctgaaacttttttattatcctgtttggctggattgactgctgtttccagtagaatgttttactaaaactcaatttaataaacaggaaaagacagagatgcttttatgatagagttgaagttcagccacctgagttttcatcagtatcattaatcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcattcatagcagattagtagtggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataccaggtcttttttaacaaaagcacattcataattttcctcccaaagcacctgggctctgtaaattatttagaacagtaagggttttagagtgtttctggatgcctttgcagagaggtgggtctcctggtagtaaaagaagcagacattgggtattttaaaaagaaaaaagaatttgagttcctgaatgaagcctgatctagtccattttgaggagtttcttcttcgctaggaaaaggcagagaggcctggcagatgaaagcaaagcacatggaacttggcagtgctccctatggagtgaccaacagtggtggcccgggctctggtgtggccatgtgagtgttaggattgcagccgtggtcagacctatacacagacagttgtagcaccctgtaattagaggtaaagatactgtagggtgctgtaggagcacagggaaggggaacctggactaggtcagctcatggttctgatgggaggcggtgccttgtttggtcttgaagttgagtagaagtcaatgaggaagcaagatgttggggaggcagaggctgactctctctctcttttttttttttttttatgagacaaagtcttgctctgtcacccaggctggagtgcggtggtgtgatctcagctcactgcaacctccatctcccgggttcaagtgattgtcctgcctcagcctcccgagtagctgggattataggcgcctgccaccacgcccggctcatttttgtattgttagtagagacaaggtttcaccatgttggtcaggatggtcttgaactcctgacctcaagtgatctgctcaccttggcctctcaaaatgctgagattacacgcatgagccactgcacccagccctgactctcatttttgcacaggagaggcaagcatcagatgagggattgggacagagagcagttaatataatataatagtaacttcttaaaatcatagtactttccgtgtcccaaattgcatttttaaatttttttatctatttatttatttattttgagaccgggttatgagactggctgattttcgtatttttgggtaagatgggtttttgctatactgtctaggccggtctcaaattcctgggctcaagcgatccacccacatcagcctccacgcctggccacaaactgcatttttatctcacaatgtcacagcaagataggtaaagctgtatacttattaccattacttatttttactagtgaggaaattgaggtacaagaaagatcttgacattctgcattccctcaaatcccaagattccatattatttaaaaggacatgagaggccgggcacaatggctcacgcctgtaatcccagcactttgggaggctaaggcagttggatcacctgaagttgagagttcaagaccagcttggccaacatggtgaaaccttgtctctactaaaaatacaaaaattagccaggcgtggtggcaggtgcctgtaatcccaggtactggggagcctgaggcaggagaatcgtttgaacctggaggcagaggttgcagtgagccgagattgcaccactgcactccagcctgggcaacaagagcaaacatctcaaaaaaaagacatgagaaattttcttaggcagactatgtagaatacctcaagtttatttttattcagtgccaaaataaaagttaatctttgttgccatctcccagaacatttgctagactgtactatgagcttttaaaactagtcatgggaggccaggtgcagtggctcacgcctgtaatcccagcagtttgggaggccaaggcaggtgggtctcttgaggtcaggaattcaagactagcctggctgacatggcaaaaccccatttctactaaaaatatttttttaaaaagtagccaggcatggtggcaggcgcctgtaatcccagctacttgggaggctgaggcaggaaaattgcttgaacccagaaggcagaggttgcagtgggtcgagattgcaccactgcactccagcctgggtgacagagcaaggctccatcccagaaaaaaaaaagtcactgaatgaattcccctgcctgatggcaaaattaaattaaagactgtttggctgtgaggttgacacagtcacccacagcctctgggaggctggtggctgcaaggaggatgggtgcctgacaaggacatgttaccaggcggtctggtgccagcaagcacccacttgtgctcttgtgtaatctctaacatgattcttttgtcttttgtctttgcagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaatcttattgttatgagctatgttgggatatttggggttaggggctatgcagtggggacaaggcgagaatgagcgttggttgagctgagctaaatgctttgtatgtctgatttcacttactcctcctaacagccctatgagatgagtactagcaggcctcttttttttttttttttttttttttgagagtctcactgtgtcacccaggatggagtgtagtggcaccatctcggttcactgcagcttccacctcctgggttcaatcagttatcctgcctcagtctcccaaggagctgaggattacaggcgcgtgcctaatcctggctaatttttgtagttttagtagagatgaggtttcgccacgttagccagcctggtctcgctcgaactcccaacctcaggtaatccacctgcctcggcctcccaaagtgctgggattagaggcatgagccaccatgcctggcaccaggtctcttttcattgtatactagaaaatgttgtttgaacagaaccctccgagatgatagagtcaccgcccttctgctctcgtgttctcagctgccctatctaccctgcaggttgctgctgctgctggagcccacgcaggtcatgtgccactgtggcatttcctaaacactcctgcctctgaaggtggcaccccatgccccagtcacaattctttcagagtgtcacagaaggaaagaatccacatgtattcctcagcagtctgtccctctgtccaatttgaagaaaaaaaaagcccttaatcccgctgtactaatgctcctaagtgttgaggggtccttcaggagggccttgtgtctccaggcaagagtgaccacagaggtgccctttgcccctcagcccctctccctgtggcagcagtgacctgcctgtctggtgaagctggaaaagggactaaacacatgacacccagccaccttctccctctgaaccgacatccttaggatgcacccaagcttgtccacgtggcaggtgactaaagcagactcttcctctgcaagtaggtgacctgcagctgtgatgaagaattgagttaccctaagacagggcagttaccctaagacagagcctaagacagttaccctaagacagagcctaagagttaccctaagagtttaagagcctaagacagagttaccctaaggtggagcctaagagttatcctaagacagagttaccctgcagggagccaaaggcccgcgggacgtgaccaactcagcattccgctggaggctatatgatcaaacagcgaactgtttatcatgaatgcaggatgtgggcaaactcacactgccttgccaccaaaatgtttgctgagggacatcatgccctggcgccgggctcctggaagttatctattgagaaatctagcgcctattgttcacaagcccgctgtgaaccaaacggctgactgacaattacccgacaaccatcctcccactttcttgctgtctctttcacctaataaatacagagggctgtgtaaagctcacggcccttgtccactagaggcaagatgccccttgacctcttcttccaaatatactcttttgtgtcttgtcttttattcccacattcgcccccctttgttcagtcccccgaggtccatgcaggttacaagtggcaccccaaacagcaacaggatcgggtgctctgcatagtggcatccgaacacaggacttcgaggacatgaatgaagaaagtccgctggagcagaggaactgaaattgacaaggcgaatggggaccccgaaacgagtctgccagcagcagagataaggtcagtgccctaaagaggtactgatcagtgccgtaaagaggtactgggagcagtgctttaaagaagtactaggaacaggaagttttctgaatcaggctaacaaggggaagaatttgtctattgaagaaaaacattatgtgcagttgcttaaagttctgtagagacagtctggagcttaggttaattcgcagacactaacc

SEQ ID NO: 12956 - DNA, 18122 bp, Human
  misc_feature (1)...(18122): n = A,T,C or G
ataaatggtaactactactttcagcagctaaaaaaaaagtctgtatggtctttggaaggctgagagtgtgtggtctacctgacatcaactacttgacttgagagtagagccacaggaattttaatctaattcaattctttgattttccagatggaaaaaatgaggtctaaaggggctagattcaggcgttcaaggctgcggtgagctattatcatgctagtgcactacagcctgggtgacagagcaagacattttctctaataaaaaaaaaataataataataataaagggactaaatgacttgcaaagccacccacagtgaattagagacagagacagagccaaagccaaacccacatgtagtgggtttccactacatgtcacagctataaggtagtgtttcaaacttttataaaagggtaacaagaacatagctgctgtactgaactttttcactccttttattaaggccaccagtgagctatgaatttgatataaggagcaatcacaccaacaatcaggctgtgaatatataatccatgagttaacaacgaaacagtcttaggaacgcaattctatcatagacacctgatgaatagatggagttcacctgagcagctgttatatgcacttcaatagagagactacaaagcctctctacttgtagaatacaagtacaaagaagatgctttaaaacattttccaaagcacacttaaaatgtgacaatagctgccggtcactaagaagctaaagggagataaattatcttggcatacagcaacagaatggtttattttaagcaaagactaaaaggagtctaataaaattattgggagaccaaggctaaaagccacagatgcaggaagagttgcagcaaccaatccaaaaaagtttagcctttcacaaagagtagaaaggccagctgtggactgtgtgtggacttttaggtccttttgcattgaagattagggtggcctccccctagcctcgaaataaaaaatcgtctctgaagcagagagacaacaaggcagggcatgaagaggaatccaatctatttcttgtaaattaaattcaactcaacaaatatttcctgaaaatctactatgtgcaagacattgtgaacgatgcttgccttacctcaaaggcttcaaaattttatgggaaaagggaagcgaacgggcttcccggaagtaaacaacccaagggcgaatagaaatgccctaaaagaggtgccggtcaggcttatcggttcaaaagcaagaaggctttgggactcaagagtttagtctcccaaagtgagagaagtggcgttcaagataattgctgaagaaaaggcagagatatggggatgaaagataggaaagtaggtgaactttaggaagagccaagaggggccaactctcggttccctcacaactgccagtttcctcccgcgctcagccgacgtcacgcgcacccgtgtccgcgggcaggcgccacggttccggaccagacctacccctcctctattctccccgccctttctcacctcggtccaaactcctcggtctgccctgtctgagaagaggagaagacaatgccgtcgggagtgagccccaaagcccgcaacctaacagtcccgtcaacccgggagccaccggcggcggccaggccgcatctccatggcaacgccgccaagcgccagttcgaacgcccgcgctgtggcccgcgcgtcgccagtcccgcaccgcccaccaatgggcatccaaggaatcggttgacgttcgttgacttctcctctggaagaccaatcagaggtctgaagaaaccgtgggcgtaactctcaatttccgaccttcagccaatcgttccgcttgagggaagatctcgcgacgtttcagtgtgagacgcgcacctttgaggcgggtcgaagatccttctgccgaattctattgatgggcccaagcgtaaccaggctcttctgattggccggtgtacttcagtttccgtccaaggtccgcctcctacctccttctgcttcgggtgagtacccttaagggcccacttgattttagttctcagtggaggaaatgagccttggagcgatgggaatctgcctctggcaaacctctggtcgctgcagggcccgagagggatgcgccctcctctaagttggcagtgaggtgtgggcaggccaggtcccatccgctctcaggacctcagttttcctgtctgcaccgggagaagggaggttccctgactctgagccttgcttgtccccgtcggagtggggatagggtgggtcgtccaaatcccagaggcgggagaggtccaggtttagggcccagaggcccaggcgccgaaccttcccctccctgggcctcagtttcacttgttgctacccattaaaccccgcctgctttccaaaagagattttatgttttctaattgcttcagttattgaatggataatatcgtggcagttatagcagaagtaaagaaagtcgaacaagagccccaccgccttaaacaaacaaacaaaaaagggacagcgtaaacaatgcaggccgggtgcggtggctcacgcctgtaatcccagcattttgggaggccaaggcgggcggatcacgaggtcaggagatcgagaccatcctggctaacacggtgaaaccccgtctctactaaacaaaatacaaaagttagccaggcgtcgtggcgggcacgtatagtccctgctactcgggaggctgaggcaggagaatggcatgaacccaggaggcggagcttgcagtgagcggaggtcgcgccactgcactccagcctgggcgacagagcgagactccgtctcaaaaacaaaacaaaacaaaaaaaaactgaatgcaatcaaattgtcaaatgtaaaacgctattatagagttaaggttaagatcattgatgttaggagtcaggcagacctacatttgagtcacttacccagacatctctgagctatagttccctttctactcttctgaaaaatggcagtaatgcctcagcgggttgttgtgaagattaagtgaaataatgaaggtaaagcacttgacacaacgcctggcgagtagtaacttcttaaaaaatggtagcggccgggcgcggtggctcacgcctgtaatcctagccctttgggaggccgaggcgggcggatcacgaggtcaggagatcgagaccatcctggctgacacggtgaaaccccgtctctactaaaaacacaaaaaattagccgggcgtggtggcgggcgcctgtggtcccagctactcgggaggctgaggcaggagaatggcacgaacccgggaggcggagtttgcagagagcagagatcgcaccactgcactccagcctgggcgacagagggagactccgtctcaaaaaaaaaaaggtagctattattcttataataagaacaggcaaatacactagtcagtgcgttggtgtactttttgtaactgagtacccaattttgcccaaaattagtcagttaagggaaaaaaggtaattcttactaataaggaaacaaatccattcttcaaaagataaattatttttctagtttctatattaaaaggaatttatgctgtgggaccttataaggaatatatatactgtggtgaacagtgttgagcagtttaacagacaagatgaaaagtcatttctttaaaacagagaagctttttgatgatcttttatgacacacgggtaacagtaactcatatatttagtacctctgataatgtcagaccctctatatatgtcatttataaactccacaacaaccatgcaaagtaggtgttaacttcattttacaaatgaggaagttaagtatcttgctctaagtatcttgctctattaacttcaatagctaggcctttctgactgcatagacagccatgcttttctgtgtttctgactaaaggaggatgaaaatgcttggaataccagacagatgcaggggcaggttggacagcttgacttacctaaattggagggaatgtgagctgcagaggtacctatggtaggagcaatatcttgctctaatagaaaattttcaccgtggtcttggtagagaagggaggagaaaaaaattgttttaataaaaataattttaaaaaagtaaattcccaccttgggaaatgaagagataggatgagatgatcactgaactttagacccatctgttcatttatcttatggatagactatagcacttcaaattcaacttgtcccaaacaaatgcttcacttgcaccccctcctccacccaggcactcaaaccaaagcctttctctttcccttggcttatgaaacatctctctgtcccttagacaatgaaatatcactattgtccattttactttgaaatatctctcagattcatcccttcctttcctttctcacagcctctgccttgatctaactggaatcatttgttaactggtctgttgcaatagacttgtaactggttaatctctctgcctccaatctgtcctaattcgttccccagcttgcttgcagctagaatatctttgtaaaatgtcagtctgaccaaattatacccttgcctaaaaccagtcagaggcttcattgcctacagaatataaactaagctgtttaccaatgagatgtcattttgtgcttgagggtgttgcccacactcctccctttgctggcagtgccttgcatccgcctcccttctgcctggtaaactagtgacccatcagaatccttatggggtaccttgttaacctaaagatgcttctttgctgcctttccatcttacgttgcacaaaacacactgtaacttgtctgttggaatgtcttccactttcactagcctgtaaatctctaggaagttggtgcttggtagtattcagcttcatatctatctgtcaatccttcacactgtctgtcgcatgggatacgcacaacagacaaattccccgagttagctttctagaattgtacagcagatggcactaataggctgcttaacaaatccccttcactaagaatgatttttgtcccaaccttgtctgactttggccttatcctagaagccaatatttatgccattacaggtaaaatctcctgtttcctccctcagccaatagcaaaaataacaaaatgactcagcagcttcgtctctgcaagaatggagtggcagatgtccagggaaaggtgcatttgagggaatattttctttgtctcaatttattcatggtagttggggcttttcttttgcatttctttcttttttcttctcttccatttgttattgttcttacaagaaagagctttactcatgggtgggtgcctcatttctgtccactccaaaagggaagaaagaaactggcaaattggaaaaaagatgatgatgatgtgggaggtgagggagtagtcacatagaattgcagtcacatagaattgcttgtgggcaggcaaacagttggctttcctcctcatctggaggagggtctgggcaaattttctggacactagtgccctaagttaagtggaacatgtggttttaggttcctacttcccagaaaagagcagaggaggcatagaaacccttttgagatgggtgctattaggagcctgaggctacattttacccctccttcagagtcttcttcggataccaggatttaacatctacggccctctccccccaactaaaacctttttggtggaaatgatcccagctagacatcttaacctccaaaggaatatagattaaagactgggaatttggggccaggcacagtagattgcacctgtaatcccagcactttgggaggccaaagtgggaaggtcacttaaggccaggagttcaagactagcttggtcagcatagcaagaccccatctctacaaaaaaagtgttttttaaatttagccagatgtgatggctcctgcttgtagtcctagctacccaggaggctaagacaggaaaattccttgagcccagaagggatgcagtgagctcttgaggctgcagtgagctgtgatcataccattgccctccagtctggatgacacagagagacattgtcaaaaaaaaaaaaaaaaaaaaaaaaaaaaggactgggaattttgaaactggaaatgattttataaatcttgtctgtcctctctcagggccatttgtgtcctaagccctactctttcatggtgaacagagctatgaaagggacaaaaattatagactttggagttagacttacttggattgaaatcccatcctttacaggccagctatgcccttatgcaagtattttaaccttttgaaataatatcagtgtccttgtaaattagatataataatgcttctcttgaaaggttgttttgagctttagaaacaatagttgtcaaaagtcttgcacagtatagctggcacagtatatatagatgcttaattgacaacgcggcatgaaacactgtttctgctaaagggatattagaatatggagaacaggtcagagggaaaatttggagagctcttcctgtacctaaagttacatttctgagggctttttacagttactctgattaatttgatgaaaatattgaaacaaacagcatagccatgtatttgtaaattctttttttggtacctaggtcccgaacctcctaggctctgagggaattgtatttatggagaaagccgagaatatttttccttagcttctagaaccttctaatgacattgaaggtttttttgttcaggttttttctaaccacctcaggcactctgccacttttttgaagtgtgaattgcctgctgtcagcctggagttctcacctccgcaatcctggctgcaggcatatttgcatattggatgctgtgttccttaaccccctgaggtttgaatccacttggagtctgtgtgtgaaagctggctactttcaaacccatgaacagtttcagctttgtggtctccagaaaaacagaaaacccccaacaatagttccattcacttttatgtaaatggcactcttcaggaaaacactgggctatttcccagggccccagaacatactcaaacatttgtttgagtgggaggtggggagagagttcttttgagtcaatgaacatctgttcagaactgctgtgctgggtcccaagaaaacagagcttataatctgtctcttccctgccagaggtaccagcagagatttactatactaggtatatgtgcttgtggtggcattgtactgtgtcagtttagctaagctggattcccagtatccttcctatctgcttccaggtgagggttgtccacaagaaaatttcgtgagagatttggaaagctgaattgaagtagcagccagtacactgtgaaggacagagcagggtctgtacgctgtgaaggacagagcagggtaccaggcatagtggcagtacctgtactttctctctgatctggctcaccttgttggtgaaggtcatcacacagcccccagcacccctagctcctactgaatttcctccttcagctcctctgagtcctgggccatgtgtgcagtcagctctgtagcagagggctccggcttctccagatcacctgagtcactgagcttgggaccagtgaaaggaagttgtgggtttcagtttgtcctcatgagttccagttgtccttgtagatcccagtttgttctcagaggttccagtttgtctttgttctcttccacctcacatccagttttcttcccaactgctggcctcacagacttcgggcccaacaccaggtgcagaggcagcagagttgcatggatttatccaccaacttccaaagatacacagtgtctactccttataataaatctttagttttctgtcactcatagcgtttgcttccctgattgaactttaaatttgttcaagccgtgttaaggatgcagagcatggaagtgattagaagccagaaagcttcacagaggaggtgacatctgagctgcttctgacgagtaggaggttgtgtgtatagagtgggtaggaggaattctagagaatagctggctcaagccaagcaattgaaagagcagtgaggagttctgtatttctagaagaactgttctttccatgggtccagaatatagatggagaatgagcatctgatcctagctcttctggcgccattgagattaactgttagctgatgtggttcttagatgtggtcatccctaatacactggcatccactgaaatacattcttgctagggtacacccttgtcactaccctaagattcctcccccaccccaccgctgctttcctctccccagtggttccatgtggctaacccaggcttgtctttcttggctccccatgcaggcatctttgcttgtccatgttgtgttgatggtggcagtggtatggagttcctgtcttaggcagggcactgtgccctctagtcttggatccctaagcttatttaggggttctaacattgattccatgggaccttctagtcttggatccctaagcttatttaggggttctaacattcattccatgggaccctctagtcttggatccctaagcttatttaggggttctaacattccatgggacctgaggcaggagcaaggtaccccacatctataactttctaatgctttttgagcatctttatagggagggcatgggatcagctacctgtttctgcctcaaccacggaccaataatatgagatctttgttcaccagttctacagtgatggggtgcttccttttggcttctggaatggggtaagttcttgacataaatagggagtccaggaaaatagaacaatgaaatagaatagaaaaatgaaagcctaccactttatatatgaatttgtaaactcaaacagggatttcattatacatgctattcagaactgtctccttttcatgtgtctaaaaatttttcttacaagcagtacattaggcttgacctaatttttttttctttttcttttgtttttgagacaaggtctcactgtattgcccaggctggagtgcattggtgcaaacatggctcactgtagcctcaaccttccaggctcaagcaatcttcccacgttggcctcccaagtagctggaagtacaggtgcatgccaccatacctggctaattttttttctattttttgagagacaaggtctcactgtgttgtccggactggtctcaaactcctgggctcaggcaatcctcctgcctcagcctcccagaatgctgggattaaaggctcgagccactgaacccagcctcgacctcattttttttaatgacttcatgctatttcatcatatagatatactgtactttttgcctattcccatattgatggatatttgtttctggctcttttcctttttgatattgcaaacaaagttgtagtgaacattgttatatgtacatcttttttttttttttttttttgagacagagtttcgctcttgttgcccaggctggaattcagtggccccgtctcggctcaccacaacctccacctcccgggttcaagtgattcttctgcctcagcctcccaagtagctgggattacaggcgtgtgccatcacgcctggataatttttgtatttttagtagagacggggtttctccatgttagtcaggctggtcttgaactcctgacctcaggtgatctacccgccttggcctcccaaagtgctgggattacaggcatgagccactgtgcccggcccgttgtgtgtacatcttaaacctatatttcttatgtgagagtggctagaaatggaattgctggctcttagggaatgtgcattttatgttttgataattattatcaaatggccctcctaaggggatatgctaatttacttttctaccaacagtatatgagagcacagaccatttcagaaatcccctttgagattatttccagtccttaaaaacttttgttacaggtttagaaaagcttggaaaggtcttggtgttgggtgtttggtttttggtgagaaaccgctattctctagagtaacattaccatctgttggcagtcttgagaattgccctggagtaggtttctgtttgggcctgatttttatgcctttgatagctgcaaattcatcttgattgagcaccagcaaagggactgtggaggatagcagctcctgctccagctgccctctctgcatcagctgtgcaacccccgggcaccagcaatgtcaggcaatggtggcatgtgcctgtattgccagctgctcaggaggctaaggggggaggaccacttctttttttgagacagagtctcactctgtcgccaagctggagtgcagtggcccgatctcggctcaccacaaccgtaacctccgcctcccgggttcaagcgattctcctgcctcagcctcccgagtagctgggattacaggtgtgtgccaccacacccggctaatttttgtatttttagtagagacagggtttcaccatgttggccaggatggtctcaatctcttgacctcgtgatccacccagggagaggaccacttctgtttgggagtttgaggccagtctaggcaacatagtaagtccctgtttcttaaaaaaaaaaaaaaaaaaaaaaaaaaggataaaataaaagactaaaaaaaatcagactgggcatggtggctcatgtctataatcccaacacattgggaggctgaggtaggtggatcacttcagcccagaagttcaggatcagcctgggcaatatagtgagaccctgtctctaaaaaaaaaaaaaaaaaaaaaaaaaaaaaattggccaggcatggtggtggcatgcctgtagtcccagctacttgagaggttgaggtgggaggtttgcttgagcctgggaggtcaaggctgcagtgagccatgatcacaccattgcactccagcctggtcaacagtgctagaccctgtctcaaaaaaaaaaaaaaactcaacgaaatatttttttctatatgaagttactctctgtagatgacctctctgcattgtcagaaaccacactgctggggggttctgtgcttcaggggctcaggatatgggctgggggaaatggggttacaggtttgacgataaaacttgtactgcctctctcccattcccaacatctctcttgtttcagtgcgtttgcttctgaggatctccagtgtcacaacaaacacatgccagccctgttttacagggagccctggaggagttgggatagaggccacattgactgagggtagttgccagggtcctgcagttatacacaaaggtcagtctctgattcctggatgccttccattggtcctgggcatgctgcctttttctgtgggctatgagatcacagttagctagtctgcattactgtccatcaccagattgctaccccccagtatggagcttcctattttgtgtaacttcccaatattctgtatcttctttgttaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggtagaggccagaggggccagctcttgggaaactgccaaccactgctcagaaatctaccctgccaggccctccccaaggcttaattcccagtgactgtgtagcaaaaaggggtagggaaggtaggagctcttgaccctttctacatacaaggtctccagaccaggccagagtagagctgagaattctgtgactgaattccagggtagaaacagcacctggtgtttttatgagtatcattcgccagctctccaacctctgtggtgaatggctgggtaagagaaaaaacagtgggcagggaattggggaccttgaggttgactgagctatgtgcccacctctcagctttgagtttttcatctgtcaaacaagggcttgactagaaaatcctgttttcagccaggcacagtggcacacgcctataatcccagcacttttggaggtcgaggtgggcagattgcttgagcccaggagctcgagaccagcctgggcaaaatggcaaaaccatgtctctacaaaaaatacaaaaattagccaggtgtggtggtgcacacctgtagtcccagctactcaggaggctgaggttagagaataacttgagctcgagagatcaaagctgcagtgagccgagattgtgccacagcactccagcctggacaacagagcctgtctcaaaaaaaagaaaatcctaagttttcttccagcctgtctctgatttcatttgatcaatttcctttgactcctagttcagtgtccctatcattaggtttttcttttctttttttttttgagacaaagtctcgctttgtcgcccaggctggagagcagtggggcaatctcagctcactgcaacctccatctcccaggttcaagcaattctcctgcttcagcctcctgagtagctgggattacaggcgcccaccaccacgcctggctaattttttgtatttttagtagagacggggtttcaccatgttggccaggctggtgtcaaactcctgacctcaggtgatctgcccgtctgagcctcccaaagtgctgggattacaggcgtgagccaccgcacccagccaggtttttcttttgaactaaacacagagagtatgagttctacagtgtttctgaacatagttgtattttgagttggagcatagagaagttgggctccctgatcatagattcatctgcagattgtggcaggagtggaggagtgaggagatgggcagggccttcttagaccaggaggggatgggcagggccttcttagactgtaaagattatggagaccttgagattgcagcttgaccagctagctacctgtgccttgagtctatcactcagcactgagggtggagtcggccaagtctccagagggaagaacagtgaagactactggcctgaggccttaggccaggccaagatctgtttgtaagctggccagttttcatccaccagcactcctgacctcacctctaagagtaagaaagctgcagtcatttggtcctgaaagagaagccaggctgtgtggggagaaatgggaaaaaggagcccttcttggctgaggccattgggatggtttgagttgggagggacagactgtggctcaggtgcctgctggaatgaggaatagccctcagacagaaggaagcagggactttattttttaaattattttgttattattattactattttatagagacagggtcttactatattgcccaggctggtcttgaactcctgggctcaagtgatctgcccacttggtctcccaaagtgctgggattataggcatgagccaccacgcctggccagaagcggggactttaaaagggagtggggttagaagggatggacaaagatccaggattgaaggaaaacaaggaaatgggaacaggaaataaattttgcatgtttgagttgtactggggagaaacaaggtgaaaaaagaggcagaagcttcacaaatactatgaataggaatattcacacttgtctccggatcacatgagtcacactgccttgttcctctcactacctgatgtcagtggacctctcctaatcctttcctgcttcggcagaagctaccctgttaattaacactgatggacagaatactgaatagatgcccctgggaggggtgtgctcagggacttccatacacctctgaggggaggtaggacgtcctgagtcagtatcacccatcactactagcatccctcccaccttgctcccctgatgcattacctgtctgtctttgtgtacaccactataggaggtgcttgtgcagagaaaattccccagaagctataagctagaatggtttttaagtgctaagtttctgggggttttgtttgtttgtttgagacggagtctcgctctgttgcccaaactggagtacaatggcacaatcttggctcgctgcaacctccgcctcctgggctcaagtgattctcctgcctcagcctcccgagtagctgggattacagatgtccactgccacgcccagctcatttttgtatttttagtagagacagggtttcaccatgttggccaggctggtctcaaactcctgacctcagatgatccacccgcctcggcctcccagagtgttgggattacaggcatgagccaccgcccctggaccctggggagttttttgtgcagcagctggctctgggcattgtagacccctgggaaggatgagggcccccatctccaaaccaaggagagaacaactgagttcctgctcgccatgagcctgtgagcaggaggcctccctagaaacttactggagccaaggtgtagacagagtctgccagaccgttcccagtctttgccccctctggggaagctgaagatttgtgggaggggactagaggtaaagctgagagctgctccagtctgcagagcttcaagttctcctacagcagtttcttggcagctgtcttcttgggtttgggtgttgctaacacattttcttagaagtggttctcagctggcccttagtctaagttcccatcaagagtttccctatgaaactgaaatctggctttgcccagtaagaaagaggaaaacaatttggaaaaagccttgatagcttcatggaaacagctgctcattcagccgtgcagggttttgagcctgttggccctggaatgtcagggtccacctgcagacaatgttaagtcctcactggattgtaggcaaagtacttcctcgtcagctaacttccacttgttaagaaaggacttccccctccttggaaaaatcacttcaaggtctccaatagaaaagtgattccttagagcatgggatgaagaaagttccgaagaataagaaagcagacgtctgaagaaggtcatctcacaccataaaagagcagtattctaaacctgacttgctatacacatggtctgtttcactctctgcagagaagagggaatggaaaggtgggattgctcaaaccccgagaactagacactacctgccctgcacccccttcccaggcatgttaggatattgccaatctccaggcttcctttagcaacacctagaaaagtcactgaatggctgggtgtggtggctcatacctgtaatcccaacactttgggaggctgaggcaggaggatgacttgaggccaggagtttgagaccagcctgggaaatatagtgagaccccatctttaccaaataaataaataaataaataaatagctgggcatggtggcacatgcctgttgttctgaatactcaggaggctaaggtgggaggatcacttgagcccaggaattcaaggctgcggtgagctgattgcactactgcactctggcctgggcaacagagtgagtccctgtctcaaagcaaaacagaaaaaaaaaaaaatcttgtctggaaaatccagctttgggaactttggaagatttcctcctccttttcttcctcttttctcctaactaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttctaacctgttgtgtttatttcttggactcttggcattggtggagagaagaaagctgaagtgaatcagagttctgaccttaaccagagggaactctgtgtccatacagtatccccagagaacttaagagctagggatccaaatggaagagacccagcactggcaggatggctctctcgcctctggaatgccaagcacacccaccccacccccaccaggggccctgagactttgtgacccatagtcaggatttccaagtgagtgggactggagtgcaggaattgggtctgtcctactcactaatatatctttcaccagcagcaggcacatatgttgtaagtactcagtaaatattaccttaaatagggccaggcacggtggctcacacctgtaatcccagcacttgaggcctaggtgagcagatcacttgaggtcaagagtttgagaccagcatgggcaacatggtgaaaccctgtctctactaaaaatacaaaaattacctgggggtggtggcacacacctgtaattccagctactcgagaggctgaggcaagagaatcacttgaacctggaaaatgaaggttgccgtgagctgggatcgtgccactgcactccagcctgggcgacaaagcgagactgtctcaaaaaatgaaagtattaccttaaataattagagactggctaggcgtggtggctcatgcctataatctcagcagtttgagaggctgaggtgggtggataactgaggtcaggagtttaagaccattatggccaacatggtgaaaccccatctctactaaaaacacaaacattagctgggcatggtggtgcacacctgtaatcccagcttcttgggaggctgaggcagcagaattgcttgaacctgggaggtggaggttgtggtgagctgagatggtgccattgcactccagcctaggcaagagtgagactgtctcaaaaataaataaataggctgggcgcagtggctcacgcctgtaatcccagcactttgggaggccaaggcaggtggatcacctgaagtcaggacctcaagaccagcctggccaacatggtgaaaccccgtctctattaaaaatgcaaaaattagcaaaaatgcaaaaatggtggctcatgcctgtagtcccaactactcaggaggctgaggcagaagaatcacttgaacccgggaggcagaggtttcagtgagctgagatcacaccactgcactccagcctgggcaacagagcaagactccacttcaaataaataaataaatagagacagaaagaattttagactccccaagtcacaacagagagaggagggacaggcaaccctggacccccaggtcagtgacacgtgtactctgtcctctcagaccaggcctgcctcccagagtgataagccttgttaacatgactaaggtcactgggaatgaggcaagcccagacccaaaggaatctgctgggccacccagcagtcacatcattacacctgtgcattcctcacctgcagctgccttccccaccctcagcaaaacctcatcattaatgtttctcctcttcctatctacttttttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12957 - DNA, 35471 bp, Human
  misc_feature (1)...(35471): n = A,T,C or G
ctgccagggggcttcactcctggcccctgccgaggagtcttccatcaagtggatggaccccagcttgtttgtctttcctcacttaagggacatttttcccccattttttggcaagtttgatgcattgttttgaatttaatttatttggtttcttggagtaaaaagttagaccgttgatttgagaccttttttaaaaaaaagtttgagatatctacatgtgatgaaacccaccaattttgagtgtgtgattcagtgaattctagcgttttcacagcgttgcacaagcgtggacacatcctgcattcagaacactcctgtagccgtgacacagacccacaggccccctgtcacttctgcaggcttttctgcagggaacgctcactgctgtgcgtgtcccccgggcaccgtggctgtgtcccctctgggctctccatgctcctagcccgttgtcctgtggagctctatgtgggcgtagcctcatctgatcagctggtttgctcaggcagcacggggggctcaggagctgcatgcacaggtgtgactttgcacatgggtgcccaaacaggtgcgtcctcccaggtgtgcacccacagatgtgtcctcacgggcgtgtgcctgcaggtgcgtcctcatgggcgtgtgcctgcaggtgcgtcctcatgggagtgtcctcatgggtgtgtgcctgcaggtgcgtcctcaggggtgtgtcctcataggagtgtcctcatgggcgtgtgactgcaggtgcatcctcaggggtgtgtcctcacgggcatgagcctgcaggtgcgtcctcatgggtgtgtcctcacgggcacgagcctgcaggtgcgtcctcactggcgtgtcctcaggggcatgagcctgcaggtgtgtgccagcagcaggagggagatgctctccaggcccctccacagggtcctcgcggcacgggtttggcctccgtgtggacagatgggctgggcttctttggtgctggtcttgctgtattttgctgaatcccaggcctgtgcgggcctctgggctgattccagctgagacaggcctcctgctcagtcctccctgcggagctgatgcagggtgggctggcgagggtgctcgtggtgctggttcgtgaggacatggcctcagtgcctcccaagctgagcccctgcggtggccccaggaggcctggagcatcggggtgtcagcaccaccagcctggacttccctgggccttccagggtaagcctctgggctccggaaggttccgtggctctctgtctgtggagctggtgagaaggctggagggccagatggtttcatcgctgagggaagcgctgtactcacctgatggccgatcttggggcactcccagtgcctgctgcctgttgctgtccctgagctctggtgagctctggtattcctgtcattcctggagcaactctgtcctgtttttgagcctgcctgggcccaggaagccccaactgtgttctctgtgtagtcactgctgttggttttggagggaaagatgggggccgctgtgggcagggctggtggctggtggtggccacgtggctctgggggtgtagcatccaggctggctgctgccagtgggaaggtgtcctggggctcccggcagggtctgggcagtgctggagctgggctttgcctgggaagctgccgcctggcccccacagcttccccaagaagggcctgagcccttgggggcagctggcgtctgtgaggatccgggatgggggctgtctgctcctgctgggaacggcccctccagatgcatctccctgtccctgacccagcctgtcagtccattttggttgtagccacccctccctgatggtgtgggggcttcgcttcctctgtttattcctcgcctgagggagcagaggtgaggggatgacactgccccgcctgagccccgagtccctgggccacgggaggtgggactgggtctggcctttggtgccacaggtggcactctctctgttgctgtttgcagactacgtctactttgagaactcctccagcaacccatacctgatccggagaatcgaggagctcaacaaggtactggggggccctggtgttgctgcaggggggtagtgggtgggggctatgccagctcctgccctgtgggtggccagtgtgggtggccccctttcggggctgatcttggactggccactgcacaggcccttcagtgactccgtccactgtcacctgcaccgtggctcctccttggagatactgagtgaggggcctggtggcctcatgcaggacccagcgcagctgccctgagctgcctgcccactctacacttggtctgtgggtgctgggtcccctgaagatgccagtgtcccctggggagcccgagcggaatggtgtgattctgaaaccaaccaaaggctgcagaaagccatactcggtgcccctgccctgcccgaaccctggcagccagccctgcagggctgtgagctctgcccccacccctgaggtgtctgcgtggctggaagctccctccctggtcactcaggcagccctgaagggctgtgagctctgccctccacccctgaggtgtctgcatggctggaagcaccctccctggtcactcaggcagccctgcagggctgtgagctctgcccccaaccctgaggtgtctgcgtggctggaagcgccctccctggtcactcaggcagcccttgctcccacctggtttgtgtctgccatgagtccttggcagttgcttgctgtttggtcgggggacgtggttgtgcccatgcattgagcctggcagcaccagatccttcctggggggtggtgacacatgggcccctcagccccagccactcctggcctccactgcctcggcacagcctccgtcccatcagctcgggagacagagccgtagatggccatggaggtgtagggcgcccgcacaccctgggagccttctcgctgtcctcaggggtggtgggtgggtcccccagcgtcccttctcctcctcctggttggagactttctaagggtgttgagggagggcaggttgtccccaccagtggacacatggttccagcagagagtggggtggggtgctgggtgcttcacagacctctctgtgcctgcctgcagggctcctgagcccctgatcccctggagccagtggcccgatggctgccttctcctaggagccctgcccactcggcaggcctggggcactcgggcccttggtgttccatctggatgctgcaggctcacctgggagaagctgccttcctggacctcaggcttggtggcagcggtgacgtggggttcttgggatcagagggggcagcggggggaaggttagcgcgccacctctgacgtagccatgctgggctccgggcttccctggctgcgcttgtcgagggccattccctgcggtatctgccaccacctggggccgaggagcatggggtgcgacatctgctcccccgcagcttcctgggaggtctgagggccaggcctgtttgttggaggcacaggcaatgacctgggtgtcttctgagtctgcctcactgcccctgctgggcagggcctgcccgcctgcagagcaaggccacttgggtactgccggaatggggcgccactcctgtggctgagcctcctgagtgcggggcagcactttacgcatcccagcatgtggactgtagggaaacaggtgcagagggaggttcctcagctgacgctgaaccatggctgggggaggtcctgtgtccctcctggtctgtgtagtggaggggcggccggcagatggcactgctggccccacacagccagctggcaggcaacccggggcgggaggctgcagtgcctccgtgggcgcctggccgagtgccactgctgggaggtgccactgtcaggaaggttccctcgtgctgcttccggcttccatgtgcagacagtagattgcaggcgtgtgcaggcagggggctggcttccagcccttgggcgatgttcagttacacatgtagcattgcacacgctcagaggcgtccccttcgtcctaggactccctcctcctcagggccagggccacatggcgtgggcacttgcctgtctctgggcgggacaccagcctgtgaggggcacgactactctcttggactgttcaggcagggcagccgagccagacgctcaccatgtggaaaagaacccgcaggcctgcgacagagtgcggccagtgccctccacgccaaggagctccaggcggggcttccaggtgggcgcagctggttgagtacagacctcccctctgttccctggactgaacgccccctcaaataacaagaaagtggtgctggggctctgcacccacagggcaaggaaggtgggagaggcggtgccactgggaggtatgggcacagcttggaaggcagccaggcagactgggcaacctgagaggccctggccctggcctgggtcaggatggggagaacaggaaccatggtgacatgtggctggcagcgcggaaggcctgtctggggggtcaggtggtcccacagagcccttccctgggctggagcagtggactcagaggacccagatttggggcaccagacccaggccagcacagttcgtgcgggggctggaagtggggatcgcctggctcatggcctgtcccctggtgggcccccccgcccctcttgcctccttggctcccaggaccctagcggtcagacttctaaagcccacagacccagctgctggcatcggggacccagcagaatgcccgctaccccagcacccatgggtgcagcccatgcagcgagctgcccagcaccggggaggctcccagggatgaaaagccgcaaggcgtatggggcggggcgggggggcttttaacaggaaggtcagccagcacatgtaaaaattgaactcagaggctggacgcaggggctcacgcctggaatcccagcactttgagaggcccaggcaggcggatcacaagatcaggagatcgagaccatcctggctaatacggtgaaactccgtctctactaaaaatacaaaaaattagccgggcgtggtggcgggcgcctgtgatcccagctactcgggaggctgaggcaggagaatggcgtgaacccaggaggtggagcttgcagtgagccgagatcacgccactacactccagcctgggcgacagagcgagactctgtctcaaaaaaataaaaaagtaaaaaaggaactcagaggaagggccagtgcagggaacagaaggaaactaaagcaaaacaaagcccgtgaatgttctcagagaaatggatgggatccatcctgggatgtggtcagatgagaggaaagctcttgacacttgggttaggagaagtagcaaatgaaatgaaaggatcaggtgataaagttgaggataccgcacagaagatggggcaaaaacacaaagaaactaggagagaaaaaaatcagacatcagtccattggtccaacgtccagttaatagcagagaaggagcgagcaaagcaataaagaggggccccttcaaggtgtatttaaaattttagaacacgggagaagaaatgtgtttagagaaaaagtgggtcacacacgaagcaccggagtcaaaacccactttgcctttcggcagccgcgttcaggtgtggaggctccacacccagccaagctccatctcccggaaggcagatgagtgaggtttcctgactgaggccttggagtgcactcctccgcgcctttccaacacgagggaggcgcaggttcctcccgcccaggaagatgcggcccctggtgcaggcagcaagcagggtggaccccagctctgggaggggcctcgcaggcaccctgatatgagccctttctctttgggagctctgctgccgagcactttagggaagaatctgtgatgattccatgaaaaactaggcaagtggagaaaaaagacgattgttaacctcaggaagcaaaggtgttcgaaggaagagaagaaagaatggcctagtgtggcctcaccgcctttacctgtgtgtgcaggagcgtctcagaacagaccccgagtgtgactgagtccgctgtgtgcaggaacacaacacaacagaacagaccccgagtgtgactgagtccgctgtgtgcaggaacacagcagaacacaacagaccccgagtgtgactgagtccgctgtgtgcaggaacacaacacaacagaacagaccccgagtgtgactgagtccactgtgtgcaggaacacagcacaacagaacagaccccgagtgtgactgagtccgctgtgtgcaggaacacagcagaacagaccttgagcgtcatggaatgcacacagtgatcctggagggtggggtgcatgtgtggcaatgggaggcctggcctgaggcgctgagctggtgggaacctgaatgcggaagagcctggccccacggtcccagctgcccgggtggtgtggctgcggtcatgtgttcttgcagggttcatggctcgctgtgacattggatggtctgtgtgtgtcactgtgatcagatgtggatgtaaccccactgtggtggagcctgtcagggacacaggagccaacaaagcgagaacccggcggccagggtagggacagctcgacctgcaggagggtcaggccacgttggatcatgacttgaagcagagcatggtggtccctgggttcacaccaccatagtgagcagatacagatgcgaaggggagaggagatgcacgtcccaaacagaggaattccaccctcgagaacgcccggctcccggcaggctgtgcagagcaactgagcacttttctctttattctttcttttttgttgttgcttttttgaaacaaggtcttgctcttttgctcagaccagagtgcagtggcacgatctcaactcattgcagccttgacctcccaggcccaagtgatcctctcacctcagcctcccaagtagctgggactacaggcgcacaccactgcatctggttaatttttaaaacacattttatagagatgaggtttcaccatgttgcccaggctggtcttgaactcctgggagtgagccactgcccccaacccatttataccattaaaccaaattatctttaagaaaagtggccaggtgccttggcttactcctgtaatcctagcactctgggaggccaaggcgggcagattgcttgagtccaggagttcaagattagcctgagcaatgtggtgaaaccccgtctctacaaaaaatttaaaaattagccaggttggctgggcgcggtggctcatgcctgtaatcccagcactttgggaggccgaggcgggtgggtcacgaggtcaggagatagagaccatcctggccaacatggtaaaaccccgtctctactaaaaatacaaaaatgagccggtgtggtggtgggtgcctatagttccagctactcaggaggctgaggcaggagaatcgcttgaacccgggaggtggaggttgcagtgagctgagatcgcaccactgccctccagcctgggcgacagagtgagactccatctaaaaaggccgggtgcggtggctcacgcctgtaaccccagcactttgagagaccaagacgggcggatcacgaggtcaggagatcgaggccatcctggctaacacggtgaaacccagtctctactaaaaaatacaaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtatttggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcactccagcctgggcgacagagtgagaccccatcttaaaaaaaaaaaaaaaaagagttataaatagtattccattaggcacttgcactgtgattagaattacagcacaattcttgcagtagcaaagatgttataaaaactcgttcagaaaacatacgtgcttctctggtggcgttttacagccgtcttgacttggagacgtttgtcagccaggccaggtgggagggctggtcccatgcggggggtccaggctgcgtccgccgctagggccgtggctgctgtgcaggtcaccccagaggggctgggatagctgggcgtggcctcccaggagctgactgaggtcctacccagtgtggcgggggccttttcctccttgggaccctgctgttctcaggtggtacactgggggtctggaagggagggagaatggagacacaggttgaggttgggtgcacacgcccgccttctcccccgggatagacgccacgggcgtccagagctgcaggatttgctccatttgtgaagtgccctcctggagtcccgaggggtagtgtggttacacctgcagtccctggacggcagggtccggccttggagcccctcctgggagctgtgcagcccgggtttggtcgcgtttctcagacgcccctgccttgctgttacagacggccaatgggaacgtggaggccaaagtggtgtgcttctaccggaggcgggacatctccagcaccctcatcgccctggccgacaagcacgcaagtgagtccggccttccctggggtgcccgcctggcgggagggtcggctggggagggctggcggggtccttcttccctagggcccatcggcatcctggcctcgtggggccaccctctgcccaactcactctggcgtctctttttctcccttccacagtgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccaagtttagtaacctggctgggaggggctgctgtggccagcacagcgtgtgggaggaagccactggctgcatgggaatgccctcagccttggggacccagcttctcccccgggaacaggtgctcgcaggtggtggagtctcctgtgccgggggatgttgacttcagagccaggagccagaggcacccccacgccctccacatgctactgacacagggcctgccgagctgggccccacctgcaccagacacagtgtggtaccccactgaggcccttcatgtgtcggtgggggcaggcatgaggggcatttttggcttccactctgacacatcacctggggtgggatctgagcccaggctgaggctgtggtctgtagggtgacatttcccagtaggtgaggcatgtgactgcccgggtacccgtgtcgctggggtgggccaaggtcccacctgtaacctcccacgacccctaatggggtgaggtccagggactgtgggtttgcggtgggtcgggtgggaggaccctcgcatcttctgccccgtcccagcgctgtgggtgaggggcaggaagtcagcccaggcaacctccccctgctctgggaggggcttagggacaggacagaccatcctgccaccgatgccttgttcctgagcctttgctgggagtcggccagggcaggcgcttgtggaaggaaggtgtcccttaaccccactgccttgcccaccggacagctgggacctttcctcagcaaccagtggatgcggacgtgagctgccctgggtcagtgcagctgggccgggcccccgagcctgggtccactctggacactgggctgtggggcctgtggctggcccaaagggagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctggcctatgtcgactctgcagggctggcccgctggagaagcagtggtggggagtggcctggctcgctggagaagcagtggtggggagcgggctggcccgctggagaagcagtgcccaggctgagcggccgcagtgtggccctgccagtctgtgtggcctggggagtcaggcgccaccgttgagttgggcatgtttatggctggcccagggtggatcctgtctctgtcctctggcacctgggggcacagtgtccctgctccagagagcctgtatcagtggtttagtggtttttgagggtactgtggcccccttggctgaggttctgctctcagacgccccagaggatggccttttgctggaagagccccagaaggggactccagacataacgtgattagaggtatcagagggcaggttttccagaagggcctcgttggggctgataggactgggtggagagcagtgtcccagctcgagcactggcccccccaggtacacagcacagcccctttggacggtgctccctggaaagctgcgtggcggcccctctgcagggcgttcctatgaactgagagcccagctgcagggagcaggcgtcatgggtgatgggtctgccgctggtccagggactcagagcgcggccccactcttgcctggcggctgggccttgcggtgattctgcagggcccacaccccccggggttgtgtcaatctccgtttctcctgcttctctgtgagctcatggcagccagggtgaggcccccagctgatcccagggacaggtgtgaggacactctgggaggcctctggctctcccacgtcactgcctccacccagcccctgctggggcgtccagcccacagtgcaggcctcagggtggagggtagacacccgccaggctgcactgtggcccctgtggcagagaagccctccccccggcagggctgtgagcatgaagcctttctcaggacagaatgacagggagaggggaacgtccctcctcagaggagggcgtgggggccctggagaccacagccaagagtgggagtgagggcacagcctgggcctcacgcttaggggtgtatccagggtctgagggagggttcagagtgtgaggggtgcagggtacactagccagccccacctcctgcctgggtgtttctgcctgttgagggtcttctgaggagctgtaggcccacctcgcccgcatctccgacaggctgcaccacagagccctgttctgctgaccgggacgctggtgaaatgggagtttcggagccgctgtgggctcctgtccaggctgggtcagtgctcggatggggcctggcatagggcgggcgtgaacaaaagccagcctctggtctggggctggtgtgtgggcctctgggccctggtgatgtctgagttcagggtgcagtttgctcgtgggtccccagaagtgggagcgagtgagatgtgttggcctgggatgagaggactggggctgtcctggtcggccctgccctgttctatggaccgggaggaggtgaggctcagccgccagacaccccaggcttttgaggcccagatagggccggcccagaacacaggcccagcatggctgctcccagcctcagtcttagctgttggcgcctgggagggcccagaggagccaggacttcctgcaggcaccacaagggggccgcagagagcgagcagcccggctggctgtggtcccatctggggacctcgggctcagagagccggcagggcgctgagcgggatgagtggcccactggcggccggtgctgagcgtgcgaggggcggtggggagcaccactgcatgcccccattttgggtgttataagaaccctacttgggttcctagcacagggcaggaatccccatgctgctggccggtgcccggccccggtctcatctggacagcctgttctgggaagccccagtggagtgggggcaggggtggcctctggacaggggccctccacagccaggcttgtctgggctcttcccaaagaggcttggcactgggtggatgggcagccagagtggggggacgtcgaggcccagatgatcttcaaccgggtggtcttcacgccccaccgggaggcctgcggcccccgttctgccctgccccctggcggcacagccctcggtccgggccctgggcagggagcaggccgccaccctgtgctgaccgtgctgccgggtgctgtctgtctgttatatagccctgtcagtctgctataaggccggaccgggggcggacaacggcgaggaaggtaagagccggcctccgcaaggagggcgtcctcctgtctgtgtccctgggctgggggcggcagcgccgctgagggacagagtttgggcgggccgcctgcatgcctgtgccctgcgcccggccggcccggctgaggaggggccctcccttgtgtccggcccacggcccaggcttggtgcggccccggcctgagggtgacctgctggtgtgggaggtctgtggtgggctgtatggggctgtctggccacgagatggggacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaatccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcagggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttatctgggggtcacctgtgattatacggtgttaacctgccgtatagcatcccccaaggcgtgacaaccaaaaaatgtgtcccgacaatgccatacatccctggggagcagtgtcgcctgacggagagcggtggcactgaggctgctgtgagatccagcgaacgggagggttgggttttctgaggccacgtgggggcaaaagcgtctggagcgtgttggttccctggagtgcctgtcacagttgcggggcacacctgccaaggggcaggcgcatctccaggcctagggcttggcctcccacgggctctgctgccacctggctggagtcttgtgacctgaacacccccagcgtgtccagtcagctcagatgcaggttgctggatgcggcccccaccctgcccatcccaggggggctcatctctgtcgtggccatcggcgctctggcatgggctctgaaggatccaggatggccacggtgtgtcccaagctcagccctgcactacctctgtggccccggtccccattcccaccacacagcctggaaacaggcgtgaagggcgacagtggctcagctagggctgtggtcgtgccttagctcagagtcatgagcaggcagagaagagcaggcagggcttggcctggggtcgtaacacatgcgtggagcatgggcagggctcgaaccctctcaggctgccagaccagcttcccagaaggctgagccacaacatgctgggcgggagcagaggctgtgggggtcgctgtgaaggcttccactcaggaatgaggagtgcccttattgacagagccacacagagagggtgagactgcagaaatgtatctgtgggcacagaaaatgtttgttagcaaaaaaggcccgtgaggaagcagcaggtgcagtgacaagcctgtctgcactgtgtccgcccagaaacggccgggtccatgcttgccggggacaaaacaggctgctcaggcaccctgaaaccctcctgctgcacgatgcagcccttcccccctttttctttttcttttttttttttttttttttttgagacagagtttcgctcttgttgcccaggctggagtacagtggcgcgatctcagctcactgcaacctccgcctcctgggttcaagcgattctcctgtctcagcctcccgagtagctgggattacagacgtgtgtcaccatgtccggctaattttttgtatttttagtagaaatggggtttcaccatgttagccgggctggtctcaaactcctgacctcaggtgatcatcccgcctctgcctcccgaactgttgggattacaggcatgagccactgcgcccagccacttccctcttctttcttacctggggtttctgaacagccccaatatgggaatttaatgtaacaggctcagggtgagtacacttagcacctggcagaagcttgtgccactggcccctgggcgatcgtgcccctgcctcgcctcaaataaccctcactgatgaagtcctgataaacacaggctcatgtcacagataagcaagagtgcagaaacagcacacagcagtcacagacacacccaggccctgaccagtggcgcagtccggcaccaaatagaaaccacttgtgtttattaatttaaagaaacaggccgggtacagtggctcatgcctgtaatcccagcactttgggaggccaaggccgggggaatcacttgagctcaggagttcaagagcagcctgggcatcatagtgagacctcacctctacaaaagtaaaaaacattagccaggcgtggtggtgcacacttactgttgtcccagctactcaggaggctgaggtgggaggattgcttgagtcaagaggcggaggcttcactgaagcaagatcgcaccactgtactctatcttgggtgatagagcaagaccctatctccaaaaaaaataaaagatccaggcagagtaggagctgaggctgaggctggcagctggcctctggatagtcgtgtcagttcaagaggacgaaggccctgaagcatggctcgtggtcacacatggagcaggtgtcatgctggactttaaaggtagctcttgaaagaaaacacgcagagtagctttcagaataggagagacagggaaagcgggtaagggctggaaaagacgacccacaggaatcaggaggatgacctggaaacgggagggtgattggacgccaggcacacatgcagaagaaagtgcagccctggctgaggccaggtgctcaggctgggactccagggtcaggcccggacaggcctgcttcaaaaatcatcagaaccagcccagtgcaggacacacaatgctggacagcaaaaggttggcaaaggccatgtcctggaaatgccatcccagaggcagcctgggggccctggtgtgaggttgcctgagatggaatgctggcgggaagggccgcgcctgctgcgcgggtggcggccggcggtgctgagcctggaatgctccgtagcgctccagcggtggccgctcctccaaggttgtgcccagaactcctgatttctgttgctcttaaacaccttggataagttacatcttcacattgctgctgctgatagggatggctttgtagccgggcatagcacacgcctgtagtctcaactacttggaggctgaggtgggaggatcacttgaacccaggaggcggaggccacagtgagctgtgattgcactgctgcactccagcctgggcgacggagcgagaccatgtttcgaaaaaggaaaataagtctgctgggcgcagtggctgacgccagtaattccagcactttgggaggccgaggcgggtggatcacctgagctcaggagtttgagaacagcctggccaacatggtgaaactctgtctctactgaaaatacaaaatattagctaggtgtggtggtgggcacctgtaatcccagctacttggaaggctgaggcaggagaattgcttgaacccgggaaacggaggttgcagtgagccgagatcacgccattgcactccaacctgggcgacaagagcgaaactctgcctcaaaaaaataaaaaggcaaataagtcatggtttttgggctgtagccgtatccaccctgccttggtaaaggcttgtggagcctggccccacccctgcagctgctcattggccctgcctctgctgaccctcggcatgtctcctccgtgcagtgtcatggggcaggtgcatcccccagtgaccctcgaggccccgctgtaggctcctcccaggcatggccgggagctgtgggggctcctgcgccctccctccctcctgcgcccatgtcgccccacaagagctctgggcaagaccctcccagcagcccggccgtgctgacgcctctctgaccctcccagcagcctgactgtgctgacgcctctctgtctcctgtggtgttttccaggatttcttcttctattctctagtctacgacccacagcagaagaccctgctggcagataaaggagagattcgagtaggaaaccggtaccaggcagacatcaccgacttgttaaaagaaggtagggtgggccgccctgggcatggagccctctgtcctgtcctgtcctgccgggtgacacactgggtgagaggaggctgggacatggccgtgtcagtgattcatgtgtgactgggggcggcaggtgtaggcctgggctctgtccacatgggtgatgcgtgtaggctggtgtcccggagccttcccccacccactcctggtggtgttgggggttctggggaagccccagaccctcaggcaggacgtggtgatcagctgtccttgcacagtgacacctggtttccttctggcagttgtttttctttttcttttttttcagacggagtctcgctctgttgcccaggctggagtgcagtggggtgatctcggctcactgcaacctccgcctcccaggttcaagcgattctcctgcctcagcctcccgagtagctgggattacaggcgcccgccatcacgcccggctaatttttttatttttagtagagacggggtttcaccgtgttggccacgttggtcttgaactcttgacctcaggcctcccaaggtgctgggattacaggcgtgagccaccgagtctggccttggcagttatttttcattactttttcttttttttggacaaggtctggctctgtcgcccaggctggaatgcagtggtgcaatcacagctcactgcagcctcgacctcccaggctcagatgatcctcccacctcagcctcctcagtagctggaactacaggggcaccaccacacccccctagtttttttgtatttttattagagacagggtttcgccatgttgcccaggttggtctcaaacccctgaactcaagtgatctacctgcttcgacctcccaaactgctgggattacatgtgtgagccactgcacctggcctcattttttaaagttctttttgcctccagaaattttcttctgtgtgaatctgcccacgtttcttgtcttgcctgtgggtgccccacccttgaggcctgctggggccgtggagctccgacgcagtgctcaccccggatgcaggcagcctcctccctccaccgggtgcttcggtagccctggtgggaggtcctggggctcactgtccccttctcagccctgtccctcatctccccgctgggcaaggccgcgaggctgccctcgagacgcagggctctgcccccgagggtgggcggggactcgcctccctgcttgcagttgtgatcaaggcgtttcgtgcttgtcctgttttggtttgttttgagagcgggtcttgctgtgtcgcccaggctggacttgaagtcctgggccccagcgatcctcaagcctcagcctcccgagtagctggtgctgtttcgtgttcttcttgattgtccgtaaggtgctggtgcgtctcacaggtggctgggtgtgccacctcctccaggcagctgtgggctccagcattgggctcgtgggcctgctacattgcaagcatctgtgctctgggaggtgcttggcagtgggggaagacccccacatctctccaggcagacagggcacattgagggctgggcctggggaggaggcctctgtgctgaggcctgtgggttggagcctggggaggccgctgtgctggagcccggcctgtgggtctaagtgtggggaagtcactgtgctgaggcctgtgggtctgagtgtggagaggccgctgtgctgaggcctgtgggtctgagtgtggagaggccactgtgctgcggcccggcctgtgggtctgagcatggggaggccgctgtgctgggtctgggcctgtggcctccagggtgccctgctatcatgccagggtctcccagcctggggctgtcttgcctttctggcctggccaaaggtgaaggcctggcagccgcacccaggtggaaaggcagagtccgtggctgggagacaggtgagaacacagatcacatgagggccagagagtgaggagctgtctcaggtcagaggccctcagctggcgcatctgtaccttcagcctggggccagtgggcctgtcaggagaatgggccttgaggtgcccccatcttaccatgcacacctggagagacctggcggagctctgcagggtctggggcgatgggactaagggtccacaaggccgagccagccgcaggagccggcctcctctccccacgctgccttccccgctgccctgccgttccttggcttttgggccgctggtgcaaggaccagggatcccaccagctggtgtggggccgggacgtggcgtccagagctttccccacctccgagaggctgtgtccctcttgagtgatggaaaattgcacactagttgtgcacctgcctttagtgagtttgaaatgtcaaagggagtgcgaccatcatgaccagcagtgcgcatacacggaggcaccatggcttgtgtgggtgacaccaaggctcagcttcttggccgtcagggagctaggccccagcttccccagggtacccctgagccaggtgaggagtccacaccaggctgaagaccccccagcccgccttgctggttcacacagccccagtccctggctgaccccgtcctctgagtctggccaggcattgtttcctagaggccgcatggcctgaccctccctggacacatggcccaggatgtccggcccttggggcagggtctgggagccagtgccccttagcgagggatagcattttcttggggactttctagtctcaagagctctctccatgctggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggtggacagaggacaattgtggagctctttctccaagtcctcccccaggagtcaggctcagccatgctcagacacacattctcctgagggtgtctcccaacaccacggtcttgttttttggcgagtaaaaggctgtttcgtcagaaaccctcctggccctggccgactgcaggcgtcaggtggcctcttcaccagccttgagttctccatcgtcccagctcccagaagacaggaaacaactggtgactccagaggcacgcccactccctggcccccggctctggctgtgccaggcttagccgcagctgccccagaaccccctggggtggaagaggggccaggagggagcctgtgcccccagaaggtccctggaggtggtctgcctgctgctgtgacgtggcagggccctcttgccacagcatgtgaacccaagtatctcaaaataaaaagcttgggccgggcacggtggctcacgcctatgatcccaacactttgggaggctaaggcggatggatcacctgaggtcaagagttcgagaccagcctgggcaacatggtgaaaccccgtgtctactgaaaatacaaaaattagctgggcatggtgtcggtgcctgtggtcccagctactcaggaggctgaggcaggagaatcgcttgaacctgggaggcggaggttgtagtgagccaagatcgtaccactgtattccagcctgggcgacagagtgagactccgtctcaaaaaataataataataataataataatataaataaataaataaaaaggcttgatttaaatttacaaaccaaccttcccatctcttgtggccacagttcttggagccctgcattctgggtgggctgggaggccccttgcgtgtgcaccccagccccgggttgagaggccactgtgtgcctgtgtgtgcaacagcctccgtccagccttgcaccctggcctcacctatggggccctgcagcccttccccctccccgtcccagcagctccccgcacccagggaggagaggcgcggcccggcgcgccgtgggaccccgtctcagaaaggccacacttcctccctgtaggcgaggaggatggccgagaccagtccaggttggagacccaggtgtgggaggcgcacaacccactcacagacaagcagatcgaccagttcctggtggtggcccggtgagtcctgctcctgggcaaggccagcaggggtggtgcctggagcttctgttctcccttccctgtggtgggtgttagggacgtgacagtcttggatcccatatcccaacaagaagcccatgcgctgcagccctgagacccccggtagcagttcccagagaggctcgggagtgctgggtccaggcccttcattaaatagaagggcggcccttctggggggcaggcctgtgtgcctgcccatgtgtccctaatggggctttcccaggatgggccagaggtgctttcccactcctgggccactgggagcaagtgggctgggcctggtcatggagcagagcagctgcagcccgggcagacccctggggcagggcgaaggccgaggcccaggagaggaccatgcaccttccctgccagcagcctgggaggtggagaaaaccccaaaagaagccccaaggcggctgccaatctatcgggatgccctcagttagacgcacatgggttctggggtgggtgccgggccctactccgcagcctggggcccaggacacgaggagtactcgccacctgcgggctgctccctgcgatgctcatgcagtctgtccctggtccctggcgcctggggagctgtgtgcctggggggagtccgcgctgcccgtggcccctggtccctggtccctggggagctgtgtgcctggggggagtccgtgctgcccatggcccctggtccctggcacctggggagctgtgtgcctggggggagtccgcgctgcccgtggcccctggtccctggtccctggggagctgtgtgcctggggggagtccgcgctgcccgtggcccctggtccctggtccctggggagctgtgtgcctggggggagtccgtgctgcccatggcccctggtccctggcgcctggggagctgtgtgcctggggggagtccatgctgcccatggcccctggtccctggtccctggggagctgtgtgcctggggggagtccgcgctgcccgtggcccctggtccctggcgcctggggagctgtgtgcctgggggaagtccgtgctgcccatggcccctggtccctggcacctggggagctgtgtgcctgggggaagtccgtgctgcccatggcccctggtccctggcacctggggagcggtgtgcctgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttccgtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaacctcttgactcctcatgtccttgttttctgtctcacgtgagtttagcccagcagcaggcctagagagtcttcatggcgtggggtctcccttccctgtacctccacctcaggacccccaccctccaaccgtcagccctcctaaaatacttctaaattaatctgttagaagagcatccctatgtgggggtggtggggcccccaaccatcagccctggggaggtggagactgtggcagggcagggaggagccccaaaggggccgggacacagtggggtggctagtatctgatgaaagcaccatccgggcagcagcgcacaggccagcgcagcagaggctggagacgcatctggaattcggaagaaacaaacatggggttgggtagggtgcctagacctgaagaggaggagggacagcagccagctgtgaggctcctgaggacgcatctgctgggggcaggagtgcagctttgtgtgggggcctctggccaaggggagagcttggccgggcgggaggagtccctgactgtccctggggccagcggcctctccaaggcggatacggatctctccaggcttaaaaacaaaccaagatgagcagaacatgttcagacaagaggacgagggctagaaacaaaattcaccaactaggctcagaccagggcggaatttgagggagaccctgctgcacatggttccagcggaggagaccccagtgctgagcccacgtgatgcctagcgaggcagcgctcaggggactgcggctgcggggccatgcccaggcacggtctcggggggctgcggctgcggggccgtgcccaggcgcggtctcggggggctgcggctgcggggccctgtccaggtgcggggatgggaggctgcagcttcggggctgtgtcgagggagcaggccccgctctccttcctgccagatgcagtggaccagactgaggaactatctgaacccttatttaataagacaggtttcttaaatccatgccacagcccgggcgcagtggctcatgcctgtaatcctagcactttgggaggccgaggcaggaggatcatgaggtcaggagatcaagaccatcctggccaacatggtgaaacgccatgtctactaaaaatacaaaaattagtcgggcatggtggcaggctcctgtagtcccagctactcgggagacagaggcaggagaatcacttgaacccccgggggtggaagttgctgtgagccgagatcgcaccactgcactccagcctgggcgacagtgcgagactctgtctcaaaaacaaaaatggctgagatggccgggcatggtggcttatgcctataatcccatttgggaggccgaagtgggtggaccacttgaggtcaggagttcgagaccggcctggccaacatggtgaaaccacgtctgtactaaaaatacaaaaattagccgggtgtgttgagaggtgcctgtagtcccagctactcaggagacagaggcaggagaattgcttgaacccgggaggcagaggttgcagcgagccgagattgtactactgcactccagcctgggtgacagagcgagactccgtctcaaaaacaaacaaaaaaaaggctgagatggaggctgggttgtcagtgccacctcggcaagatctcgaccttgaccttgtgccagctcctcttcccctggcgtcactgtgttttggcatctggcggggggacctgcttcatcagctgccctctgcacctgcctgccagcaggggcctggcctccgtgcaccaagcacacctcgccctctggcctcccgccccctctgtggccttctggctgcagccctgcccctgcctgcatggtgtgcctgcctcctgccccttcctgcttgtgtgacacgcctcctcccacccagctcccgtggaagtcgctgaccagcatcattgagtactactacatgtggaagaccaccgacagatacgtgcagcaggtgagcccgcccgccactcagtgcccggggtgtgccgcctccccgtcctgcgccccatcctctcccagcaggtgggcgtgcactgctgcagcaggaggggaaggaagactcctgagtccctggcccggctgtcctctccgtggtgctctcctctccgtagcctccagcctgtctgcactgcagccccaacctgggcctagcctgctgacctctgaccttctcttttgttttaagaaacgcttgaaagcagctgaagctgagagcaagttaaagcaagtttatattcccaactagtaagtgtgccctcacagccgtcgtcctcgtggccccgggggccagggagggtgggcacagggtgctggggccaggcgggtcccaaggaaactcaagctcagaggctgggaaagttggggcagcccccgggagggcggcccagggctggggggttctggctgcagacgcagtggccatgtctctgtcgtcctggcctcctggtcagtaagggggcattgggattccagcccacaccgccagggttcagtccctgagctgggctccatgctagggggagcacgggggcctggagaacggctcagacctcagcagtggctcccaggaactgaaaggggagaaaggaagatccctgccgaggccgaggggtgcgaggacgtggttctggacaaggggtggtcagccgcggtgcctgctgggcacatgggccctcgaggtttgtgctcctgcaactcctctcgtctctcctttccctctttaagtaacaagccaaatccgaaccaaatcagcgtcaacaacgtcaaggccggtgtggtgaacggcacgggggcgccgggccagagccctggggctggccgggcctgcgagagctgttacagtaagtgccctggatggccgggggcacaccgcacgcccgcctgtgggccgtggtgcctgcgttggccctgagggctccagcatggcccagcctgcaaggggcccactgacgatgggggctgcgtcccaggggtgtggttgggagagcctcggggaacgtgtgggggtgcctggcgggtgggggcggccggcgtgggggtggcggggaatactctgacatcgctggttctgcttaagaatccgtctatttccaactttgttgtccgtagccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatggtaaggggggggacacccaccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgtgagtcaccccaacgccccgcttactctgttcctgcgggtggtggggagagagcagcaaccttggggcccagcctgtagccccactgggagttctgatctcagggagccccacgtcctcctcggtgctgacatggccgagcccagtgagggctcccaggtcaaggcgcaggcagggtcccgtgctcccctgggggtgccccacccctcacaccgtgtggtaccccgcaggcacggcgcggctgcccgaagcctcccagagcccgctggtgctgaagcaggcggtacgcaagccgctggaagccgtgcttcggtatcttggtgagcagccaggcgtgctggggggctcccaatgctgcctgcaggcagcttctcacccaagctcgtgcactggtgctcccagccttctctagctgggagctcctggacagccccccagggcctggaactgtccttttggggtactctgcaccgtgccaggctcaggcagacccactgggacccaggctgctccctgctcctggggtcgtgatggggcccagtgcggagtagcggccgccctgtcttctgcggggccagcctcctcaaggcacacccgggggcttccctgccagtctcgctaccctgttccctgtgttctgatcgtccctggggcctgagggtctggggtttaggtggtgcacacccctgcctgtaataccattaaggcagcgtcgtacctgctgcctgcagggagtatacttcctgagccacgcccactccacaggggcagcactcaggcctctgcacgccctcggcagggggaggagcagcctcaggcggcagggggttcctttgcctttgagcatctgaggacacccgagaacctcagccggctaccctggcccagctggaagcagcttggtggctgggccagacatttgtggtggcggtggggggcctcctccatttgctgggctcgagtgggcttgtgcatctgccctcccgacacagggtgactgtcctgagaaggacattccagagtcatgagccaagtgtgctctgagattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacaggcctgtgtatggatcctgttgtcccggggctgaggggcctggcccccgccaggtggtctccctgctctctggaagccctggggtgcaggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcccggcagagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtgagtggcccccccgcccggtgagtgtggccctccccgcccggtgagtccggcccgtccccgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgagctcgagtgagggccctgcctgcccacagcacggggccccagcgctctaacccggccatttgcccgtgcagcctgttgcgctgtccccacctgcggggcctgcagatggctgcgtgtggctcactaacctaaagcatgtgtttcttccctctgctgtccaccgctctggtaggcacttacctgggtaagtagtttttgtgctactggccagccctgggcgctgggccttggcttgtggcaggtgccctgaggtatggctgttcctgcttgggagcgccgcagatcaggcacctgggcccccacctgaccctgcccggcagagctaagcaaactggcagggaaaggctgacccagggctccagggccccagttggcccccaggggagtgccccaagttaggaggcaactgcaggtggggaggggctggacaggctgcttctgttccttaagggatgggcctcagctaagcagcgtttctggagctggcaggttgctccgatgcccctgggccctggcacctgactgagttgagtatgacgtcctgtcctctctgagctggtcctgctgggagccgagccatcctgggaccagctcccacatgcacacgcccacacctacacgcagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtgtgtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccgaggtggctgaggccgtggtgggcggtgggagtgcaggacgcgctctctcggggcctcatttctctcctccatttctcatcaggtctggcaaaccacggacagaccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtagctcactggggtggtggggggttggccaggcacagcaccttggctggtggcccctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctaccttggcggacactgggggaggagaggaagaagcgcggctaacttattccgagaatgccgaggagttgtcgtttttagctttgtgtttactttttggctggagcggagatgaggggccaccccgtgcccctgtgctgcggggcttttgcccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12958 - DNA, 38368 bp, Human
  misc_feature (1)...(38368): n = A,T,C or G
tcaagaaataacagatgctggtttctggtgaggttgtggagaaaagggaatgcttatacaatgctggtgggaatgtaaattagttcagtaaccgcggaaagcagtgtggcgatttctcaaagaacttaaaacagaattaccattcgacccaacaatcccagtattgggtctatacccaaaagaatataaatcattctaccataaagatatatgtacatgtatgttcactgcagcactattcacaatcgtaaagacatggcatcaacctaaatgcccatcaccagtagactgaagaaaatacggtacatatacaccatggactactatgcagccataaaaaagaaagagatcatgtcctttgtagcaacatggatggagctggaggcctttatcctaagtgaactaatgcggaagagaaaaccaaatactgcatgttctgacttgtaagtgggagctaaacattgagaacacatggacacaaagaagagaacaacagacactgggacctacttgaggctagagggtgggaggagggagaggatcagaaaaaatacctgtcaagtactatgcttactatctgggtgacaaaataatttgtacaacaaacccacatgacaagcaatttatctataaaacaaacctgtgcatgtatcccgaacctaaaataaaagtaaaaaaaaaaaaaaaaagcagtttaccatctatgaagggtgtggcagatatgcaatgttaataatagctgacatttagagagtccttcttacatgcaactaaccacttcgtaaatgtattaactcacaaactccccacaccaactctgaggaaaatactattatttccacagagcaggaacttccacagagaggttaaaataacttgactaaacctgcccaaattcgtaagcggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgcctttgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggaggtaaggatgtagtgctctggagtgtgagcagctcggggagtggagcggacccaacccaggtcgtggagactgtgggagaagccgaggcccagtgtggcgctgcctgaagagggcggcgccggagaggaggctggatccacgaaggcttcctaaaacctgcccattttacagatgcaggtgtggagtccctggaaaggggcgatgtgtccgaggccgcacaaaccaggtgtagcagccaagacacaaactcagtctttccgattccccattctgccttctttatactgcatcctcctaagaaatgaggctgccggagcttgtagagagaggtagaaaaataggaagcctgataggcttagggttctggttgctaggaaatgggtaaaggagaacttttaacgctagaaagctctgttctgagtcggtaaatatttgagtgaccaccgagtatcaatcagccaccttattaagctttgtagggggagactgaggcttgattttgcccttaaggatttaaaaatctgctggtgttacacaatgctttgagacaggttaatgctgcccccggggggtctggggagatggttctggccgtcacagatgtggtaggaatgggtagagatggtggaaaggagtggagagaagtatggatggtagaagcttactttccacacatcctatcttcatttcttgattcaagtgattctcttatgtaccttggacagctcagagcatgggcctcagtttccccatctgccaagaagatttatattggagtgcctctcaaattttttacccctaaccctctctgatgaatttgttattcttctcactatcatttggatgtttgaagccccacagacacttattttctccatttggattttgccacgtgcaaagaccagccagagagatgaaaatgggtaggataaagtcttatgctaggtaatagacttagaataaaaggactagaaattgtggaaagagaaggtggaatcattttgtagcagagtgtgacatgaaggacgctcagaatcaggtttctcatagataacgttttgtctgtgcatagcatttgttaaaaaaaaaaaaaaaaagtcggccgggcgcggtggctcaggcctgtaatcccagcactttgggaggctgagacgggcggatcacgaggtcaggagatgagaccatcgtggctaacacggtgaaaccccatctctactaaaaatacaaaaaagtatccgggcgtggtgttggccgcctatagtcccaggtactcgggaggctgaggcagaagaattgcttaaacccgggagacggaggttgcagtgagccgagatcgtgccattgcactccaggctgggcgacagagcgagactctttctcaaaaaaaaaaaaaagtcttcactaaggagtatggggaggggtaaggaaaaatccattgaaaagtgatggtttgttgaagcgggtaatttgttgaagctggatgatgggtacatgggcatacgttatattattctctcagcttttgtataggtttgaaatttttcatcataaagcttttaagataagtcagtactacatagtttggcccattgagggaaaatgatgtttttagcaggcaactgagtgggagaaatgttgaaagattgcctcaaattgaatttgaatggacaccatttggtctcttaatttaaaaccagtccaaaacctccaagcgtttctttgcagcgggatgtatacaaagaactagtattactgtcaatctaaatacatctttttaaaacgtcagattttgcctgccacggtggctcacgcctgtaatcccagcactttgggaggccaaggcaggtggatcacctgaggtcaggagttcgagaccagcctggctaacatggtgaaaccccatctttactaaaaatacaaaaattagccagacgtggtggtgcacactggtagtcacagctacttgggaggctgaagcaggagaatcgcttgaacctgggaggtggcggttgcagtgagccaagatcacgccattgtactccagcctgggtaacagagtgagactccgtctcaagaaagaaagaaaaaaaaaaacaaaaaaccacgtcagatttattttattaattcaatttacctttgaactatcttacagggtttctgtgaggattaagtacatttaaagtgtttatagctgtatttggcacataagtaggatttatataagtgttaggtattactgttattgttgttttggcatttctttgagtgattctcataaaagatattgaataaaaattttcagttcaagaactgcaaaatgaactaatttatgaccttggttcagaaataaactgctcctgcagagaaaaagcaccccgacagcacaggccagaagcaatggactcagaattggagtcattgactcagacggccacctcagctgtgaaggtgcctttgtcatgttttccaggaactccaactccttaccatgagcaaattatttatgcatgtaatctcactgaatgctcacaactctggagggtggtttattactattactgtttagaggcaaggaagccgaagactggagaggtgaagcaatttgccccaggtcatttgaccactgggtggtagagctgggaatccaggccaggtctctcaggcctcagagtctctgcccacacctgtatttcaggtacctccaggtggtagccagtacactgtagtgggaagagccaggagacctaggtacaggcccagcaccgtggtccagccatgtgacttggaagggttgtttaacatccctggggctcatctgttaaatgaggagccaagattgaatgacctctctcccaaattctactcttaagattctactgggccaggcacggtggctcacgcctgtaatcccaacgctttgggaggccgaggcgggcggatcacgaggtcaggagattgagaccatcctggctaacacggtgaaaccccgtctctactaaaaatacaaaaaaattagcagggcgtggtggcgggcgcctgcagtcccagctacacgggaggctgaggcaggagaatggcgtgaacccaggaggcggagcttgcagtgagctgagatcgcgccactgcactccagcctgggcaacagagtgagactccgtctcaaaaataaataaataaataaataaataaaaaagattctactgtactaaaagtcaactccacaattcactagcacattctatgactgtagcgtaggataataattttactggcctcatcagttgtctgaggattaaatgaataattatatgtgaaatgtgatatataaatgaaaagtgtcatatataagtgttatttttgatcatcactgtgacccgtctttttgtggatagcaggtgtttggataaggatctaattagagtagaataaaaggtctccttccagccgttatatgtcctagtcttatttatacacatccccaagtataccccttgtgaagaaaatgtaattaatcattgaccttagggaagatactttttttcccccaagttaatataaaacctaatggaggttatctagttaatgttccagtgattttggacacgtttagaataaactgcacctgtaatctcagacagttcctacttgcagctagtttcctcagtttttcttcttgctgtgatgatttaaataatttccttataggtaaacagaggagagtatcacattttccactgctaagcacaatgctttctaagttgatcattttagtgcttctcaaagcttcagactgaagtggttttaaggacatgggaaatggatccaacctggtgcaacctgtagcaagaagtttcttcaaagactccagtccattttttcatgtgagcctagctttcttttggcccagataaactctgctagctttaatatttcttattttcaacatggtttcctagcatcttcaaataaaatagttgggaaaatatgctttatcagatgtttctgagtacccctagccttctccccagtatcctaataggctcttgagtggggataggtgagggaagtggcgatcttaggaggaagatgagggtgatggtttgaccatttaaatctgtgttctttcttcctttccttctgcaaagcaagactgctgggcccacctgtagactgtgtgactcccctaaaagggtttatgtccaggaagaagagcagtggggcatggagctggggagcatgctgataaaaaggcccctgacatggtcccaggggcctgcttgcttcaggctttctctagacatctcttgcttttaaaaaagcacatggatccatgaacttaatagtatgacagcctagctcttgttatctctgtgatcctgggcaaatggtttgacttttctggctgcagcagccagatccttaaaatagacatcacaatatctattttgtgggttgctatccaaattaaatgagagtaaagaaatgtatttagtgcagtaccttgtatgtacaaagtatttagtaaatccgtgttgttatttctctgccctcaggttccgtcaatgtctttctccatgccccagacctcatctctgaatgtcaggcctacagtggacacatcctacaactccctcaaattcagcatgttcaaagcacagctcatcatttccaccttccccttgatcttttcttctatcttccccttgtgttctaggtcttggtcgaccccactaccaccatccactcattatccagacttgagggagaccttggagtcaacagcagccctttccccaatcccctgtctttttatttggtcaataggttctgtcttttctacctcgaatctatttccaatggcaccccttttcttcatccctgctgccattgtgtgaattcaaggcctcattatttcgcttctggaatattgcagtagctttctactccttctacttctagtaactcacccttcttaactactgtctctgtccttctctctggtttattttctgtggtgtcactcaaatgatcccattaaaatgtgcagctgctcatgttactctcttgcttaaatgctttcagtggttacccattgaaactgaagttccctaaaagagactccaggattcttttagccactcccagctaatccttagtggattccacatcagagtcatgaaaatgcagatcctcaaagacctcatgctccccaggcctctggggccttgcacaggtgtgccctctcgcatgcccttcttcccttgtttaccttttaaactcttattcatctttcattcttcattctctgtaaaatcttctctgattcctcaaattagaattaaaggctctatctatgctctgtgtttcttggagggcagatgggatcttattttatcaatctctatagcttctactagccagtgcctggctcatggtgagacttagtaagtacttgttatgtgagcgagtgaatgaaagagtgaatgagaaactcaagggtccaacaaataggaataaaaattcttggggacagcaggaatagtggttgttgttaatgcctgaccccactgctccagtcacccaagaggaatctggttctgcttcactagggcagttaggagaggcatcaggaacaaatctagaactcaacctgggaaaaactgggcaatggagaaggaaggggagttgtaaattggccagtttttttttagtcacagtatagacacaatgcctctccaaccatccccaacccaagtagtagtattggaattttagagtttcacagagtattcagtagtggtaagaacagcagtattccagtcttttctttctctttcatattttatttattcatagcacattatttgtgaatgacatattatcataaatataaacacatagcctaataatgttatagaatagatataacacccagacacagaactgaaacataacagaactggtttttctataaacatcccaaatttttttgcatctacctagtatcctttgtaggtagttcaaatatgcttttcttgttccaagatttctagaaaccccttttagactagctatcaaggcatgtaggacccacacaagggatcattttttaaaataattgttctccgtaagttttacccagcttattcactcactcttttcaatggagatgatgcaaatgctattcccgaaaaataattgactttcaaaggacaaagatttggcactattgaggctattcaaaataatgagatgttgcctctagaaacaattccaaaagaagtttcaagaatattttgaacaatggtaacgttgtgatcatagatatgttgatgtgctttagggacaactcttacttggaagtagctattttggtacatctttagagaagccagaccaaatcccagctggcgaaggaggctttttgaacttgttgagaagtttggtggactaaggggtatatcatgaatggtatgagagtattgtgagttgggccaggcatggtggctcactcctgtaatcccagcactttggaagtccgaggcgggaggtttgcttgagcccaggagtttgagaccagcctgggcaacaaagtgaggccctgtttctatgaaaaatttaaaaaaaaaaaattagctggtcctggtggtgaatgactttggtctcagctacatgggaagctgaggcaagagaattgcttgagcccagggggttgaagctgcagtgagctgtgttcgtgccactgcactctcacctgggcaacagagtgagaccctgtctcaaaaaaagaaaaaaatattgtgagttagattcaccagagccggagggtagactatgagtggtatgagagtattgtttgattcacctacccagaggcatttggtcagtggctctgtcagtctgtagccctgtccacatttctattactaacttgaaatgtttctcagatttgcagatgacatattcctggagggtagagttagctgatcattcaaaatgatcttataaagtctttttactgtatatcctgtgacctaataaattaacatttagatatttttcctaagaaaacactcatgaatatgtgtaaatatatgaacatttatcacaatgtttataatagcaaataatttaaagcaacacagttaataaattatatataaaacaaatattatttatccactaaactgatgttgtaaatggctcatatttatgaaaaatacccaattgcattcataataagataaatgcaaattaaaactacttgacatattatattggcaaaaatacactcagtgcgtaaggctgtgtggaagcaaacgctcttaaacagtgctggtgggaatgtaaattgatataattcctgtatcaattgggacaatttggaaatatttgtcaaaattacaaaaacacatacttcttagcccactcttttgttttccacccagcatcttacagatatatttgcatacatgtgagatgacgtatgtacagggtcgttcactgaagtattgttttaatagccaaagattgtaaacaactcaaatgtccaacaagagactggcaaagtaaaatatggtacattcatcagctaagcagctgtaaaaaagaacaaggacgctctctatgcgcaaatgtaaaatgattttcaagtggaaaaagcaaggaacacaaaacagtgtatagtatgccgtatgctaccttttgtttaaaagggcatatgtaagaagctgtgtttgcttgtgtaggcatagggaaatgcaggaaggatatgtaagaaactaacagttgttatttatggagggagggatttgagaactaggtagatagaggataagaatgggatggagacatgcaaacatgtcacctattagaagaatagttaatgaggaggaaaaatgcatagtatatatttaaatggaaaaaagcatgttgaaattctatgtacagtttgatccatattttataaaagaatatgcccatcaaaaataaagcttagaaggttgtacaccaaaattttcatactccttgtctctgagtactgggattatatgttatgttagttctcacactgctataaagaactacctgagactgggtaatttataaagaaaagaggtttaatggactcatagttccaccggccatataagaaacatggttgggaggcctcaggaaacttacaatcatggaggaagagtgaagcgcaagcaagcaccttcacatggcccagcaggagagagagcaaagcgggaggtgctatacacttttaaaaaaccagatgtagtgagaactcactcactgtcacaagaacagcaaggcagaaatctgcccccatggtccatcaacactggagattacaattcaacatgagatttgggtggggacacacagccaaactatatcagtctactcctgacccctatcaaatctcatcgccttctcacatttcaaaacacaatcacatgttaattataatgtttattttttaccttctgggcttttcccaattttctacaatcaacacgtgttgttcagtaaatggtaacaacaaccctaaaatgtaattttttttttaagtcagggattaattttgggcagaaatcaagaaaataaaaatcagtatcactctaaaattttgtttccatttcaaaatcacttgcgtaagtgtaggattattgaggacctaaacattcaaacagagaggcaaatgacccctgccaggaatcctacttggacagattattggcgtgggtgcaaagctaaggtaactgccctgtaaagctctaatcctaacataatcatagaatagtgtagggaaaaaaattggtgctggataactcagagtgacttaaaaatactttcagaggaagaggaaatgcttagaggtttactgtagagcaggatcaaatattgtgaaatagatcaatttagatcaatgaaagggtgaggcagatgaagtgggatgaagtcagaagggtaaacactggctgaggtcaaaatacagagagaggatagagatgtgtttaagtgggtccttgggtgattgtgtcacctgtcattgaaatcgtcagggcatttgcttatcattcgtcttatttctgttcctctgggacaagaggagtggtgggccttcttccactccttctccatgtttgtgttaaaggtgccaggttcatgtggaagtagcacctaggctttttctggaagtctcttggggagatgcagaaggaagaagactgctgggccaatggcctagagacctcagtgcactagtgatattgacatgacatttgcaagatgctttttactttgcagagtgcttttctatgtactttctcatgtgaccaggctctgtgatgtcccagttttatttcagcattctactttttggaggtcacatagttaagagctgtaagttccacaaggatggggaccacatctgcccttatgtttgcccagcacctagcccaatgcttggctcaaattaggtactcagtaagtgaacaaacttttctccaatttccttcactgttctgttttgaccggaaggtggtgggattctcctggttcacagttacaaactcttaacttggacacagcatgagcctccactatgtataactcttttccattctccagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaagttttgggtaaggatgtattttctctttagaaactgaaagtaaaaagatgttgagaatacagtttgtttaaaatattaggcgttatgtctattgaactgccaatgaataagtgtttctgtagcgcgagttcaggaacctgatagcgcaaataatgtggccatgtacaaagcacggctttttcacttgttcagttttgcccagtagatcatcagattttagctactgcatttgaagcagtcagtggagatgccaagtagaaagaatttaatggagtgataaagacaccagggttctagatccaactctgccactacttttgatcataggcaagtcatttagccctctgggctcacatacacatgttagaaaaagaccacatagtgcgagtctgtgatcccatgaggagcacttgcgtagggaattgtttaaggggcctctgagtcccctgaaattatatgcagaattttgtgtgtacttatttcttgggagaaggtgcatagcttttagcagattttcaaaaggtgtctgtggcccttcaagggttcaggagctactagtagatgctgtctaaagtccctgccagttctaatattctttaatacttctactgttgatctcagcacctatcatttaagtgcttcctggtatatagtctgtgtgtaactggagatacatggaggaagaacacatttggaagtagacacagtgagataggctgtgtgttccaggaagtggaacagattctcagtgttgtaggaattcagaggggagggagacctatgagtgctggagatggcacttgagctgaatcttagagaatgtgtgagcgaggccgggacactggttctcagctccagctggatgttagtattacctggggagtttttaaaaacatactgtggctgggccctgtggaccccatgccaggccaggtaaatcagaatcttggaggcaccacccttctcccctctctttcactcccttttcttctcccccatgggcatattttttaaatactccccaggtgttttcaaagtatagccagttttgagaaccataaaatatggaagaggggcaagaggaaggatattcatcttgcatggtaggagtccagggacagaggcaagagctaagcaggtctagcttgtaaagagacctacctgatgagagctgggaacatgttggataggttaggcaggctgattctggcagccagggcaggagaagccaactgaaggttggagcagaggagttacccaataaaagtgttgtttgaagaagataagtctgattgggtgggtgggaaaaagaagagctcagatttttgcactagtccagttgggaattgcacagtttaaaccagtggccattatcattcccctgggtcagtgttgtgatgtagcctgtaattcatgcattgaggaaaccacatcttggagtcatctgatttattccccacatgctgtgtacagtaggttttccttttatatatcatgttacccagatgccctgataagcagaatggcagaggacaataaaggttgcacacccatacatttgtacatgtaccaggaagcagggaaggccctggtgaaggtcttgggactcaggtccatgattaggcaagtaatgaacttcattaaggttttgtatggattggaatgagagactatgatttgcctcaatgaactgaagtcatatggttagaatagttaagagtatagagattattaatcatattgggaagtttttctgaaaatccagtgtttctgcagaggtagaggagaatcctaatgaagtttgaaagtggggaactggccaggcgtggtgatgcacgcctgtaatcccagcacttcgggaggccaaggtgggcagattacttgagctcaggagttcaagaccagcctgggtaacatggcaaaaacccgtttctacaaggaaatacaaaaattagccgggcatggtggcatgcatctgtagtcccaggtacttgggagactgaggtgggaggattgcttgaccccaagaagtggaggctgcagtgagccatgattgcaccactgcattccagcctgggcaacagaatgggaccctgtctcaaaagaaaagaaaaaaaaaaaaaaaagaaagtggggaacataggccactggggcctctcttctgaaactaaataaattagttggaattctgttgctgacaaatgaaaacagagattccatgttggggagtttcttcctctaatactgcatttcttatatagttgttaactatgttgggcagatgctgttcctctgcccattgatctccatttgatgacttacactgtaagacttaaggctattttttgtagccttgaccctgggaacatagccctccctcttaatctagtttctcctgttttatatttttgaccataaaacaattttaaaaggccatcttcatggcagcaaatatttgaagatatactttttggatactctcttggcatctattaatacatcactgtgggtaccagtggttattgagctctgagcccttctttttatatatatatatatattttttttaattatactttaagttctagggtacgtgtgcataacatgcaggtttgttacatatgtatacatgtgccatgttggtgtgctgcacccattaactcatcatttacattaggtatatctcctaatgctatccttcccccctctccgcaccccacaacaggacccgtgtgtgatgttctccttcctgtgtccaagtgttctcattgttcaattcccacctatgagtgagaacatgcagcatttggttttttgtccttgcgatagtttgctgagaatgatggtttccagcttcatccatgtccctacaaaggannnnnnnnnnnnnnnnnnnntactagatcttattacattctatcttaactatttttttgtaaccattaaccatccccactttccctgcccattaaccatcactacccttccaagcctctagtaaccatcattctactctctatctccatgcatgcaattgtttaatttttagcttccacagatgagtgagaacatgcaaagtttgtctttctgtgctccactgtgtatatgtatcatattttctttttttttgcttctccattcatattcttttattctatcaattttttagactatatgtatgtatcactttttctttatatatatatatttttattatactttaagttctagggtacatgtatgtgcatgacgtgcaggtttgttgcatatgtatacatgtgccatgttggtgtgctgcacccattaactcatcatttacattaggtatatctcctaatgctatccttcccccctctccgcaccccacaacaggacccgtgtgtgatgttctccttcctgtgtccaagtgttctcattgttcaattcccacctatgagtgagaacatgcagcatttggttttttgtccttgcgatagtttgctgagaatgatggtttccagcttcatccatgtccctacaaaggacatgaactcatccttttatatgtgccacattttcttaatccagtctatcattgatggacatttgggttggttccaagtctttgctattgtgaatagtgctgcaataaacatatgtatgcatgtgtctttatagcagcatgatttataatcctttgggtatatacccagtaatgggatggctgggaaaatggtatttctagttctagatccctgaggaatcaccacactatcttccacaacggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttgtttgtttttttcttgtaaatttgtttgagttctttgtagattctggatattagtcctttgtcagatgagtagattgcaaaaatgttctcccattctgtaggttgcctgttcactctgatggtagtttcttttgctgtgcagaagctcttgagtttaattagatcccatttgtcaattttggcttttgttgacattgcttttggtgtttaagacatgaagtccttgcccatgcctatgtcctgaatagtattgcctaggttttcttctagggtttttatggttttaggtctaacatttaagtctttaatccatcttgaattaatttttgtataaggtgtaaggaagggatccagtttcagctttctacatatgtctagccagttttcccagcaccatttgttaaatagggaatcctttccccatttcttgtttttgtcaggtttgtcaaagatcagataattgtagatgtgtggtattatttctgagggctctgttctgttccattggtctatatctctgttttggtaccagtaccatgctgttttggttactgtagccttgtagtgtagtttgaagtcaagtagcatgatgcctccagcttaggattgacttggcaatgggggctgttttttggttccatatgaactttaaagtagtttttcccaattccgtgaagaaagtcattggtaggttgatggggatggcattgaatctataaattaccttgtacagtatggccattttcatgatattgattcttcctatccgtgagcatggaatgttcttccatttgtttgtatcctcttttatttcgttgagcagtggtttgtagttctccttgaagaggtccttcacatcccttgtaagttggattcctaggtattctattctctttgaagcaattgtgaatggtagttcattcatgatttggctctctatttgtctgttattggtgtataagaatgcttgtgatttttgcacattgattttgtatcctgagactttgctgaagtggctcatcagcttaaggagattttgtggtgagacgatggggttttctagatacacaatcatgtcatctgcaaacagggacaatttgacttcctcttttcctagttgaataccttgtatttctttctcctgcctgattgccctggccagaactttcaacactatgttgaataggagtggtgagagaggacatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaacggctgttgaattttgtcaaaggccttttctgcatctattgagataatcatgtggtttttggctttggttctgtttatatgctggattacgtttattgatttgtgtatgttgaaatagccttgcatcccagggatgaagcccattgatcatggtggataagctttttgatgtgctgctggatttggtttgccagcattttattgaggatttttgcgtcgatgttcatcagggatattggtctaaaattctcttttttggttgtgtctctgccaggctttggtatcaggatgatgctggcctcataaaatgagttagggaggatttcctctttttctattgattggaatagtttcagaaggaatggtaccagctcctccttgtatctctggtagaattcggctgtgaatccgtctggtcctggactttttttggttggtaagctattaattactgcctcaatttcagctcctgttattggtctattcagagattcaacttctttctggtttagtcttgggagggtgtatgtgtcgaggaatttatccatttcttctagattttctagtttatttccatagaggtgtttatagtattctctgatggtagtttgtatttctgtgggatcggtggtgatatcccctttatcattttttattgcgtctatttggttcttctcttttttcttctttattagtcttgctagcggtctatcaattttgttgatcttttcaaaaaaccagctcctggattcattgattttttgaagggttttttgtgtctctgtctccttcagttctgctctgatcttagttatttcttgccttctgctagcttttgaatgtgtttgctcttgcttctctagttcttttaattgtgatgttagggtgtgaattttagatctttcctgctttctcttgtgggcatttagtgctataaatttccctctacacactgttttaaatgtgtcccagagattctggtatgttgtgtctttgttctcggtggtttcaaagaacacctttatgtctgccttcatttcgttatgtacccagtagtcattcaggagcaggttgttcagttttcatgtagttgagcggttttgagtgagtttcttaatcctgagttctagtttgattgcactgtggtctgagagacagtttgttataatttctgttcttttacatttgctgaggagtgctttacttccaactatgtggtcaattttgaaataagtgtggtgtggtgctgagaagaatgtatattctgttgatttggggtggagagttctgtagatgtctattaggtcctcttgatgcagagctgagttcaattcctggatatccttgttaactttctgtcttcattgatctgtctaatgttgacagtggggtgttaaagtctcctattattattgtatgggagtctcagtccctttgtaggtccctaaggacttgctttatgaatctgggtgctcctgtattgggtgcatatatatttaggataggtagctcttcttgttgaattgatccctttacaattatgtaatggccttctttatctcttttgatctttgttggtttaaagtctgttttatgagagactaggattgcaacccctgccttttttgttttccatttgcttggtagatcttcctccatccctttattttgagcccatgtatgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgttattatgatgttagctgcttattttgcttgttagttgatgcagtttcttcctagcctcgatggtctttacaatttggcatgtttttgcagtggctggtaccggttgttcctttccatatttagtgcttccttcaggagctcttgtagggcaggcctcgtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatcagctgttagtgtgacgggcttccctttgtgggtaacccgacctttctttctggctgcctttaacattttttccttcatttcaactttggtgaatctgacaattatgtgtcttggagttgctgtttttgaggagtatcttcatggcattctctgtatttcctgaatttgaatgttggcctgccttgctaggttggggaacttctcctggataatatcctgcagagtgttttccaacttggttccattctccccgtcactttcaggtacaccaatcagatgtagatttggtcttttcacatagtcgcatatttcttggaggctttgttcgtttctttttattcttttttctctaaacttctcttctcacttcatttcattcatttgatcttccatcactgataccctttcttccagttgatcgaatcggctactgaagcttgtgcattcgtcatgtagttctcgtgccatggttttcagctccatcaggtcctttaagtacttctctgcattggttattctagttagccattcgtctaatcttttttcaaggtttttaacttctttgcgatgggttcgaacttcctcctttagctcagagaagtttgatcttctgaagccttcttctctcaactcgtcaaagtcattctccatccagctttgttccgttgctggtgaggagctgcattcctttgtaggaggagaggcactctgatttttagaattttcagtttttctgctctgttttttccccatctttgtggttttatctacctttggtctctgatgatgtacagatgggtttttggtgtggatgtcctttctgtttgttagttatccttttaacagtcaggaccctcagctgcagatctgttggagtttgctggcggtccactccagaccttgtttgcctgggtatcagcagcggaggctgcagaacagggaatattggtgaacagcaaatgttgctgcctgatcgttcctctggaagtttcgtctcagaggggtacccggccatgtgaggtatcagtctgcccctactggggggtgcctcccagttaggctactcaggggtcagggacccacttgaggaggcaggctgtccgttcttagatctgaaactccgtgctgagagaaccactactctcttcaaagctgtcagacagggacatttaagtctgcagaggtttctgctgccttttgttcgagctctgagcctttcttctgcttggaaggcctcaccattcccaggctgctgtcttagttcactaatagcctcttaatttaccttcctgcctctagtctcttccctgttttagtacattctgcatgctgcagctaggatgaccttccttggcaaaacaagctactcatgtcacctgttcccactccccacccccaccgcccatagctcccccattgcctgtagggtaaaatccagactttgagcttggcatgcagtgaaagtaggtgacaggtgacagtcttcatcctgttcttacagttgctgatttcccctcactccactagaggtcctgacattctaagagtcttgctgttctctagacctactgggccctgtcaagactaagaacctttgcctggcccttctctccatttggaatgccctcccttattgctctagctgtccagtccccacctctaagtccttcaagagctgatcaagggtcacttccacactgaatccttaggtattttaggcagagcttgttgtttaagctctctgagttatcacaggactttgttcacagcttgggaataacagtacttaactgttcttactataatggataattttataagtcttcatctcccacaaggccctaactttccccaggagagtgatcattgcttatttaccttgcagattttcagcatttggctcctatccgggtacctcaggttccaaaggtttggattcattcattcctttagtcatcagatgcccactactagagccaggcactgttctagatgctggagcacagcagtgactcaaacacacagaatcccctgcccttgcattcagtttcggggagaggaacagactctaaatgtaatctttttgactatatcagtaagaaaatgacgtagtatactaaagatgataaatgctataaaaatggagcaggaggtggcatgttaggaattctaggagtggatacagttttaactagggtggttatgatagaaatagaaatgacatttgagccaaaacttaaagacgagacataaatgaaagaatgagtgaacaagtaaaccaacagtaattgtttcttcccttagatttttcttctccagattcaacatttccagatcctttacccattttgaggagacctattttctagactcctcactgccttgtattacttttccactttcagatcttaggatccagacagaaatgtcgatttttcatctctggcatagtgctgtttcagctttgagattactgagcattgtaggaaggagggctcatgggtcataactcattgtcacatcatgacatcccactctcgctttgattgcctctaggcgacttggggcttctgctgtggctcagatcttttcaccactgtcttctttcttcatctagttcagcacatgcttatgtagtaccatgtgccagatgccgtgagagatgctgggggcacccagatgaatgcagcatggctctggccacaggcagctcctggttgctctcctattcctcatggtgaagtcatagtatcggcaaattgttatctcagacaagggttctagaatccagcaatcttatgctgacatgtccaacagaggcctgctctatctagcttcataccaagtcttcctggatttcccttgttctggatactcttgtttacccaggtccagttgcctggctccttgagaagtctgtacttacttcctttgatgttatgattttcctttataacaagtacaggacattcttaggctgtaggacaatttgccaaaaatcagttcacagaatgaccacattgctatattattgattcaccaaaaacttgtttctgttagttgctgatgtttagagcaacttgtgtttcactgaagccatccagtatttaatatatttttagggagtgataacttcttgagaatttgatatttcaagtgtcatatatgtcatgaatgtcaaggattagttaatgtggagtgggtttatctcttctaagcacatttttaatgtattctactgatttttaaaaaaatgaatttgctttctgtagtgggagagaaagggtggagttaaaagttgagaacaggaaatgaaaaattatgcctgggaatgtttccactggtatctatgcatctatcgtgtttccagaagttaaaaccatgttcaagggaggtcttgctcatttgcttaggaagtattagcactctagagtggcttaggtatctgcaatgtgaagtcatgtatgaaactgacattcaacttagctggatgacaaatccataaaaaataaatgcacatttgtgttatatcatcttggtagcaatttgcataaagaattcaggtaaaccacaatgtgggggcaaaacttttaaagtaatagcaagggatgagtgctcagtaaggatcactgtaaataacagagtagttagcacaccaaatctgacacacactgagcattttcaccccagtgcactgcctttgcccctctctgtaatgtacagctatgtttagttctgcatccccttgaatgtcaactttgcttatgtttcacatttcagatagtattctttcacagatgctcacacctataaatacaaacagaacattggtgcataatagtgccgataattggtaacattaccttgttgttggcttaaatgggatttctactaaacgattcactgtttttaagctgacttatgggttaaatgaatttttttcagtcattttcaggaagtatccactgtttcctgttttactaagcatttatctcaggaatagccaagcttttcttacctgttgtgatgatcatttgggttttctctatctagcagcatgattggttttatatctcttataatccattcatgggatgactctcaatcaagggggtaattttaatgtactgctggattaatattgttcattaatgtttacttgggaagttagtatcaaggtacgatctaggtctctcattctacttttttcccttttgttgtcttttagcagcaatgttatgttaggttcttgaaaagatttaggaagcttttcttctctaagaagagttttaaaacttttttattggccaggcgtggtggctcatgcctgtaatcccagtactttgggaagccgaggcaggcggatcacgaggtcaggagttggagagcagcctgaccaacatggtgaaaccccatctgtactaaaaacacaaaaattagctgggtgtggtggtacgtgcctgtagtcccagctcctcaggagtctgaggcaggagaatcacttgaacccaggaggcggaggttgcagtaagccaagatcgtgccactgcactccagcctgggcaacagagcgagactctgtctcaaaaaacaaacaaaaaaaaaacacaaaaaaaacctttttattatggaacatttcaaatctatatgaaagtagagaaaacagtataaagaatgaatccctgtgtatccatcacctagcttcaacaattatctgtatagggtcaatcctgtgtatttccatctacccactccctgcctccctgcctccctgccctccacgaaagctggattattatttaatagtaaatcccagacatctaaataggtgtttgaaattgtaaaattttatgactaatacatgaatacattcatcttatttttaaaaaaacgacttatagattaggccaaagtccctttcaaccactattcctacatccttggacccctccccagaggttgccactgttagaagattggcgtgtgtccctccttgtatttacttatttatttatttgagacagagtctcactgtgttgcccaggctggagggcagtggtgcgatcttggctcactgcaacctctgcctcccaggttcaaatgattctcacgtctcagcctcccgagtagctgagattacaggtgtgtgccaccatgcccagctaattttcttgtatttttaggagagacagggtttcaccatgttggccaggctggtctcaaactcctgggctcaagtgatccacccaccttggcctcccaaagtgctgggattacaggcgtgagccactgcgcccggctagatagactttttcatgtgatctttttcttcctttctcttcaatcctttagacaaattgggcaacatggggtttatgacatttttctgctgagagacttatgctgaaacctaattagaattttgaagaggcaaaatcaaagatctataggcagagaactacatcattagaatgtagtgactccatctagaatggaaaacctggatttgtgctgagctgtgccactcacaactgtgtatcctttgggaaaaacatgtctctgaatcagttcctcatgtttcaggggatatagacttgactttagagggcatgtgggcattgagtatacatgaaagcattttgtaaatgataaaatataggaatagaaaaccaaacacctcatgttctcacttaaaagtgggagctgaacaatgagaacacgtggacacagggaggggaacatcacacacgggggcctatcggtgggtgggaggcaaggggagggagagcattaggacaaatacctaatgcatgcggggcttaaaacctagatgacgggttgatgggtgccacaaaccaccatggcacatgtatagctatgtaacaaacctgcacattctgcacacatatcccagaacttaaagtaaaataaataaataaataaataaataaataaaatatggcttttattattgcctatgttaggtcactttaggatgagaggaagccagccaggcgcagtggctcacacctgtaatcccagcagtttgagaggccaaggcaggcagatcacaaggtcaggagttcgagaccaacctggccaaaatggtgaaaccccgtctctactaaatatacaaaaaattagccgggcatggtggcaggcgcctgtagtcccagctactcgggaggctgaggcaggagaatcacttgaacctgggaggcggaagttgcagttagctgagaccatgccactgcactccaacctaggtgacagaatgagactgtctcaaaaagaaaaaaaaaaaaaatgagaggaagccaaggagaagaaagtagtactcatgcatcacctctgttttgttagaacatacttctaaggattaataagcctgaattctagagatgaggagtagcacagattgatgtcaatgacaagttaggaacactgttttagaggcttatgctagagggtaagtttgatcttaggatgggtgctgaagagatgggtttgccttccaaggcatgtgcgtgcatgcacacacacacacacacacactaatgtggcctcggtgtgtcctctacctctgtgttcagaagggaagcttcttctagtgtcagacctcctgggttgaagactggcactcctgctcagtagctggtaactttgagcaaggttcttcacctctctcagcctcagtttcctcagttgtaaacatgggcaaatcatagtacctttttcatgtagtagttgtaaggttttgatgagataatacaattaaaagccttagcacagagcaggcatagagtaagtgctcattattaccttatttttgtaaatattatctgacctcaccattatcagcctgtgaccctgtttcttctctttcaggtaggaggtgtgcaatctttggggggaacaggtgcacttcgaattggagctgatttcttagcgcgttggtacaatggaacaaacaacaagaacacacctgtctatgtgtcctcaccaacctggggtgagtctttcagctgaagtgagaggaaaaacagaaaccagagagaattatcctcatgactctccctggttacacagaaaatgtaatccagccctagaacaactgactgttgggaatggcttgaacagtgggttatggcagtgcatgagaaacctgctgctcaaaatcaagttaagaatactctttctcaagactcttagtagacttgtatctaccaaggctatgttgaaactccccagaggaggcatagaatgtagatgcaggaagtatcattgtagtagaatataagtctggcattaatgtgactggttgaacttgttcttggttacaatcattcctctacatcttaacccccagcctggatgatgcccagtggacattgagcctgggagggccctggaagctgacttgcatcctttccactcatgcctcctagtgtttgtaaagtgcttaactttttacttctttgcatgcagagaatcacaatgctgtgttttccgctgctggttttaaagacattcggtcctatcgctactgggatgcagagaagagaggattggacctccagggcttcctgaatgatctggaggtgggtgatttagaggaaaaagtagagaattgcatggtgtcaggaatctcaggcaaagtctttggaccagttgctaagtgaaggagtctgagacaccttccccatacctgatggtggtttctgacatagcatgtaagagagagggcacaaaagagacatgaaagagtgacaagaatatggttgccctttgccctccatcactgaccaatctgctgctgactctgtctcccaatattcccatcagtgtcagagctgacatagcttccttctcctcagaatgctcctgagttctccattgttgtcctccacgcctgtgcacacaacccaactgggattgacccaactccggagcagtggaagcagattgcttctgtcatgaaggtaactgccccttcagagcatctcttaaaaaatagtatatattcttatttaatgtatgtagaagcaatacctgtttgctgtttgctgaggaattaggaaaatggagaaaagtccaaagaagaaaataagtattaactgtaaattttattacctaaagaaagatactgttaatgttttggtagatagaatgtcagactgtgtgtgtgtgtgtgtgtgtgtgtgtgtgtgtgtgtgtctagttttatgtatatgttttacaaagatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacactattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggtaaggggctcccagtctggtgggccggggggtggggagtgcagaacagtaattgtcccagtacatttaactgggtctcttcctttcattttggcagaagcaggataaaattactttaacttctttgactctcagatatttgtaaaacaggggctgatatctacctcacacgtgcataacacaacacctggaagacaggagggggcactcgatgaatggtagttttccccaatttccccccccacccagtcttcctctccatgaagttggaaaacccaagaaggtattcccagcaaaatagaatatcgaacgtctaggcagtttaacagtttgggagctcttggtttttatctgtaatttacatacactttatcttattttagaacagtaatttttatatagtagctaaatctgcaatctttatttagtaagtcctgatgaaacatattgccctattaatatctatagcagcacctcggtgaagcctgagttgaaatgtgagtgtattctagccagtatacccaagactagcactagactcactagtaaatgcagtcctttccttctgccccctaagtctctctctctggtatgttaatccacccatccagacatccacatgccataataggcaggttatgatcccattgtcagctgtcgtttaaattagagtttttaaacctgtgtgttttcgggtaccatctttcctgtctggattggtatttacgtcactgtccatgcttcaggacaggtaatgtgaagacaatggctgaccggattctgaccatgagatctgaactcagggcacgactagaagccctcaaaacccctgggacctggaaccacatcactgatcaaattggcatgttcagcttcactgggttgaaccgtaagtggcccccaccacctccagcccatgcgtgcatgtagacacacaacattcctttcagtcgctcgccttgagctgagctcactttcacagcctttgcctaattgggcagccattgctttggaccaggacaagttaggttttcttagggtgtcccaccatctcataaactctctgggtctcagaagagtattgtggtctgccctgctgacccacagccaagatatttccgtgtttgtgggctgggaagtggctcagagccagctgggaggtaacaggattggtagctgggagccttaatttatgaaaggttcttataaatgctcaggtacattttgggtttgccttaatcctgaatataatgattattcagggaactgatttcttgacaggtctttcttatttctaggtattatcctcaaaaagagattacaaagttatctctgcatttcataaacaagaacctagattgggctgggcacagtggctcacacctgtaatcccaacactttgggaggctgaggtgggcagatcacgagatcaggagatcaagaccatcctggctaacatggtgaaaccccgtgtctattaaaaatacaaaaaaattagccgggcgtggtggcaggcgcctgtagtcccagctactagggagactgaggcaggagaatcacttgaatccaggaggcagagcttgcagtgagtcgagaccgcaccactgcactccagcctgggcgacagagcgagactccgtctcaaaaaaaaaagaaaagaacctagattggtggttggaattaaaagctgattgaaaatctagtaggtggtcatgcatggtcttggtcaattgtcagtagggcacatctgccatctgcagtcccatctgatgacagaagagtcatttcttctttttttttttgagatggagtcttgctctgttgcccaggctggagtgcagtggtgtgatctcgactcactgcaacctccgcctcccggcttcaggttattctcctgcctcagcctcccgagtagctgagattacaggcgtcatttctttagtaattcccacagtgcagatgtggcgactcacctgtgtgtcccagtgactctagggagggatgtgtggctggcttggtttgtaggcagaacggcagaggccgtggggaggtatttaactggggccatcacagtgccagtgtgaagtgggctcagaaaaatccaaaggaaataaatataaatggcagttaatagagcttgtattgtggacccctcaaaatactttggggtaaaatgaagctacctaagaaagtaaagaaatagctcagttagctgtagatgtcctcttgactgaggaacagagaattagttcactcacaattataaaaatattacatgtaacagaaatattaatagtctttagtagtaatagtctaaaagctcacaatatgggaatgtctccctgtaaaatatccatatcttcccattatccacaggaggaaattagttttattaatatcacgaattggaaaaatgatgagaatagaactgtgcttataacacaaaagttatatttttagcgcttggcatcatttgcccttattaaaaacaggggttttgttttcctcccaactttttttttctttttgagacagagtcttgctctgttgctcaggctggagtgcagtggcacaatcttggctcactgcaacctccacctcctggattcaagcgattctcctgcctcagcctctcaagtagctgggactacaggcatgagccaccacacccagctaatttttgtatttttagtagagacagggtttcaccatgttgaccaggctggtctcaaactcctgaccttaagtgatctacctgccttggcctcccacagtgctgggattacaggcgtgagccactgtgcctggccttttttgtttgtttgtttgtttcagacacggtctcgctctgtcacccagggtggagtacagcggtgcaatctcgggccactgcaacttctgccccctgggctcaggtgatcattccacctcagtgtccaagtggctgggaccacaggcgtgaaccaccatgcccggctaattttttgtagaaacggggtctcaccatattgctcaggctggtctcaaactcctgagctcaagtgatctgcccgcctcggtctcccaaggtgctgggattacaggcatgagccactgcacctggccagaaaagttttaaacatacagaaaagttggaggaattgtacagtgaacccctatatatccgccacctagtttctacaattctcacattacaatacttcctttgttatcttttttctgtcagaatggggcttttaacctggaatccctggatgtacgtttaggagaactgtgaagcccctgaaatgatgtttaaaaaattgtatatgtgtattttggccctgctctagggaaagagtccataacttttactagcttttcaaactgtgacacttcccttctctgaaaaagtagaaaggcctcatttttactaaaacaaaaccaaaagccagggtaggagtcatttaatcactgcctcagggcacaggcttttagaaagagtggcacacccagggctgtgttggcttgaggctctatccccttgggtgaccaattcacacaggtaaacctcttcttaagcttgctttctttgttcactggtttggaggggtcaagggaaaacttaccctttgccctctgaaagtttgctggaaatcagctgacaagaggcagattaataggagaaaaggcatacaaatttatttatttatttttgagtcagagtctcactctgttgcccaggctggagtgcggcgtcacaatcatggcttactgtagcctcaacctcccaggcccaagcaatccacccacctcagccttcgtagtacctgggaccacaggtgtgtgccaccatgcccggctaatttttaagatttttttgtagagacagggtctccttatgatgcccaggctggtcgtcaactcctgggctcaagcaatcctccctcctcagcctcccaaagtacttggattacaggcatgagccactgtgcctggccagcatgcaaatttattaacttgcacaggtgtcttacaaaatagaactcaaataaatggccagatgattgatgcttttataccatcttggggttatagaaagaatgggagcttggagcttgccagaacagattatggcaggcagagaagagaaggcctggttagcaaaggtggtcttgttatattatgtagataagacaggtagcagccctcggagaaaatagcggtaaaggtctatttcttttagacctttaaaggcatcacactctcagttaatctcccctagatctggacaagggagggcctcagagaaagcctagctgcagccatgcagattttctctacagatacagatctctcccacaaaagacagctttgcagggctacttctgtatgtaggccctctcaacagccatctcaaaatatgtcaaagtatattttggggtgaactattttggtttccttcaaggagcactgagtccagggtccagatttttcacttccttagagaggcactgtagcatcacgggggcagtgtacagcccagacttgaaatcctgcctgaaaatcccacatccaccattgaccagctgtgcaatctcggaaggccatttaatgtctttatggcctatctgtaaaatgggcatgataaagttattatcaggatgaactaagatgcagtgcttagaacactgcctggcacatagtgtttactcctctgattatgatgattctattattattccatttcctcaggttggtggtatcttaaaggtactaattacttaagcaataattcactaaaattctttttttttttgagacagagtctcactctgtcacccaggctggagtgcagtggtgtgatctcggctcactgcaacttcctcctcttgggtttcaagcaattctcctgcctcagcctcctgagtagctgggaccataggcacatgccaccacgcctggctaatttttgtatttttagtagagactgggtctcagcatgttggccaggctggtctcaaacttctgacctcaggtaatccaccagcctcagcctcctgaagtgctgggatcacaggcgtgaaccactgtgcccagccaaattcactaaaattctatcaatggatttgccaaatagcaaaactgctttagagactgctgtataaaggaagtacaggtagtctcttcttacccacatgtgatgcatttctgaaaacatggaaaaactactgcatctgagagaaagctgagaaatgaacagaagtctgatggtgccaggtcagagaggtctgtgtcatttctcagctcattggttaattcacacaggattgatcaggtacctcatgcatggggccttacccaatgtattgtaaaaatgaaatgtcaaagggaggctgccgcgggtactcaatgcaagtccaggttagggaagaactaaaggaagcacttcatagccagcatttcatatcgctgtccgtctgatggttgtttttaggtgataggggtgtcctggtggatataatgtataaggcttggttggaaggcaatctcagattaaaattcccatcagtagtagccatattgaattttctggggattcaaaggtgaactagtaagagtactttccagaatctagtgagcatatttttctgtttgtcagttggacaaaatagcgccttttgttttgcttctctctgttaaggggaaagaagtaaagctgtaattgtcatataattgctgagcctccactgctttaaggatcccctctgctctgattatgtcttcttttggttttcaacagccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagacatggagttgattttatgaccactaatgggttgtgacccacagtttaaaatgaatgctttagagggttttactagtggctaaaggaaaaactacaatgtgttcttacagtatagcttccttcagtgaactcaccatataactccctggtgattttgcgggcttgtcatttggaggccagctgtcttatgttacttaagaaactggacttcttggactgtgagaggagatgacatcactcaggttgattatagaacatcagcccgttccctgctgtcagagtccctcctggtttattgaaacagaaccacaaaaacatacatcacaatttccagagtccaagggccgctccaaatggccattttgtagaatttggtggggtttgatgttacttaacacaagaggtctattaattggagtttttaagtatttaaagttaattcttgtgattttaataggatctgccactttctaggactcatttgggttgttagaaaatcctgcagtcctgagggatgactggggcctcagaagtcatcaagtcctgcctctccgccagtgaaatagtctctccatattgtctctgactcatccatttcaactggtggggtggtagtggtgatggattctttaaatacctggtgaggcatccccttctgctggtggggcctcttaattaaaaaaaaagaggctcatttaccttttgctcacggtaaaagttcatctaccttgaaccagaatttgatctttgttccactcccctgcccctcctttccttcctttaaaccacagatagtaaatctactggcacttctaatctaccacctttcaaatatttgaaagtagcagttgtcattccttgtttacacttttccacatgaactgcctctcccccaccacttttgtttctgcacaggatgtggtttccagatccttccctgtctggctggagccccaggagttcttcagaggacactcactctgccagtgtgtggttgggctggtggaagttcatgagtgaatgtgattagatgccctcccacccatctcttcacagctttctgaacatatcagtctttgttctcctcccaatgtaaagatgcttgttgttagtaagggaaggcagccaacagagaagtcgaatgattctaccttctgtcaatctgccattctctccaaacgctttcaaccactcattctccatggggacgatactgcctccatggggacgaaaattggctctctggggcaaaaaaaaaaaaagcctgaaatactaaaatgttgccttccaaagtgcaatcctacctgaccatcttattagtatttaatttctcttgttagggaaaattaaaattttctctttagggggctgccaaaaccattaaagataaacacatctttaaatctaagtgacagtaccaaagtgctcaaatgtttttagccttgaaaaaagcccatctcaatgggaatctggccttcttctattccgacagatatgttggttggtgtggttcccactgcgttcacctgaaaaagggctgtgagtttgggaagccggcaggactcctcaggcctctgacatgccagtgaacttcagaggtgggattgtttcaccaattttgctcactcaagagcagggcactccaacctccaggctctgccagttcccaggtgtgtaaccgtgagcaagaagacagtaaccttgcagacagtaacccctcctccacagggtggttgagaaagaaatgagctaatgggtacttaacagaatacttggaacataaagcccttggcaaaatagttgtttccattatttattattaccgttagtgaaatgaatagcctctactgaggttcctgagaagaatcttaagaggttttggcataggcccctgatcctcctgtttgctttgagaaatgagtagtaggtgtcagatttcagccttccttccacacaggtattatatgcccaaacacatcttcccacctgcctggctgttc

SEQ ID NO: 12959 - DNA, 49526 bp, Human
catgtagttatgtgaatttaaattaattaaatgtaaataaaaataaaaatttagttcctttgtcatatttcaagtgttgaatagttacccatcacagaaaatgttattggccagtgcttctctagatcactggttcttagctaatagtatacaccagactcattcaaagatcttaaggaggttggagaagagcacaagcccttccagacccagtaaattggaatctctagggagaggcctagccatttgtgaagcttcacagaaaattctaatctgcagccctggttaatagctactgctctagaagctctatagtaaccatggtaatgactgcccctcatgttgtggggagacctagactgacagagatacccagagcaggctgatctctttgttcaacaaaatagtctctccagttggaggccacatggacagcagctgcagtctgtgatgagatgaggacctcagtgtgatatgtggcatgatatggccatgtaagcccccaagctctttacaggggagaatggtgatgttttggctccattgccaggtgtattggggaggaccgtatgctatttattaattgttgttaaattcgaacttcctaagtaaccctaaaatctatgtagctctaaaattatgatagggaacattattggagcttctgatatggatgaaagacttgggcaaaaattgtttagttaggattgttggcaacagtactttaataatattgacatgtagtagtgatttgggacacagttttactatgactttgtacagtttagaaacatgggggaggagtattcccatcatcactcaccaatttagctgagatttcagatatagcctaagaaataactctgcttctcttttttccctttgatattaagaagaacagcctctgtggcttattgtcttacctgttttctttcatgaaagctctacttcctctactataaaacacttaatagcattattaaaaaacaaacacgtacagagaacgaattgtttggatctccccttcctttattttggaggttttgttgttgtttaaggtcttaacagcttaaattatagaatagcttattaattattgaataatagaactggaaggaaccctagggataacctagaccagtcctgggaggtgggttctagcagtctgttttaacaagcctttcaagtgattctgatgcatgctaaaatcaatgaaccactgaactccttcatgtgacggttaatgataggcctagagtatcagtatctatttcacccccaatgtaagagctagtttttaagttttatatcagacccatgcctactctccatcttgtgtgtgtcttaaaggtgcttagagaaacttccccctccccgcacaccaccaatagatataggtagatatttctggcaggggaaagtgtgctctggagtgccagtaggataaaggcatatcaaaaagtgaatgagctggttgaacctgttgctccacaaagagctggaaagaaagctgttgcatcaaatacctgtgaattgaattttgagctttcattattggtgctagctgtacctctctgtcttcttgctcttttttttttaacttccatgacagcctaccattgaatcttcttgtctctcaaagagataaaagttctgttcttcttatatcttcaaactcttgaatattaaaggaaatgagcttttcagttgagatgcacaagactcttaattcagagttcccattccctcaactgtcacttagctgctttgcttatttggaagaaagcataaatttaactgtgccatagtgcaaacaggctatagatgtgtaaggggagtttccactattggaagaatagaaacatctagatgtttgtgtatttgaattccccgtcatggtattgaagcatcaattttggtgtgtaacaaggtgatggcagtgcatagcagcaccgtcctctaccaactgaagggcctttgtttatacccggcctgtcccttggatctcaagcagtaccacagttacaaagtagtttttagcttacaaggtgttttcacaaataggtggtattttcatttttcaaatgacaaaattagggttctgaggcgggtcagttgacttaaaggttactaggttggtctcattgctctttcaaagtaactgtatttctttatagcatacagactaaaaaaacctgtgtacttgggttatatattcagtggccagaggccatcaaagctcaggttaatgaaatgctctttattttgtagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcaggtagatggtgattgtgattaccttgacccttgttgctgtccaaaatctgatctgtgagctatagaatcagaatgtatccttggcttccaagcctcttgacaggaatgtagacctgttggctcagttaattacagagtgctactaacaaagccaaagctataggcaccgttccatgtgtgctccaaggaaaactacttactccctggtcacaggtacgtatctctttttctcttgacctgactggccagcttatacctagtgagtggtcatctctgaatgagatgggatgaaaggcagtggctgaacatgtaggcactgctactattaggaaaaccattcatatcatgtgccctggtgacggaagaggccctttatgcttctgaatacctttaacatatctgccttctggttcaaaatgaatgtgactgggagtagaagaaaaggggaagattaaacagaaaagatgttaacagcattgatacaaatgttaagatttccccttatccatctctttttgtcgaaccattcacatcattatctctttattgtcatttttgtattgacaaagttttctatcatttatctttgagtgatactcatactgaaaatagggagagaatataaaacaaattttacttctaagactttaaagcaaagtacgcctttaatatagaaaattgtctcttttttccaatagaggagagatgaggtaattttatttattttttttatttttttgcctgcttactaaatatatccccagtgcctaaaatagtgcctggtacaagtaattgagtaggctgtcaaatattttttttgaatgaaaactaaatgaaagagagaaccaaagtagcttagtgattttcacactgtctgaattactaaaccttaggttttcagttggttgagccaggctgctattgactattcattgtggttagggtacagattcctaacacttataaaaacagtctaggccgtgataaaaagagttaggctcactggtagaaacagctgctctcaaacttatgttgcccaaatagtaaatagtgtaaattttcagtggataaatgtagtccacttgtaaacaaaccacctaaaaacccagcttggccgtccttcctggctcagtttaggcagggtgagagaaaaaccctgggcctcctaagtatgaggccttgcatgcttgctttctatactcatcatcagtgcatagcttctcacaaaacacttcatctttcctcatgcaggagagtcagtgctaaaagtatattttcctttcctacagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggtaagatatccctgcctcctgcccttccctgtgtgtgactacagacagcttgggggttagtgtcatgagaactttgctgtacagagtggttctctaacgtgcacttaaagaccaattaaactctgggtaaacatgataactggattgattgaactaataaaggcataacctccttaactgcataaagacctgtagctctccttaatgatgaagaaatagggcaatggaaagttgcatagatggataagaaattaaagataatgggactggtttttttattttattttattttattttattttgtaaatcaacatcagaacttcagcatctaagtgagttggtcttttttcaaaacagtcactttgagaggcagtactgtacattcactccaactgccattccattctgctatcgctcaaaatacttggatcccttcatttggaattgccaccagagctgataccacattctttagaatactctcagtggtggcaaatcttattttttgtgggtggattttgtttggggaaatagcaaaaattcatttggagttatgtctggtgaacaagatgtaggtaatagagcctaaaatagcatttggggctttatttttgtagagcccaaagaaaagagatgactgagtgatgacaggtccactaaaaagtttatgtattggtggcactgttggaataaatatctcatcccaaggtgatgtctttgaatgaagcagtactcattttaatgcagaggttctagcatgatttttttgtggtttcattggtctcattccttgatagatttaacttgaagttggccagacattagcatttaaccccaagaaacagccctctgtaggcagcaataaatgggtgacaattctgtcagaaagagtccactgttgacattcttaccagtcacagcttggatttttctggccttcacataatacttttcgcaactggactttctctcacactcatgagagacagtcccataaccctttcacagtgaagtaagcctgcctggtttatcaataccaggccatcacagcttttgtttttcttgttgtaggagctatctcaagattcatttgggtctcaggcatcctcagccccctcaatgacctccagtaagggagggcaagaagatatgaacctgagccttcagtcaagaccctccagcttgcctgtgagtatttctgcaccttctgaaaggtgataggggcagagaggaaaccaatgcaaactagttagtttctggttggaagtttagctaattttgacctaaatgaataagttatttcttgaattcaaggaacttaaaggctgacttgtagatgtctgttctgtctccctgcccagggaataggtttgtgatctgtttagtttgtttttgtctttttaagtcttgtgcttttagacatggacccacatgaggggcagagaagatggagatatcagaagcactgtctgctctccatcaaagttgagaaaaatatcagtttcttgactttactcttacaggcttaatttttaggtttttggcttaatgtttagctacaaggtaggatcctggagcaattcagcatgcattgtcacattgagcgtggctggagcaaaagcagtttttctggtggtgattttgtgtgaatactttttttttttatttttggtagagtacttgatgcccaggtgcttaagttatggaatcaggtacttatttatgggatggactgaccatatcctgagacaggcagtatagtctagtgattaagaacttgggctctagagccagagttcctggctctagcttctgccaccaactctgtttcataggggtggtggtgaacattaaataggttactagagagtgcacacgagcactgcacattgtaggcactccataaatgtcagcctttgtaatcatcgcctcagagggcattgggactgtgctttatacctgaaaggcagttaacaccatactaggtggttgtaggaacctttactgttagtcttagctctgtgggcaagttactcagcctctgaaagttaatctgctgggcacagaaataaaataggctactctgaaatctagtcatctagtaagatggtgggtagcaaacccaccatgacaaatcctgcttcagttaggaaatggaaattcagccacatacccagataagaatcttttggaattttgactctacttggatgtaaagcctgtgtcttcatttattctgacctgagagaaatggtttcaggatctctaagaaataggcagaaggcgggaactctcttcatcatgaagcctcccatggattcccctgaaggtctctgagacacctcaatagggcaaggtctgcagagtcccttagtacctggtgttcaggcttctgaggccagaatgcagataggacgtctgagattgttgactttctcaactgaggaattgggggaaggaagtgccttaataaagtgatcactctttgttcccttctcattagtgtctgttgcaatccttttctgcatcctgaacttcattggaatgtgctttttaacctgattcagtcagaatgtgtaaccactccctcatcatctgtggtctgtggctaaatctgggtgaggtgctattgtgtcaagaacccaaatcggtggatttctgtcagtgctgtaagttgcttcattccaaaaagtttttgcttgcttctggtgaccttttgatagatctgtatttggcttctttttttttttttttttttggtcctgagaaggcttgtatccagagatgctacatgccttgtaagggttgggaatcttaagaacttcttatctgacccactgaagtgaaggtgaaggtgttggcagccttttaggcccaggggatggttgttcctgggaaggctatcacaaggaacattcccacgtttgggctttttctaaagattcatccaaatgggtcatttgctcagtggtagaagctccatgtgggaggtaagctggctgggttattggcatcttgttttttgaattgctttttatccctttgctacttgggcaggcatcaaaaagtggttattctttgaaattttggtttgatgccagatttgcctacgcaggctaggaagcagccccatctgaagaaatgacaagttggattccctacaagagccctctcctttcttaaccagtcgtgttaaaggatccctaggtttgccagtgcattgcttcactaaacaaatgtttatgaggtacctattggcaccagagcagattccaggctggctggagagcagcccctcagatttcacattgctctccttactcattcacgttaccttcctggccctaaaggcattatgattgtgacccttgaatattacaaaaattaaattttgaggagtctgtgctcagttattgatgccaagccatttgggtgctattatcctgatcatgttatccctatatttaaacctctcaattatttttttgttaatcttagaataaaatccagaattttttttttttttttttttggggggagagagagtttcacactcttgttgcccaggctggagtgcaatggcacgatcttggttcactgcagcctccacctcctgggttcaagtgattcttctgcctcagtctcccgagtagctgggtttacaggtgctcgccactacgcccaactaatttatttatttatttttggatactgagtctcactctgttgcccaggctggagtgcaatggcacgatctcagctcactgcaacctcagcctcccaggttgaagtgattctcctgcctcagcctcccgagtagctgggattacaggcgccctctaccacgcccacgtaatttttgtatttttagtagagacgggtttcaccaggttggccaggctgatctcaaactcctgatctcaggtgatccacctgccttggcctcccaaggtgctgggattataggcgtgagccacctcacccggcctgaaatccagaatctttaatgttagacatcagaaacacagattgctgttccctctcagctcccatcccctgtgtctttctcattcagtaggtctggagtggggcccaagaatgtgcatttctaacaagttcctctgtgattctgttgctgctagaccagggatggcactttgagaacctctactttattcttttttctctgccttgctcttggctttctttcagtttctctaaggcaccatatgctattttttgctttcagacctttgcacacacccttccctttgcctcatacttttcccctcaactcctcctgttcatctttcagactatatcttaaagattgttccttcagaaaactactacctaatcaagcttcaagacgcaccttaaataacttctatgatgacttcattgactaaaggccattgttattttacctttaaaaaaaaggccgggcgtggtggctcacgcctgtaatcccagcactttgggaggccaaggcgggcagatcacgaggtcaggagatcgagaccatcctggcaaccatggtgaaaccccgtctctactaaaaatataaaaaattagccaggcatggcagtgggtacctgtagtcccagctatttgggaggcagaggcaagagaatcactttagaacctgggaggcagaggttgcattgagccgagatcacaccactgcactccagcctagttgacagtgaactccatctcaaaaaaaaaaaaaaaaaaaaagtatagctgggcgcggtggctcacacctgtaatcccagcactttgggaggccgaggctggcggatcacaaggtcaggagtttcgagaccagcctggccaatatggtgaaaccctgtctctactaaaaaatacaaaaattagctgggcgtggtggcgggcaccctgtagtcccagctactcagggaggctgaggcaggagaattgcttgaacccgggaggcggagattgcagtgagccaagattgtgccactgcattccagcctgagtgacagagagagactctgtctcaaaaaaaaaaaaaaaaaagggcacagtggctcaggaggccgaggcgggcaaatcgcctgaggtctggagtttgagaccagcctgaccaacacggagaaaccccgtctctactaaaaatacaaaattagccaggcgtggtggtgcatacctgtaatcccatctactcgggaggctgaggcaggagaattgcttcaatccaggaggcagaggttgcagtgagccaagatcacgccattgcactccagcctgggcaacaagagtgaaattctgtctcaaaaaaaaaaaaaaaaaaaaccctgcacaatatataaggcctacaaaaactataaagaacagttcagtacctgagtacccatctgtagaaatcaagccttgctaacacaggtaaaactttatatagctctctgggatcacttatccctcttggtaagcaccatcctgtatttgacagagcattttgccaatgccctctacctgtgcttgctttttttttgtttgtttgttttgagatgggggtctctctgtcacccaggctggagtgtagtggtttattctcggctcactgcagtctccacctccccaggttcaggtgatcctcccacctcagcctcctgagtagctgggactacaggtgtgagtcaacatgcccagctaatttttggactttttagtagagatggggtttcacgatgttgcccaggctggtctcgaattcctgagctcaagcagtctgcccgccttggcttcccaaagtggtgggattataggcatgcaccaccttgcctggcctgactctacttacttaaatggtaagttcctggaaggcaggcactgtgttattgacctctgtgcccccagtacctatcatgtgatgcccaagaccagtggttctctactgtgtctgcatgttagaattacccaggggagtgtattatctttaaaaattaatgcccaggcccgagcacggtgcctcacgcttgtaatcccggcactttgggaggctgaggtgggcggatcacctgaggtcgagagtttgagaccagcctgaccaacatgaagaaacaccatctctactaaaaatacaaaattagctgggcatggtggcacacgcctgtaatcccagctactagggaggctgaggcaggagaatcgcttgaacctgggaggcagaggttgcggtgagccaagatggtgccattacactccagcctgggctacaagagcgaaactccgtctcaaaaaaaaaaaaagaaaaaattaatgcccagagttcacagagttctgatttgtttcatgtggggtttgggcattggtgtggttagcagctgtcccaggtgaatcccgatttgcaggtagagatctattccagactgtatgaggttcctttgctatagtaaactcttttttttttttgagatggagtctcactctgtcacccaggctggagtgcagtggcacaatcgcagttcacaacaacttccgcctcccgggttcaaacgattctcctgcctcagcctcccaggtagctggaattacagacgcccgctaccacacccggctaatttttgtatttttaatagagacgaggtttcactatgttggccagactggtctcgaactcctgacctgggtgatccacccgcctcggcctcccaaggtgctgggattacagccatgagccacggtgcccagcctatagtaaattcttagcacccatacttcttgttagtacttatctcaagtgtaatttaaattacttatttaatgcaagttcattgaggactgacttgctgtcttgcttattgccatagtgcctggcatctggttgcttattgccatagtgcctggcatatagtaggctccaacttactgaatagatgaacctgagcagcatccattatagtgctcattcaggaagtatacatctgacaggagcagcttgactgtattaccagagtcttgctctgtcacccaggctggagtgcagtggcacgatcttggctcactgcagcctccgcctcccgggttccagcgattctcctacctcagcctcttgagtagctgggattacaggtgtgcgccaccactcccggctagtttttgtatttttagtagagacagggtttcaccacgttggccaggctggtttcgaactcctgacctcaagtgatccacccacctcagcctcccaaagtgctgggattataggcgtcagccactgcgcccagcttctgtaacttttcttttgttttttttttttttttgagacagagtctctgttgcccaggctggagggctggagtgctggagtacagtggtgccatctgggctcactgcaagctccgcctcccgggttcaagcaattctctgcctcagcctccctagtagctgggattacgggcacccaccaccacgcctggctaatttttttgtatttttagtagagatggggtttcaccatcttggccaggctggtcttgaactcctgaccttgtgatccacccaccttggcctcccaaagtgctgggattacaggcatgagccactgcgcccggcccagcttctgtaacttttcttactgagacacatttgtaaatttacattttggtcttgaaagtgtacctaggatagagtaatggaaaatggatacaggattgaaagctgtgatctgaagaggttagctagtgcttcacaaactttagcgtgtgttaagaatcacctgaattactgcctctacctgagaaattctgattcagtaggtgtgggctgggacctaagaatttgcatttctaacaagctctgaagtggtacagatgctgccagttcagaagaccacaattggaatgagactgaagtaggtagtcacctttaagggaaggaaaaaaaattactagactaggaagccacagcggtaactagaataatagtggtgatttacactgtagtttgactcttgattatttggaaggcacactgtgggttaagaatggtagaaagaaaagagacttgaaagaaactagacttcctgtagctgtggcctcagtgcagtttattcctgggtaacggagcccttgccctgccagtaccaccctgggagctcctctgctctatggtgctcatcactggatcccttcctttagtggggccaaacttagttggtcaccaaatcttagtctaccacagaaatggtttttgcttttgaatctggtttcccctctctttctccactgccttttgttttttcgggtccctgttatctctcacctggtgtcttgccacaaacttctgactgttctgtttcttttcttcctcttttccttccaagtctgtcctcagcataatcaccagagtgatcatcttaaaaaaaaaaaaaaagaaaaaaaaaacctggccaagttatgttaatgctttaaaacctggctacgtgttgtctgtagatttaagtccaagtgtgacatacaagtaagtttttttgggatctggaggatgaggagagatgtaggtaagtttcctgtccctggagtaaaacctggcacactttttgctatgggtgttatgtagaagacaaacagacatttgacaagggttgaacttgtgtgacttctgaggtcatttgaactcttgggtccatgattccgaatatgatacgatgattcctaaaggatcctcctgtgtttcattagtaaaatagacataaaacagaagaccatgtgcctgtatgttataatgagtgctgtcagagtttggtgaagtcactgatccatttatgtctcaatagttgaaggaagaagtcatgttgaagttcagtcagtatgagctagatgtggatgtatttaagtggttagttacaaagggaaagtccagcttgaacagaggccatgcagggatggggatgaggtgcagtatagatacttgggggctggtcagcttccaggggtgggaagtaacaggaaggaaagctagatcacagggatcctgctgagcttaagccatttagatctgatcttatgggcttgcagataggtaactggggcaatcatgtgataaaactaatgttttacaaaaatgatccattagtttgtagtatgctttgaaaacgggagagtcttaaagcagtggaataagttaaaccgtagaactacttctggcaagaggtatggagttctggtccttctgtctcatttgcatagccacctgctcccacatgtggaacatgcaggaaagaatacaggactgagaataagtgggttctgtgtggtggaatatttaaagattttgattgactggtgggcagggggagtctcatttttgaggaaaagttaaattccatatttattttgtggaatataatatagtaagatttctgaaaacaaatgtccagtttctagttggagataagaaactgaaacttgggtaagacctgagtctggatacaagtttgcgagttacctgtgtggtagttaatagttaaaccatagaatgaaacaggcctcctaaactggagtttagagatagaagccagatggagctctggacgatgccggaggccatcaggtagaagcagccaacagagagttggagagatcggagaaggaccaggattgtgtaatatttctggaagccaagggaggagggacgaagtcaaatttatatttcaaagaaaataggtagttgggtttgtcataaagcattttattgggatcctttttagataaggaaaaggccttatttctgagggcttgagaaaaggaaatgagcaagggaaagggaaagagcactcttgaaatgcactgagaaaaaggagagtctggctgaatcagtccaattcctccgcttcatcccaaagacccgcatgtgtataaggcagatggaagagggaaaagtgaaggtgctggcagaatattaggagggtataaacaggcacatctttctggagttgtgagaaaaaggaatcaaaggcatccactggattaatttctaagggacgctatacccttggctgaaaaaaaggtaatcttaaagactgttgttgaagattggatcatactcatttcctcaggttaggtaggagtgaatgttatcgatatcaggagggaggtggagaacagaattaggatctgtaatgtctatcaaattatcccttgagtttctgagccattctttagatttcacttaacatcttagctattacccttcgtatttttacttctgtaatgctctcagacgctgagatcttggaattacattggtctagaaagaggaaatgcgagggagctatgctgtccctgtagaatccagattttagagggcaggagtaaggccaggcaaggagctacagtcaacatcagttattctgaaaagataggaattggaaggtacagaatacccactcctgttttacatatgaaaaaccaagggtcagaatcaagatttgaatctagctctgatatttcaggtgaaatatttcctccagcatcccacccagtagaggaaagacatggacaatctgatcctctcttcatttttaggcaaaaaactcaactctttgccatttagcatttgctagacttgtcctaaaaggaatgtcaatggatttccattttacttctgttttcccagacatccctgtgatggaggcacagatgagctgtggaaagagcgagtggtaggaaagatagccaaacctataggacctgcttggaggaactagccaactagggaatcgcctcaaacagtgaaccgttgactagagtttggttatttggttcctgtgtgggatgagagcaagccctgttctgtgtctgtcttcttagaacatactgtcctggtcagtgctaactttaatcagttagatccttgctactcagtgtggtccattgtctagaagcaccaacatcaccgggaagcttgctagaaatgtagattttcaggccccatcctagatttattggatctaactgttaataagatctctaagtgattcatgtgtctaatggtttagaagcacagagaccctgagagctgagagtaaaattttcaaatgaaatatcaagctggtaggccaggcacggtggctcacacctgtaatcccagcactgtgggaggctgaggcgggtggatcatgaggtcgggagttcgagagcagcctgaccaatatggtgaaactccatctctactaaaaatataaaaatttagctgggcgtggtggcatgcacctgtgatcccagctactcaggaagctgaggcaggagaatcccttgaacccgagaggcggaggttgcagtgggctgaggtcgcgccactgcactccagcctatgtgacagagcgagactgtctcaaaaaaagaaatataaaaaatatcaagctggggctttggaacgtcataaattttacagattgtatccagtaatatttaagtaatctctgagtgtgggagaccaccaccagttgtttcgtgcgtgttttggggaccctggctcccagtgccttacccagttcagaacccatagtggagccatccacagctcccagcatacctctgcaacttcatctccagccactcatttgtaccttaagctcctcacaattcctggtcctcttgattaggatgtatacctgtttctctctctttctgtcatgctcagcaaacttctactttggcttcaaaacctagctggaatactctctctgagacttcttccccattttcatattggcatagccttatgctggtacctctgcttgaactgtatctgacatctgtcatgttgtgcccagaacaggcagatatttgtaaacctttgttgaatacctcctagattcttgctacctagttgagctttgggagctgacgttttgttgtttaggtttattgagaggagtgacaaatcctctcaataaatgctttaaaaattagaacatttggctgggcacggtggctcacacctatagtcccagcactttgggaggctgaggcgggtcatcatgaggtcaagagttcaagaccagcctggacaacatggcgaaaccctgtctctactaaaaatacaaaaataggcaggtgtggtggcaggggcctgtagtcccagctactcgggaggctgaggcaagagaatcgcttgaacccgggaggcagaggatgcagtactccatctcaaaaaaaaaaaaaaaaaattaaaacatttgaaggattttaattttacacagtttctgttcccttttgttcatttcatgatagaaggagagagggcccacagtccttatctaggtttttgatggttgattttcaaaaagataacagaaatgtcactagcgattttggtaaccagagaagcagggtctttctgaggttggtgacctgttttctttatagctgaccatgtatctgtgcctgctccccttgaattatagcccaggtgctctctcagagtctcgaaaaggaaatccccaccccctctgtcatatctgcccagactgctaagagcagcatgtaccctgtgcatgtagccatcccttctctagaacgctggttctctgggctggactggccaatccgcttctccatcttagtcacactgttccaaccctgatactgcctgctgactgcctgagcctgtgctgcttgcagcagattactgtatgcttgttcctgggcccatttcctgtttctattctagtcgctggtggctcagctctgcttcctgcctgtgtgtctcacacagattcctcttgctggaaccttttgtttccttcggaacagcctcaatctttgaaaagcaactgagccttaactctagtatgatggctcttgagtcacttagtcctacagaggtctggctggaagtacctcttccccattaagcacaccgtttgaattttaccttgtttttcagtttgtcgtcagccctgctgtaggaagttaagttgggccaaacttgtcctcacttattagtacacagagctatcgggactggtatgtcctgattcttttgtacctggagcttttaaatgtatttcctactactcaagaagacacttggtatcctctctggcccaagcttccctgaagcccaggtgatacttattttgagttgggcaggttatgccatcctcagcagaataacaggctgcagaaaacatagggatggaaaagaaagcgtgtgctgactcaaccctccatcctgtgtgagcaattcaaaccccccacccaccccctcagagcttagggtgagagagagaaagtacagtgaggttgtaaaaagggaagaagtgaaggaggttgtcctggacaaatgtatttaaaggcctaaggctcccccctcttgcccatttcctacaaaaaatatgcttcgtgaataaatcttttttctcttcctttacagccactcttttgggatcatttgataatactgagtcagaggatttctgtactggaccctaggtctagctatgtttaaaagagagagatttaatatagggaatttgggcttacaactggaaggagtgagggagcttgctctaggcttggcctccaagaaaccagacccagatttaacctagatttgacctaccaggggaacgtctatctcggagctactattagattgattgctcttgaatcatacccctaaacctgtggtccagaatcagtaaactggaatcaagaagcagtagctgctgccgccagaaccagcacccagttaagtggaggatggaaccaaaatgctcctgcagaaacaagtaaaggagacagaaatatggtctctgcttactttgatctaatctcatgagtcagcttctcattagcagaagctgaattgtatccaaaaccaagggattcttggaaatttcgtttttaagctttttaacctctacaattagagaaagaatagaatggaggctgcatgaactagcccaacagaatatttacaatactgacaccccattcccgtctcccctcccacccccaactttacatatgacgaacctaaggcccagaaagggcaagagacttgtccagggtcattcagtaaatgagaacattggattctctgactgctagtccagtggttctactgttgcttttactgttaggaccaactcctgtacaagaccagcaaaaagatcctttaagaaaaggccgcaggcacggtagctcacacctgtaatcccagcactttgggaggttgaggcggtgagatcacctgaggttgggagttcaagaccagcctgaccaacattaagaaactccgtctctactaaaaatacaaaattagccgggcgtggtggcatgtgcttgtaatcccagctacttgggaggctgaggcaggagaatcgcttgaacctgggaggcggaggttgcggtgagtcaagattgtgccactgcactccagtctgggcaacaagagcaaaactctgtctcaaaaaaatagaaaaggaaaaatgccatattcagaaaatggactttgccttccgtattctctttggagaaagggaaggagttatgaacagatatgaggttgagatttctagatttctaggcaaagttaatgatactacagcttctggatttagttctgttctccagaaggatataagaagcatttactctgaaaggaagaattctcaaaaactagaatgtcctgatattccttagtcatcatggatgaactcagttgttgtagtgacagtggctcaccttcacctattcccccttgccttttcttttgctgttggtgcttttctgtccaaaaagatcaaccaaaatccagaaaaccagcccccagatgtttggttgcttagctgtttcatgtctgcccttggggagacttgggtcttttgaacagaaaatgagccaagtccacccagaaatactatctttgtagaaaccactagggtcctttaagccaaggtgagaatctgtttcttcaaacttggcccagaggggaggacctgtaggtgtggagctatgttaacatatctggccaggcgcagtggctcacgcctgtaatcccagcactttgggaggccgaggtaggtggatcacaaggtgaggagattaagaccatcctggacaacatggtgaaaccctgttttagtaaaatacaaaaaattagctgggtgtgggctgggtgcggtggctcacgcctgtaatcccagcagtttgggaggccaaggcgggcaaatcacctgaggtcaggagttcaaggctggccaatatggtaaaaccctatctctactaaataatataaaaataagctgggtgtggtggcaggcacctgtaataccagctacttgggaggctgaggctgaggcagggagagaattgcttgaacccgggaggcagaggttgcagtaagccaagatcgcgccactgcactccagcctggtgacagagtaagactccgtgtcaaaaaaacaaaacaaacaaacaaaaaaaacaacaccatacctgataaatcaagcgtagaattagccctattgtttttttctttgtgtctacgacatactagaaagctgtgatgaaatcgatatgtattctgttgccatccctctggggaccagtgcttggtctcctaatccccctactcgatggcctgaaagtgtttcatcttccctgcctgttatcagcatagaattggttggtattgtgacataatctgattgccttgaggcagagcttacctccaagctgctagcttccttcccatttgacctttcccaaagaagctaagaatccatgccttgttgaaggtgggaactaggggttgaaggcttaatcttgagagtcagcgaacctgtcccttaaggccagctttgatgtgggaagaatattgaatattgtttactgagatggagatgggtggaggtaatttttcctgacattttggggaaggtaagagaaaccaaatttagactgaaagggatcagtggccaggtgtggtggcttacacctgtaatcccagcagtgtgggaggctgaggcagtaggattgcttgaggccaggagctggagaccaccaccctgggcaacacagcaagatccccatctctaccaaaaaaaaaaaaaaaaatagttggccatggtggtgcatgcctgtagtcctggctacttgggaggctgaggcaggaggatcgcttgagcccaggagtttgaggctgcattgagctatgcttgcacgactgcactccagcctgggtgacagagcaagaccctatctgaaaaacaaacaaataatataggtcaatgttcagaggaaccattatcaagaatatttggatttttatccctcttattttctagaacttgattatagctcccttgtgttcagagttgttcttttcaaagtcctttgaggttgtattctggtttaagattctatccatttctcactctcagatctgtttgttccaccctctccccctaaatatttggattttatatagaccagtaggctaaggtagggaagaccactgacaagtataaatttaagagtttacaaaaccaaggaggccatccagcccctagttctaagccatgttcagcacagtgccaactttgccttccctggctgtccttgcttgctttctggttgctgtaattctgaggggcaaccaggcttgctgtagagaggagagccagatgatgtggaagcctaaggcaacaccccctccttattacacttctcatacccagaactctgcttgctttctgtgttcctttcctctcactcccctttcctgccctctttactcaagttctaagattatagctgatgatcttcataatagaacaaactctgtttggttgaccttcctaacagggaatgcttggctttgagaaagtagggggttcctaacttctttgccttctctagctttacagtgctcttacttcctgctgggattagaacagccctattccataaatatgcactgctcttggctgctgtaactcaggcccagctctgacccagattcttttttttttttttttttttgtcagatttgagtctattaactagtgaccctcaaaacacttcatacatttttggccaaaaagtggttactgactggataagacagaagcctttggggggcagggtgactggtcgggcaggtaacatggtattatacaggcctgatggggactgtgacaaactgaaaagcagggtttcaaccagttagcggcctatgggagttccagaatcatcatcatcatctttttttttatttttatttttggaaaactctcggccaggcgcagtggctcacgcctgtaatcccagcactttgggaggccgaggcaggcagatcacgaggtcaggagatggagaccatcctggctaacacggtgaaacctcatctctactaaaaaatacaaaaaattagctgggcatggtggcgggcacctgtagtcccagctactcgggaggctgaggcaggagaatggtgtgaacccgggaggcagagcttgcagtgagccaagatcgcgccactgcactccagcctcggtgacagagcgagactccgtctcaaaaaataataataataataattctctggggtctgtgggtctgtccctgcagtgtcttgtggactgccccgtgtagctttggctctctcttggatttactccctttgagctggtgcctagaatttctccgggggtaggggacagctgtgaggagcaccttctcatctatcctttgccagttctcattgtgtttggtgtttgttttatttgtttgttggggggcggcggggagcgacaggggaaatgttgagcagaagcactcgatgtgattaaacctccggctgagcagatctgtaggagtagaatatcgacccctggaaaatcaatggctgctgcagtgacccagccgctgtttgcaggggctaccaccacaggaatgcaagcagcccagcagtctttcttctccccacctttttacctcagcagtgccctcagcctccacccagagggtcagacctgcctcaagagattttgcagaggtgggttagaacagcacgttctcgtattttcacaattagattgaaatttctccagtgacacagagccctgcctctggcagcctcctttccagacattccttttctgcactgctgcagttctagcaacagctcttaccaagttgccaaaacccattcggggttgtacttctgagttttaaacaggagaatcaattctcttgataccagcacccaagagcccctcccttgtggaggtctagaattcaggtactggggtataggatgggggaatagagattaagggaaagaaagaggactaatagaggttgtgtctaaagaggatgcttttgagtagataattcattgagcaacatttatcaagcatcttgtcgtttgtgtgtctggcatctttctggtcactaatagcctgatcttgctctggtcccacaggctagtggagaaaaagggcggatagaacacagtgccatcagtcctgtaacactgcttctagaggagcctcagaggaactctgtgccctgcctatagggtgagagtagggaactagtcctgtgacttgggtcaaaatagatggtttaatagaatggctagcagatctctgcttggagcatggaggcttctgattcctcactgcctccacaaaactgttttcatcttggaagttcccaaggctaaaaaacaattttagcctttagttgttgtacctataatgccaattctactctggtggttgggaaaccagccagcctgatgtgtgtgaaaggagagctcagttgccctattgttggagcacctctgtggccagagggttgaagcttgcttggcttttaaagcctctagaaaggagccttcccgtcttgtagcttggagagtggggtccctaaacaaaacccaaacatcctgcagtttggaagggtggctgcagtgctgggtgaggaggaaagtgtgagggtttgaagtggcctaagaggaggccatctagaggccaggaatatcttgattttttttttctctgtgagccacacccttgtgattgataaaaggcttagaacatattcagtttgaatacccagcagagaccaggctcctaccttcatgggacttctaccttcatgggacttctgcttgtttccctacattcaaagtcaccctccccacagccctctgtcctcttacacattaagtaccctacagaaaacccaggggtgagaaaaagtactgtaccctttaatttagcatagaaaaattaggttgaagttgaaggttatcagtgaaagggctgatttgaaataaaggctgaaagttatagcaagagtaattaggaaagaggggggccgggcatggtggctcacacctgtaatcccagcactttgggaggccgaggcgggtggatcacttgaggtcaggagttcgagaccaacctgatcaacatggtgaaaccccgtctctactaaaaatacaaaaattagccgggcgtggtggcgagggtctgtaatcccagctactcgggaggctgaggcaggagaatcactagaacctgggaggcggagattgcagtgagctgagattgcaccactgcactccagcctggaggacagggcaaaactccgtctaaaaaaaaaaggacaggggaacacatagcatcacagatttgtagagtttgattatctagtgtaagtctttccttcaataaaggagttaagtgagcctcgtgaggttagccagttgagtcaagtagctaatcacgcagcatgtctggtgatataggttgttggccttacctctattggagcatggaacccagcctttgatcatgtcaagcttctattaataccttatggaaagagtgtaaagtaataatggatttgaacctcaggtctatttaatagctgtctgtccttgggcaagtcacttctgaacctgcttctttgttaaaatgggggtaatacctatatcagaagatgattgtgaaaattaaatgagagtcaaccactcaccttagggttgaatatgtgatagtcacatattcatgtcaattctgcttcctttcaaaaggaatatataaaggaactttattaactttatctaacatcctttgtatttggagatttggtctccagagctttctttatgaattctgatgtgtatatagggagtttcctcttggagacgggcccctgaaaagcattctggagacaagaagagtcttaacccttctctcctgtgtcttccccgtcaggtggccaaaaggtatcaggaagaatgaatcattatcttcagaacaatagcctatgtagaaaaagagaagagggagtttggtgggggatttcatcctatgcaatggtttctaagatacaaaccaagtttttggaaacttgacgggggcaagtaggaaacacatttttctaaacctttcctggagtagtttctgctgttccaaaccatggaggtagtccatgtaggtgatagggcttggtcctacactaaaagggtagtgtcaacctctgcatcttttcttcccgttccttagtacctgcttaattaacttctgacctggaattaccaccgggtgtgaaaggcagcctattctgtgtgttgattctttcttggcatttcagttaacatcagcaagcctgctctctatgcataggtggcagttaatctgttggattgagaccactccgtggaataatgtcacagcagttctgtaacttttggagtccctaccagtctggggtgggtcaaatttctctttcttacatttatagcaaagactaaggagaaaaaaagaacttatgactgaaactttattgtacaagtgttcagtagaggtagtcccttctcctctgctaccctcaacaagttgttgcttaaggaaggttttatgaaaagccaagtctcccaaaaacttatttgccttaagtaattaattttgtctcagtttttcttccttagagtttaaggctattgcctcctctcctaccttttccttttcttcatgggttatgtttcccagtctcttctgtgttcttcaggatttcctcccattcttcagcatgagagcagcctaggggcggggcggggataagggactgacaaattactagtgtagatttggtcattatggaattttttattcaagtattgtcatttaagtggggatggctgagctgcaaggttcccagtgcacacacttactacaggcatgtgcgtaggatttacctggttctcatgacgggtggtttacctgccagtatcagcacaactcagcaaaagcttttcccaactaaatgggtacaagaactccatctgggattccccaaggatttagccagatttatgggaaaaccctaaatctgagcattgccatgagcctattctttatacttaacctgttgccatttaacctgctcagcaaaatgaactgatgtcatcctcatgtggctctattgggagataatttaaacttccctcctctaaccctgatctggtgtcttcctgcttaaaaatattcttcagtgggcagccaattcatcttagaacttgcagttcttcctgtgagagtaccagcacccccaccgtccctaccccacaaaataaggtatggactgtgtgatttcaggcatggttttgttgtggtgtgaagagaaggtgtttagctgctgagttctgtttgttagcagagcctgacaaactcatgctggcactcactagggctgggcaaccaatcacagctgggacggttatcgtcatggagtccctgtgggcttcctctatcaggtcacatcccaaaataacactgggcagtatttcaactgaagaaatgaaggctttcagggctgtagccagcctggagtgtgagattctgtgtgaaatagttggatctgctccagcgcttttgatctgcatggtagatgagcaataaaatgcacaaaacacattggaaacacgtgaggaaattctcctggccctgctgcttccttggaactggtagggcactgagtgggctgatcctcacctcccatctctcagcaggattatacttggaggagaacaaacccgggaaaagaaatcttcccattaaaggggcattgctacagttatttccgcagtccttccagaagatgcctgttaggtgtgctcttttgggagaattgagaacctgagagtcctgagatgccaagggcatccctcaccagggagaataggggcttggattgcagtggcgtgatctcggctcattgcaagctccgcctcctggattcatgccattctcctgcctcagcctcccgagtagctgggactacaggcacacgccaccacgcctggctaattttttgtattttttagtagagatggggtttcactgtgttagtcaggatggtctcagtctcctgaccttgtgatctgcctgcctcggcctcccaaagtgctgggattacaggcatgagccaccacacctggcccgactgaactttttattaatgataaatgtgttgtagaaaactgaactgttaggaacattgaggtctgactcaacaatcagacatctggctttttgtggaacaaaagacctgaaaaactggctttttgtagagtagaaagcagaggtgtgtcctgtgtaataaaaggatgtggagctgagagcaatatctgttcatgtagatagaggggcaggacatcttttggagacttctgcccttaccactccctcccatttcccaataaaaatatttactatgactagccactgggactggtgggtatgtcttagaacttatattgctggtatgttgttatatctctcattccagaatattgctgctggtcgtttgaccctgaccatatggtgctaggggggattcatgcatatgccccaggggtgtcatagacttagatttatccagccccctctgattgtatatgtgagaaaactgaagcctgacttgttgccagtttgcctaaggtcacaactgataagtaccaaaagctgggccttggtttcctaactcagaggcgtgacctttctcctcagttcatatagtgtcacaacataatggagagagaaagccagcatggcctatggggttcagcagtcccgggtttaaaatctggcttccaccacttgccagatgacctaagcatgtaatccaatctctttaggcatcagcttcctcatcttcaaattggtaatgtggctgggtacagtggctcacgcctgtgatcccagcactttgggaggccaaggtaggaggattgcttgagctcaggaatttgagaccagcctgggcaacatggtgaaaccccaccactacaaaaatacaaaaaaaattaaccaggtgtctgtagtcgcagctactctggaggttgaggtgggaggatggcttgaacccaggagacagaggttgcagtgagccaagattgtgccactgcactccagcctgggtaacagccagaccctgactcaaaaaaaaccaaaccaaaaccaaaatggtaatggtagtagtatctataaccaagacttgtagaaaattgggtaactttgctaagtgtctggcatatagtagatgcttaaatggtagctgtagttaatcgtaaatgatttacccctttctatgctaacattttggctcttaaaattatttgaaaccaactatctgatgctgaccagttgccatctaatgaaaatgacagtttgagaggttggcctcaagccaaccaaatcagagagataagaagattaatgctcttccttccctagtatttttctatacccaggcatcccagccaggtgggactactgttgacagtggtttatttagcactttttctccaagaagctcagggcactttaccaaaagtgacagctctcctgaagaaggggaagccacctctttgccagccacagatgcctccagagttctgagaccccagccccaagagctacagaggttttctttaggctcctaggatccctcaggtggaccaggggcattctccttttggatctatggtgagcctggttttttaactgaaagtgtggctgaaaggacctcctcagttcttgccctgagctgataggagtggttggtgggttttggttttttggttttttttttttgagatggagtctcgctctgttgcccaggctggagtgcagtggtgcgatctcggctcactgcaacctccgcctcccgggttcacgccattctcctgcctcagcctcccgagtaactgggactgcaggcacctgccaccacacctggctatttttttgtgtttttagtagagacagggtttcactatgttagccaggatggtctcgatctcctgacctcgtgatcctcctgcctcggcctcccaaagtgctgggattacagacgtgagccaccgcgcctggccaagttttggttttttgttttgtttcttgttgtttgtttttgtttttttttcttagcgcttcagtacatgtccaaagatacacaccaaggccaggggcagtggctcatgcctgtaatcccagaacgttaggaggctgaggagggcagatcgcttgagcccaggagttcgagacaagcctgagcaacatggcaaggccccatctctacaaaaaaatttaaaaattagccggggggccaggcgtggtggctcatgcctgtaataccggcattttgggaggccaaggtgggcggatcacctgaggtcaggagttcgagaccagcctggccaacatgttgaaaccccgtctctactaaaaatacaaaaattaactgggtgtggtggtgcacgcctgtaatcccagctactcaggaggctgaggcaggagaattacttgaaccaaggaggtggaagttgcagtgagccaagattataccactgccctccagcctgggtgacagacccagaccgagaccctgtctctttaaaaaaaaaaaaaacaaaaaaacacacacaaaaaaaaacccacaaagatacacaccaaattgaacagcggtttctctattgagggcaacagaaagacagccatggggcactttggcttcacctataatagctgaaatgtttttttttttcttttttgagacggagtctcgctctgtcgcccaggctggagtgcagtggcacaatctcggctcactgcaagctgcgccttccagattcacgccattctcctgcctcagcctcccgagtagctgggaccatgggtgcccgtcaccacgtctggctaattttttgtatttttagtaaagacggggtttcaccgtgttagccagtatggtctcgatttgctgaccttgtgatccgcccgcctcagcctcccaaagtgctgggattacaggtgtgagccactgcgcccggcccaatatctgaaatgtttttatcatgagaatgtttatgttttacttgtataacaagacacaaaaatgatcaaaacaaaacatttaatttttctaatcccagctactcaggaggctgaggcaggagaatcacttgaacctgggaggtggaggttgcagtgagctgagatcatgccactgcactccagcctaggcgacagacggagaccctgtctcttaaaaaaaaaaaaaaatgctgaggcgagcggatggaggtcaggagatccagaccatcctggctaacatggtgaaaccccgtctctactaaaaatacaaaaaaaaattagccgggcatggtggcgggtgcctgtagtcccagctactcaggaggctgaggcaggagaatggcgtgaacccaggaggcggaagtcacagtgagccgcgatagcgccactgcactccagcctgggcaacagagtgagactccgtctcaaaaaaaaaaaaaaaaggaaataaaaacgcacaaagatacgcaccaaataattgaacagtggtttctctgttgagggcaacagaaggacagctgtggggaactttggtgtcggagactttggcttcacctgtaatatctgaaatgtttttatcatgagaatgttcatgttttacttgtataaagacaaaaataatcaaaacttttttttttttcttgagacggagtctcactctgtcacccaggctggaatgcagtggtgctatcttggcacactgtaacctccacctcccgggttcaaggaattctccctgcctcagcctcctgagtacctgggattacaggtgcccaccaccacgcccgggttttgccatgttggccaggctggtcttgaactcctgacctcgtaatccgcctacctcggcctcctaaagtgctgggattacggacatgagctactgcgcctggccaacatataatttttcaaagcgatttgaactgaaccaagttctcgtctgatggatggatccctgattcctattctgttctgaaatacacttctttttcctgtaagcaggaaagttcttattaccagaagctggcagtttgataaggaatggagactgtaggaaggagtgggtgagggaaccttctggtccctaaaacagcattgagctgtggaatttgctatatagactgtagggcctaacgagtgcttcttgagaccctttctacttacagtggctctccttgtcatcttgctgcctcttttagtttgttcttggctcagaggctagatgtccatggtataacttagccatcaaaacagggatggggctgggcacagtgactcatgcttatcatatcaggagtttgggaggccaatgtgggaggattgagcccaagagtttgagaccaccctgggcaacatggcagaatcccttctctacacacacacaaacacagccagacatggtggcgcctgcctgtacacacacatacagagccagatgtggtggtgcgtgcctgtagtcccagctactcaggaggctgaggtaagaggatcacttgagttgggcaggttgaggctgtagggagctggcatcatgccaatgtactgcagcctggggtaacagagtgagaccctgtctcaaaaaaaaaaaaaaaagaagaagaagaaccaaggatgtaatccctctatcttgggattaacatggggctcttcatagctccaggtactttagtccttcgagaaaggaggatgtcctttgctgttaccttgtggttggcctcttgaaatcattctatgctggaacgaattctcattgcatttttaaagtatgctatggcatacctggcctacttcttaccaacaagaaagctagcattttctgacttctcagctaacatggaaagctggacacaggcacaaatgcacacctacctacctgccttcagagcaaactttgtctccaagagctcagcagaaatgctcccagcctaatgaggtacccaagtggtttgtggaaggtccacccagcttggatacttgaaggagagcctaaaagctgccctctgacctccagtgttactgtcagatctcagggtcaaagtcactttcagccgatctttcccgggtgagcttgtttgtgtgagcaggaatagactcaaatcaaaccaacttggatctcctcctccttgagatgtgtggtgttttcggttttgtttttgtgtgtttgtttgtttgtttttgagatggtgttttgctccgttacctatgctggagtgcagtggtacaatctcggctcactacagcctcctcctcctgggcttaagtgattctcccacctcagcctcccaagtagctgggactacagctgcacaccaccacacctggcttatttttgggggtatttttagtagagacagggtttttgccacgttgcccaggctggtctcgaactcctgggctcaagtgatctgcccgcctcggcctcccaaaaggctgggactacaggcatgagccactgcgcgtggcccagtgtgtttctttaagagaactctttatttaccatttaagtatcagggttttcatcctttcttcaattacagttagttcccagcctgaagtaatgttgctagagaatgaacatggggcaggggatggagttagggtacattttctggggtgaatatttttcatattgagctcctgtttgctaatactggagtttgttgacctagagtgaactctttattgattaactgaagacaagcaaagcctacaaacaaataccaagttctcactgaaaaacataaaagctgggaaaaaaacagaatttgttcaattggcaaacatttgttgattactgttatagaccaggtgttaggagtgtagtcccagaccttcttggcagttaagaaattgtctttctcatccaatgtctctctttcttacctcctaccccttatgttgcaaagtatggtgacttggagtgagtccttggcaaatggaggctgtgataatctatagtaataatcatcattgtaatatataatagaaggagaggggatctataaatgtttcccaaacttgttaacattctcttgtagctcctggtgccatcctggcagcattttgtaaagttttgctattagaaaagaactaaagcctcactgaaatagttgctttcttatgactgtagaagttatgactgggaaagaagacaaaagtgctagatctgcttctgaggggatagaataggagtcagcaaaactcagtcacaccattgtttgtatattgtctgactactgttgcactatagtgtcagagttgagtagttttgaaggaggctttatggcccacaaaggtctaatatatattccacctggtccttaacagagtttgccatatgtaagttatagtatgatgactagggccgggcgcggtggctcacgcctataatcccagcactttgggaggccaaggagggtggatcacctgaggtcgggagttcaagaccagcctgaccaacatggagaaaacccgtctctactaaaaatacaaaaatttagccgggcgtggtggtgcttgcctgtaatcccagccactcgggaggctgaggcaggagaattgcttgaacccaggagtcagaggttgcgatgagccgagacgtgccattgcactccagcctgggcaacgagtgaaacactgtctcaaaaaaaaaaatttttttttttaataaaaatagtatcatgactaaagaacgtgtgtgatgtatttgctcttggttgtttaaggaaaatgctaagcaagtagtaggattattgaaagtagaatctttctgcctaatattactaatccatgttcttatatatatgttctaggatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggtaccctcaagtgctgggctttagggagagggaaaggtgactgcccccagtaatattaaggagccctagtcttccactggcagagaaagcatctctggctcatgcctgcatagtttccccttagcatttggagaaggagattggaacctgttggctggatctctttgtgtgtgatactgggaggtacttggcctcttcatgagccatttctagctctgaattaacttcctagttagaattcccaggcttagccatgatatgcttatgttgttctttgtctggagcaggcaaccagatgccacctcggccacccagtggccagtcggacagcatcatgcatccttccatgaaccaatcaagcattgcccaagatcgaggtgagagcctgggtgttggggaggggcagggagctagggcagacatttgagtgccctatgcagtagcttttggagagctgtttgaccatgaagcttaggacaatccctgcagcaaattgtttttatattctttaaaagttgacgtaataattgtactcatttatggggtacataatgatgtttcaatagaagtaacgtatagtgatcagatcagggtaattagcagatatataatctcaaacacttattacttctttgtgctgagacccagcagcaaattgtgaagttagagtgggcttggccgtgttaatgtctccatttcacagtacttgtctgtgttttgatggttgcccccttacattttgcctcatttggtcggcagttgctgaagactcaatgttcggtcttcactcatcaagtcattcattttggtttttgtcattgttctttgtcttttcaaacctccatttagtagaaacagctggcatgccctggttaatggttcatgtcactctgaaggtgcctaaaatgacacaccactatatagaaaatcagatagagactccatgcaagtggctgctaaagaaaatgtagatggtaaagtcccaggataaggatggagagcatttgttcgcattgtataaagctaataactatatggatgctacccacaaataggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtcagtatactacccagttaggagtagatacgggtgagaggagaaaacagttccttgtctgatatgttgccatctagcttgtaaccttgtgagagaagggctgtcctttgcctttaatccacccagcccaggccctgaagtagggcaaggcaagattccatttgtctccacttattctgtcaccatgagaaagtctttcaatttcactgagcctctgtttcatttataaaaatggagattaggtgtttactccaccattgagcacagacaatttatacatggtagctcttggttattatttttttattaattatttttagtgaataagtcataatggaatagatctttgctcaaaattgcagccctaggctgatcaaaagttgagaatcttacacagagcatggaaatagaaaggaagttatcttcttctggaagttgaaatgcctgtgtggcagcaaagccagccttgctctgacctgcctttacatgcttctggaatccccccctttttctcatggcgataaaggctaccatgaagttgatctctttcctaaccaaaatattgaatgacattgtttggtgttctagagttgagagatattagtgagttgctagtgagtgactaaccaagtcttgtcttcctcccctcccaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggtaaggcctgggaagcagagagggtgtcagtgcaagaaaatgtattatagacccactcagattattgagatgcttctggacctaaaccagggggggaaaatgggtgtgtgtgtatgaagtgttaattcttacataccttagatgggtctgaaatttcacgtgactaaacatcatatgtaatgagctttataaaagacaggtttttggccgggcgtggcggctcatgcctgtaatcctagcactttgggaggccaaggcgggcagatcatgaggtcagaaatcaagaccagcctgatcaacatggtgaaaccccgtctgtactaaaaatacaaaaattagctgggtgtggtggcgcacgcctgtaatcccggctatcgggaggctgaggcaggagaatcacttgaacccaggaggaagaggttgcagtgagccaagactgcgccaccacactccagcctgggcgacagagcgagactgtcgaaaaaaggggttttgtggggtgttttattttggggtcttttgagacaggaccctgctctgttccccaggctgaattgcagtggcatgaccacagttcactgcagcctcgacctcccaggctcaagtgatcctcccacctcagccttctgagtagttgggactacaggcacacaccaccacacccagctaattttttttattttttatatttatttatttatttagagactgtctcactctgttgcccaagctggagtgtaatggcacactttcagctcactgccacctctgctttccaggttcaaccaattgtcctgcctcagcctcccaagtagctggtgttacaggcacccgccaccatgccctgctaatttttatatttttagactgggtttcaccatgttagccaggctggtctcaaaatcctgacctccagtgagctgcctgccttggcctctgaaagtgctgggattacaggcatgatcccaccatgcccggccttttttttttttttttaaatagagatggggtctcagtgtgttgccagggctaaagactgcttattttgatgtgcaaaataagtgttcagagtaggtggtttaacttctatcagtcaactttttggtttccaaaaggattcttaatgatacatatgtcttggatctttggtgttagaaatagcaaatggtaagcttgtggtttgccatttctcctactgttttatgtggtcctacgtgttgactctggtgctagagtacagaaggctcatgtgattaggtttaacaacttctttagccactaaatcttactgagttgttgttgatgaaccaaggtagaatagggcgattgactataaagaggtggatttggtagaacttcagaatgatggaagtgcaaagtttgcattgggcccctcaagaaataatgcaaagccacctctgggtgctatgctgagggttccagtctggttgggatttagcatgacaaaaagtggtacagttcagcatttcatctatgccttttgccacagacagggcccttaaatggaaatacaacttgactttggaggtggctttgaggaaggcagtacttaaaggacacagcagggctctgcttcaaagaattacaccctttgaaattgagctattgtggccgggtgcggtggctcactcctgtaatcctagcactttgggaggctgaggcaggtggatcacctgaggtcagaagttcaagaccagcctgcccagcatggcaaaaccccatctctactaaaaatacaaaaaaatagccaggcatggtggtgggcgcctgtaatcccagctactcacgaggctgaggcagaatggcttgaacctgggaggcggaggttgcagtgagccgagatcatgccattgcactccagcctgggagatgagtgaaactccatctcaaaaaaaaattggccgggcatggtggctcacccctgtaatcccagcattttgggaggctgaggcaggcggataacgaggtcaggacatcgagaccatcctggctaatacggtgaaaccctgtctctactaataaagtacaaaaaattagccgggcgtggtggcaggtgcctgtagtcccagctacttgggaggctgaggcaggagaatggcgtgaacccgggaggcggagcttgcagtgagctgagatcgcgccactgctctccagcctgggcaacagagcgagactccatctcaaacaaaaaaaaaattgaactattgtttgctatctagagcttgaactctcttagtatctttcgtgggaggtagaagataagaaaatctgggtgttggccgggctcggtggctcatgcctgtaattccagcattttgggaagccgaggcaggtggatcacctgaagtcaggagttcgagaccagcctgaccaacatggagaaagcccatctctactaaaaatacaacattagccgggtgtggtggtacatgcctgtaatcccagctatttgggaggctgagaaaggagaattgcttgaacctgggaggctgagattgcagtgagccgagatttcaccattgcactccagcctgggcaacaagagtgaaactctgtctcaaaaaaaaaaaaaagaaaatctgggtgttagctggacatggtggtgcatgcctcatagtcttaggcactcaggaggctgaggaaggcagattgtttgagctcaggagattaaggctgcagtaagctatgatcacaccactgcattccagccagggtgccagagcaataccctgtctcaagaaaataaattaaagaaaaataatatctggatgttgcatagttctagttttggggacccataaatgttttccttttaatccttactagatgatcacacagcactatttggctccagttcaaatctaaaagctcagagtctaacctttgtctctctcactttccatcttcttccttaggccgccaggctaccccaatatgaatcaagggggcatgatgggaactggacctccttatggacaagggattaatagtatggctggcatgatcaaccctcagggacccccatattccatgggtggaaccatggccaacaattctgcaggtaagtgctagtcattctcactagggatttcttcaagagtcacatcacagctaaacttactggacttgagaatttttttctcttttacagggatggcagccagcccagagatgatgggccttggggatgtaaagttaactccagccaccaaaatgaacaacaaggcagatgggacacccaagacagaatccaaatccaaggtagtgatttttgtcttgactcctttcaactttgtgtcctatctttttcagtgataggaaggaaaaagaaaagagagtgacaagatcccagccttttatgacaccggactagatagtctctgaaaaagctgctgttgcctcctcttatcatgaaaggtcccagaataatagctcagtgagttgggtctgggttggtctaagggatcctggtaaataacataatattctcacagctgtttgttatgggggaaatgccagacactgcagcatcaaactctctgtactgtttggctggtgccctctgtgaaaccgtgcctcctatactcaagcattgatagatggggtgtgccatgggcaactagttgctcttctcttcctgaaccttactcatagcagcaggaatggtaccctgtgttctgtaaagaaggagataaggcagatgaggcttgagtccttggcttcccttaggttggtcctgggtgtactgttaggctgtgcggtagtaaagggtcctactcagcatttgggtcatttgtaatatttctgtccttggccatacctcactttccctatctgtatacatagggaaaataaaaatcatagctgttaattcctgtgagtcttcacctctggctcccagcccttttgaccacgttcctgtcttgtacaggataatatccaaagcccttcaaccaggtgggaaacctttcctttgtttagaagaggcaaagagtttcttttcattttagtccatcccattgcctcaagatcatgttgtgagtttttcgatttctctaaaacatagtacctaagtatgttcaggctcctgggtagtagtgtgggagcagtagtggctttgatgtcaggtggacaaggatttgatactcagcctgccacttaaaagctgtgagatcttaggctttgcctcctggtgcctgcttccttatctttacaaatggggataattttataatacctaatatataaaggcatctagcacagcacccagtacataacatatatttagtgttagcttccttcctttataggaaaaaaaaatttggttctcttttggcccttcaaccttatgaaggtaggacaggtgttagtaaccaccccagagtaagaagctttaacactgctccagtcaagagacttctgagacccttagcacaggctttgaatctgacccattcctatgaattttgacctgaaccttccagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtgagtgggcgcctgacacttgactgcccctgtggtttccacaaacccctttctaggtactcactggcttcatgtggtaccatgcatcccacagggacatcatcccctctcccgctttctgagtctaatattgatagaccggggagcacaggtttcccagaagataaggcaggaagcagagacctccctggtagtatgaggtattagcagtaagtttaccgtgtatctatggtcccactgaggtgtaaagctagggaaagtctgtgggcattctgattccatgggaggcaatttggcatagtagcaaagacaggatttggagagatggacctggttttgaatcccttcttggccacttataacatatatgaccttaaggtgtgtaaccactctgaaccttaatttcattatttgtaaaatacaaacagtatgtaacagtatataacccactagactgtcaaaagttagaaataactttggctttcagcaaggtttctgccacataaatcggcctgcaagatggtacagaggcagccagagtagaagtagatcttcccattcctggaagcttcccagtagagataggatttcaggaactgcttagtagaaatagtttataataaaggaagaagtagtaggaaattatgtgtttagttattctgtatgggaaacttaaatgaaaacctgaattggacaccacccagagcttgtgcctactctgataccttacaattttgtagactcagcccaggaagcaaacaggtgaggcagcacagacagacagcagactgtgccttgcagacttccctcctgtgtatgttctgtagtcaccagaccagaagcctgctgttggatcagtttgtggctgagctcggggaggtgtggcagggagggatttattccaaaccttctaaatcagaagaggaaaacagctgtcaccagcagaaaagaaagtggttggaatgaagccagccaacagtcagttatgaattccttctcccttcaggctttattcccctcccccacaaaggaaaacaaaacaaaataagacacgtgcatactgccacataactggcatgagaagcaaagccacggaaggcttttgaggtgactccatgcatattcctgccattctccctgatactcagatctcatagtcaagccttccctgtctatagggaaagggagcattgggttaggtttcgctcacttctgattgggtgggcttcagggttcactgaacctaggatgaggtacagagagaattctaatgcctgagcctgtcttccagattggaaaaggatgcaaacctttaaaatgccgtgattgtaactgaacttttataaaggcagtgataattcaggggcaaaagagtgctatttataagttagtttgtgaaggctccaagaaagcaaagctgaatcttgagcttatctaaaggattagtagggtttaggtggaagagtggccaatccagtagactggcctagatgccacggagatgggagagagtctagatatttcccaccaaggccatctccaaccatgaagacttagctcaggtgttacccactctaagaagtattcctagtcacctctgcccctctaggttgtccccctctgtgcctctttaaactcttctttctagtatcataggtatcatatcagcagacattacaacctattgaacttcctttgtgtatagggacttgaaaacccttgttcccaggccttgggggaacaggcttaccatatggtagatgaataagcataagaatacatgaagaaggagacctgtccagctagagcagaaagactaattgtagggagcatctggggaatgggcttggtcagtgtgccctgaagctgagggaaggaggcagaactgtaggttggctgctcgggaggtacaaaagtcataataaggccccgggccaggcgcagtggctcacacctgtaatcccagcactttgggaggccgagacgggcggatcatctgaggtcaggagtttgagaccagcctggccaacatggccaaaccttgtctctactaaaaatataaaaatcagtggggtgtggtgacaggcacctgtggtcccactacttgggaggctaaggcaggagaatcacttgaacacgggaggcggaggttgcagtgagccgaaatggcgtcactacactcgagcctgggtgacagagtgagactctgtctctaaataaataagaccctgaacacccggaccatcaggacagtgactggtaagggaaagggacctgtggttatttgtcaatgagatatgtaggggagcagtggcacaagaatgtcaaatttgcagggagccaccaccccaagaaaaaaatatgagtaaatcccaagtttgacaaagcaagtcaagcagggtggtcactgatattatcatgagtctccattttataaaatgttagtttttattagtgcatctaaaataggatttagggccaggcgcggtggctcacgcctgtaatcccaacactttgggaggctgaggcgggtagatgacttgacgccaggagtttgagaccagcctgatcaacatggtgaaaccccgtctctactaaaaatacaaaaattagccaggcgtggtggtgcacacctgtaatcccagctactcgggaggctgagataagagaatcgcttgagcccgggaggcagaggttacagcgagccaagatcacgccactgcactccagcctaggcgacagagcgagatttattttttctgtctcaaaaataaataaataaaataggatttagatatccagatgatttgtacaccactttttagcagcgtactaaaaaaccggactctgaattctgttccagtagtaatgtgaaatttgccctgttgtgaataagcacagtctgatagttgcagtggaacatcctgagggtaaaatgaagccagctgcagatttaacacttcttgtggactatccaccaagcaagattaactttttcaattacctaagaactgtggttctacaaagatgaataccttacagcctgatggggcttggggcttatgggcaggaaaaccaggcgggagatatacctcgactcctttggtttggttatacaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctggtaaggatggggtcagcggccccaccaaggctgagagggcctgttgccctggcctcttattcaggatatgaataagaggcttatccaacaggatatgccaaggatctgtgctctgccttgccctaccacagggcttaacaggttggctgactagagagtgggcagtggaaactcccttgggaggtactctacggcagctcttaagttttaatttttgttgtgcagctgacaacttgccaaatgtttgtaaactggtgaatgggaggggcacaagaggagtcggtggaacttataaatggcagcaaggcagggccatctgggagctttggcctattgatgtcagcaccttagaatgcagctcagactagagccctgaattccccagggagctgagatggtaatgaatgggaaggagggagtggggaagggttatgaatggaactccctgatgggagtggctctgctcaccctcctttctgagaggaggctgaggcctagggtgagcctagagagggaagaaggccagggtgcctggaaggtgggtgtaaacacatgtgccctggtgttgacctctgagggtgtaatgagtgcctgagatgactcatcagctggggaggcctcagcagtgggatatctactgctgggaatggtaactattggaaacattaattactagtagttttgtactcatcagcttagaagaacatttgaagttgaggagtgacaccatgctggatgctttagaacaggagctcctagactcctaaaatgcatcccagatttgggacccccttcccacccaggacttgggaggctctgactggagctcatgcaccagcattacagggtttagtaggttagacaaggtcctttggcggagtgaagagaaatagccagggaagctggcaatgactcagggaatcaccagcatggtgatgtcatggccacatcactcctcttttctacacgtaaaacaaaaacaaagagctacaaaaccctcagattcccgtctttatgacctggccttgtagatcctctgctaagaagggtgatcaggctttaaaggccttaggaagaactttcccaaagagattctgggtcgttcgtgtgtttgtgtgagagttaaacactgtcatgccaagcaaactactcaacttgtatctctgtccacagcgggatcaggatctatgcaggggccccagactccccagtcaaccagcagttccatggcagaaggaggagacttaaagccaccaactccagcatccacaccacacagtcagatccccccattgccaggcatgaggtaaggccaagagcaggggcagatggttgggaggatggctgaagataagtgcatgggaactccttgcagcccaaggtggtccttgcctctgccttcccagccagtgactcctgcgtgtcctttgttatattggaggaattggtttatttgtggtttacttggttttcctcactctggagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaaggtgactgatctgattgctatttgaacttgtgctcgtaaagacagggccagtgaaatggggggaaatcttgagaatggctcagggttcttgtggagccatcctctgagataatgcatttcctgccctaactacccctcttcatccttacctcctttcttgtcttctccttggcttcaccttgtcatcccttaataagtacatgcttttcgctggttggggcctctttagatctctgttttgaacttgtctggaaaacaatgagatcaaacctgaactctgaagagggcctgggtcaaagggtagattaccaggcttgtcaacttaccagtttgttcaccgcttgcctttctacgctcagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggtaagcatgaccccagctcctgtccactcccccagcaccctgaagctatagtgggctcaatctgcctctccaattttgtttaggacggagcctggaatagggcctgagggaaacatgagcactggggccccacagccgaatctcatgccttccaacccagactcggggatgtattctcctagccgctaccccccgcagcagcagcagcagcagcagcaacggtgagtaaagcctggtctcggtgctgctatggatcaggcttcgccactgcccaccctaatcctgtgtttctttgcctcctatagacatgattcctatggcaatcagttctccacccaaggcaccccttctggcagccccttccccagccagcagactacaatgtatcaacagcaacagcaggtgaggagggtagctgggaatggactggcatgcaggttcgccttgaaaactagttagtaaactaatctaacgtgttgaagtctaagaagctcactttagatattttggcattcttctctcacctgactggccagtcctgcctgaagagccacgtcctcaatctcttctctatttggagttggaaggggctagaaatagaccttattttgatttttaggttttgtatatttttctacttaagcaagggaagggaagaaagagtggtggttgcttttggaaacaacttcaaaagacaatttgttaaggtgattcccatgttttcttggagtctgtgtccaccaagcatctggttgtagccatcttggcatctgtgggctttatgtccctgagtgcagagtattaacttcccctctgcttgtctctgccttagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggtaaggagatcttcctcattcggttgcctaatctgcccctttccatcttgtccattgttccctccaccttactattctggatgaggttgaatctggtccagtgttgactaaaatagaaccaaagaactttggaaaaggaagaaataagctaactaaaggttctccttcattgccatgcaatgaagtcctagacagacagcttagaagccatgaggggctggtgtgtttcatctcccagacagaaactgccttccaccttgtgttatcttcagagtagcttcactgatggggcagccctaggggtgcctccagccaacctgggcttggtggatagacgacatggaggtttatttcaggaaccccggaggcatggcgggtaatgatgtccctcaagtctggtctcctggcagagagcacatgggcattagataccatcaacatcctgctgtatgatgacaacagcatcatgaccttcaacctcagtcaggtgagtatcagtgcctggggaagattgagagggtttgggatcttcttagtgtagacaatgggaatgtctcatctttagccaccttggtctttctctttctctcttgtagatatcttccatgccagtactttgcttcctttgcctctgggcacgggcccaggattttgacagcaataataatttgtttacatgataaccttaacacaggattgacttcaaaaggaatttgggagacactttgtggtattagtaagaattcagattcaatcgatgccagtggggacaccacattttctagaagaatctgtgtttttttgtttttttaatagagacgaggtctcactatgttgccgaggttcatgaactcctgagttcaagtgatcctcccaaagtgctaggattacaggcatgagccaccaggcccagcctgaatctgtggtcaaatttttatcagtgagcagagtatgttttttccatttttccctttcttctctgaacagtaggggcctttgttgatcccagttttccttagatgtagagtggatgggggatttgattgtttaacaatattcttttttttttttttttgactgagtctctctgtcgcccaggctggagtgcagtggcgctatcacagctcactgcaacttccgcctcctgggtacatgccattctcctgcctcagcctcccaagtagctgggactacaggcgcccgccaccacgctcggctaattttttgtatttttagtagagacggggtttcaccgtgttagccaggatggtctcgatctcctgacctcgtgatccagccgcctcagcctcccaaagtgctgggattacaggcgtgagcaaccgcgcccggccctacaatattcttacaaagctgattcttcagacccaccctccataggatgtgcacactagtggaggtgctggaaagagtttgtgctgcatcatcctactctttttcttttgatcatctttagtacctaccaacctgtatatcaaggagctgacttattaatagttaccatttatcgtgctcttattttgtgccaggtccttaatattttgtttcatgtcatcctagcaacagccctcagaggtaggaggtatggccatttagggatgagtaaataggctcagtcttatccttgttgaggttcacatagctgtcagtagaatctatctgat

SEQ ID NO: 12960 - DNA, 6482 bp, Human
caaggtcactcagctaagtgaagcaggatttgaacccagccagtctgactccagagtctgcttcaaggggacactgtgagaattcagtgagatttaaaaacatgaaaggaactttataaatttaaggattaagactaataatcaaatgaaagaggtgtgcctgtttgtccactggtgctcagctccacagaggaaaggggcagaaaaatcctcctaccgtatgccagaaaccacttggaatttaacaaccaggacctcattttgtccccatggcagccctacagccaggcattattgtcccagggaggcttatcgaggttcaaggatcaacccaagtcacataaccaaaaagtgatggattctggagcagatgccagggctagtgatgccagagcctctctctccccatccagggcaccaggctgcccaacagcatgcagcagaaggcttgccacactggactggccaaggtccaggaacatgacacaaccaagggcctctccaccttctctcatcccctgtgctccaccatctgagaaagatgcccgggacagaggagccacgtggcagcagagcaacacttctgcccagatcacaagtgggcaacgtctgcaaagcaggcagcagcaaggtgggggcagctagccacaagctctgagaatctcaggctctggctgtgcaattgggccagtgggtccagggaaacaaacaaggactttggagtcaggcaagatctgggctttgtcttcctggtgggatgaccttgggcaagtcactttagcttttttagtctcataaagtaagaatctagccttaggaagaggctgccaatattagagtgggaagtgcctgacacataataagtgcttagagaatggcaaccatatatatacatatatatatatatatatgtatgtatgtatgtgtatatatatatacacatatacatataaatatacatatacatatacatatacatatacatatacatatatatttttttgagacaggatcttgctctgttgcccaggctggagagcagtggcatgatctcagctcactgtaacctctgcctcccagtttcgagtgattcttttgccttagcctctagagtagctgggactacaggcacatgccaccatgcccggctaatttttgtatttttagtagagacgggattttgccatgttggccaggctggtcttgaactcctgacctcaaatgatcccccttcctcagcctcccaaagtgctgggattacaggcatgagccaccgtgcccggctggcaactatcttttattataattctgtgagttcttctcagcagacctggcctttcaggagtggtaggaatcaggctggggataaggattctgaaggaccttattcctgcagggggcccagaactggaatcagaggaggaggcctcctagattggacagtgggcaaagtcctcccagcccccagggtcctggctcccttccctgtagcctgcttctggctgacaacagaagcagggccccaaggttaggcaaacaagctagtgataaggcacttccaggttgggccttgcattcaaggcccacccagctctggggctggcttcctggcttagcaaaagccctagtcttttgtgcacacaagagcgggcaccaatggggacacctgctgattgtgcacctggggccttggtgccctggtacagcctgagttaatgaccttgtttatccacttgagtcatctgataaggggcagctgagtgagcggcaggtggccctgtgccctgcaccggccacttcattgactgaggtgatatcagtgccacgtggggttcccaatgccccctcccccaccacttccccaccattcctgccaggggcaatgtctgtgtgtttttttcaatgaacatgacttctggagtcaaggttgttgggccattccccccgttccactcactgggaatataaatagcacccacagcgcagaacacagagccagagagctggaagtgagagcagatccctaaccatgagcaccagccaaccaggggcctgcccatgccagggagctgcaagccgccccgccattctctacgcacttctgagctccagcctcaaggctgtcccccgaccccgtagccgctgcctatgtaggcagcaccggcccgtccagctatgtgcacctcatcgcacctgccgggaggccttggatgttctggccaagacagtggccttcctcaggaacctgccatccttctggcagctgcctccccaggaccagcggcggctgctgcagggttgctggggccccctcttcctgcttgggttggcccaagatgctgtgacctttgaggtggctgaggccccggtgcccagcatactcaagaagattctgctggaggagcccagcagcagtggaggcagtggccaactgccagacagaccccagccctccctggctgcggtgcagtggcttcaatgctgtctggagtccttctggagcctggagcttagccccaaggaatatgcctgcctgaaagggaccatcctcttcaaccccggtgagctcccagacactcctgggtggggggcaaggctgaagcaggggccagccagggaaggtagcttctaagggtttgatatctgttatctcattgggtcctcattttctttttatttttctgagacagagtctcactctgtcacccagtctggagtgcagtggtgcgatcttggctcactgcaacctctgcctcctgggttcaagcaattttctctgcctcagcctcccgagtagctgggattacagatggccgccaccactcccggctaatttttgtactttttagtagagatgggctttcaccatgttgatcaagctggtcttgaactcctaacccctcaggtgatccacccaccttggcctcccaaagtgctgggattacaggcgtgagccaccgtgcttggccagtcctcattttcatcaaatagccatctcacagaagaggcacagagaagctaagtgactagctaaaggtaacacagccaggtagggacagaccaggatggcaactcaggtctattcactccagagactggcccttgccactctgcctgagaaatttgctctgacctttacagaaggctgtggggaggtggggtgggcagacacagctgtgtctcagtcacatcctcaaaggaaggctgcatggtgaagctctagagctaaaactcctctgtgggttcagaaagatcacatagaagagatgactgaaaggggcgtagggaggacaggaaaggagtctttatggaattcggccaggagagcggcagatggagacagtgctgtttgtaatctggagagcatctgagatgagagttccccaggagtcccttgtggcacgcataaatcgtagtaattaattgtaataatagtagcaaatactcatatcacacttaccatatgttaggccctattctaagggttttacatatactagttcatttaaatctcataaaagcctaggagacaggtcctattaatattattattcccgttttacagataaagaaactgaagcccagagattaagtgacttgcccaaggtcacccagctaataagtgacagtgctgggattcatacccaggaagcctaattcttaaccattactccacactgcctcttcataaatggatggatgaatacattgaaaattgataaataaattacctcctctaaaggaggaggtagtagtgggacctcaaaggccgagcaaaggaggcagaggggtgtctctgatggcccagatcttgggccagtcttgtcctttggtggctgggagtagggtgctcaccagccctcttctccctctctgcccacagatgtgccaggcctccaagccgcctcccacattgggcacctgcagcaggaggctcactgggtgctgtgtgaagtcctggaaccctggtgcccagcagcccaaggccgcctgacccgtgtcctcctcacggcctccaccctcaagtccattccgaccagcctgcttggggacctcttctttcgccctatcattggagatgttgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgctccagctgcctgggaggcttttggtggtccccacagcctctgggccaagactcctgtcccttcttgggatgagaatgaaagcttaggctgcttattggaccagaagtcctatcgactttatacagaactgaattaagttattgatttttgtaataaaaggtatgaaacacttggagcctgatactgtcatttgtgcatatggaagggactgtctcacctccagggcccaccctgctgctatcagaggtagcccaagggaaaaaatccacagggttgctggagctaattttccagggaacagtatcagttcacaatcccatcacctcattgtctttatcctcaggggaaggaggttgctctcccattcccaaacccttcactaaccgctcccctggctcctacccacttcaggcgccctcttaccacagtgaaagcccaatcacagccaatcaggaagcagcccactcccgaattgaaacagacaagttcactgccatttctgtagtttgagatcattcacttcccccattcctgcagatgacaaaagagagtggtccattattttcccaaagggaagggacaagggtacccagggctggcctggcaactgcttgaaggccaaggcagaccaaggtttagctggaccaccaggatttgactacatcagttgtttaagtctgaaacccttccatgacacttggctcacagccaccaccctgaggcctccccagtttccttccctgcccctctgccccagcccctctcctgggattctcctcccagacattcccactgtctagcaactaaagaggcaactcttggcatagccatgacctccctgactgctccattcagaatatgacttgtgtctattctgactggtcaatatctgtgcctcactgtttgttaaatattttgacccagttgccatgggtcagggtgagtgacctgaagggtgggcaggaaggagtgataacaacacacatgcctataggattttccggcctccccctttcacccgcagtaagtcctgccctgaccagtccccaccctcttcaccataacagtttggattcttgtcacaggggccaagttaatgattgctcaataagaggccattcacttggggataacagtctaggcgtcatcattcaggcctttctctaagccccccaggttaggactatagctaattggcctcgtacccattatggtgacccagtgccaggagcaaggggaaccctgtcccttacccagcctctcactcacaagtcagacaccagatagagacaaaaacacagctgagatctcacacaaatacaaacaacacaacttggacaccccccaacacacacatactaagatgtacaactcaggcacacctacacagacgcataaaacagactctccaaccacccacttatagcccagaaaagcactgcccagatacagtcactcagcaatgtactgcagacccccacacagtcacacagcagaagcacgcacccttgcacctgagggtggggcacacagtggggagacacccccatgccagagtgtgttcatcttccctgcgtcatagtaaagggaaaagtggccccctaagtaggcagacctgtgtctgtgcatcttcaggatcctcttggagtctgtgagcccaggccaaactgctctgcctggcatttgggaccccagctaaccattcatcctctttccccctggtgacttcaatgtccctcctcctctcagctcaacaactgtccccaccaggacctaatcaaatccccaataaaggcatccttcagggcccagaacaagccctgtatccccccacctcccaccagatgccccaaactcagacctcaggcccccaggactctctctgacctgccctccccatccctctggcacataccaccccgtgtaaccttgtagacacatgagaccactctttcaagagcagaagccctgtttcccacataggacccaaatccagaagattcagggatttagggtcattctatatcttttatgccctaccagtttctgcctctattagttaattgccacatctctctgaatcctcaagctgggtcttcccacctcttacccttctccttctccggccctgaacaacctttaggaagcattcctctctatgccccacccta

SEQ ID NO: 12961 - DNA, 36618 bp, Human
gaagacggaggctgcagtgagcatagattgcaccactgccctccaaacctgggtgagagagcaagaccctatctcccctgccccccacccaaaaaaagaaaagaagttacagaagacatcatgatacttcatccctgaacacttcatcattatctttgtctcctaagagctaggacattctcctatctaatggcaataccgttatcacacctaagaaaatgaaaataattccatatgtaatatctagtttaaattgtaattttccctgttatacaaaatacatcttttctgcccattttttaaaatgtggattatgggccaggcacagtggctcacacctgtaatctcagcactttgggaggctgaggagggcgggtcacttgaggccaggtgttcaagaccagcctggccaacatggtgaaagtccatctctactaaaaatacaaaaattagctgggcctggtggtgcacacttgtaatcccagctactcaggaggctgaggcaggaggatcacctgagtccaggaagtggaggttgcagtgagctgagatggtgccactgtactccagtctgggcaacagagtgagactctgtctcaaaaaaaagaaattatattataatcaactttcacttatcaaatttggttttcatagctctctagaacagttctcatcctgcctccatattgcctttttggaatagtccaggccagttcttctatagaatggcacacaccctggctttaactgtttatttcctccttgtgttgcttgactagttcctttatcctttatttcttgtaaactgaaaattagatctgaatcttgattggatttagagtaaatatgtttggcatagagacttcattggtaggttgaccatattcccaggtttctccaggatagccctgtgacctgttgtgttggcataattattatttatttttgctctcagaagtgttctggtttggatggtacgttaagtcactatttataagtgacgatgtgtacttcatgtggactgccatcaggaggcccatccagttagattgatccactatttataacatggtgattacgtggtgattgccagatttcttcaacgtaaaggcatctttttctctttgtagttaataagcaatctgtgggatgataatttgagactaggaatatcctgtacccatggtttaagagtccattgacgaccctgaacagaataaattccacattagttgttacaatgctagatttattcagatggttaagttttgacaatgagatagatttttttttttttttttgagacagaatctcactgtgtcgcccaggctggagtgcagtagcgcgatgtcggctcactgcaagctccacctcccaggttcgccattctcctgtctcggcctcccaagtagctgggactacaggcgcccgctaccatgcccggctaattttttgtatttttagtagagacggggtttcaccgtgttagccaggatggtctggatctcctgacctcgtgacctgcctgccttggcctcccaaagaaagttctgggattagaggtgtgaccaccatgcccggcctttttttttttgagacagagtctcgctctgtcgcccaggctggagtgcagtggcatgatcttgattcactgcaacctctgcctcctggatgcaagcaattctcctgcctcagcctcccgagtagctggaactagaggcgtgtgccaccacgcccagctaatttttgtatttttagtagaaactgggtttcaccaggttggccaggctggtcttgaactcctgaccttgtgatccacctgccttggcctcccaaagtgctagtattacaagcgtgagccaccgtgcctggccagattattttttaatgggaggacaatgttttatttatttccgaacatcttaagatcctcaggcaacttaaacattggttacttgccttttccctattgtataaaatgctttttgttattgttcattgcagctttctctcctttgaaaacactaagaataatgtcactgcatcagtttttactagagccaatcacctgtcatgcctggaacagggatcgtactcgtaagtattttattaactttgcttttgtattttggtacctttggtacatttcatctttagacacatttagggctcacatatctcagtatcacatgtgcaaagaacatacatctattatatacattcagaagggaactaagtcagtcctttggtttacagatagataaactgaggcccagagtgaaggaagggctttgcagaggttacataccaagttcacatttagtcagagcactaggacctagaataagctgtttcagagacaagtggtttgctcctgagctactcagagcattattaactagtatttactatgttattcttagtcagcttgagtttctagttttctagctccagcaaactagaaagggatggagaatgctcttagaagtaggcacagttcagcaagcaaagtgacagataatatgacaagatgaggctgggtgcagtggctcctgcctgtaatcccagcactttgggaggccaaggcaggcaaatatcttgagctcaagagttcaagaccaacctgagcaacatggggaaaccctgtctctacgaaaaaaaatagaaaaactgtgtgtgtgtgtacacacacacacacacacacacacacatatatatgtattttttttttttgagacagagtctcgctttgtcacaaggctgagcatggaggctcatgtctgtaatcccagcactttgggagaccgaggcgggcagatcatttgaggtcaggagttcgagatcagcctggccaacatggtgaaaccccatctctactaaaaataaaaaaaattaaccaggtgtggtggtacctgcctgtaatcccagctactcaggaggctgtggcaggaaaatcgcttgaatccgggaggcagaggttgcagtgatctgagattgtgccactgtactccagcctgggtgacagggcaagactctctttctcaaaaaaaaaaataataacaataataattaaataataaaaacacagaaagagcaggattggggagaaaaagtccaatttcgcttatttttcttttgttgcttgtacttctgctgttgtatcaaagaaaccattgcataatccaggatcacaacaatgtgtgcctatgcctgtgtttccttctaagagtcttaaagctttagtccttttatgtaggactttggtccattttgagttaatttttgtgtatcctgtaagatagggttccttttgtatgtagatatccagttttcatttttttcttctttttttctgtgtttatttatttatttatttattgagacagagtcttgctctgtcatccaagctggagtgcagtggtgcaatctcggcttactgcaacctccgcctcccaggttcaagtgattatcatgtctgagcctcccaagaagctgtgattacatgcatgcgccaccacacctggctaatatttttttttttgagacgcagtctcgctctgtcgcccaggctggagtgcagtggcacaatcttggcccactgcaagctccgcctccggggttcacaccattctcctgcctcagcctcctgagtagctgggactacaggcaccagccaccatgctcggctaattttttttgtatttttagtagagacagggtttcacctgttagccaggatggtctcaatctcctgacctcgtgatctgcccgccttggcctcccaaagtgctgggattacaggtgtaagccactgcgcccggcccacacctggctaatttttgtattttcagtagagacagggatgcgctatgtcacccagactggcctcgaactcctggcctccagcaatccacctgccttggcctcccgaagtgctgggatatacttagtgggcatgagccaccacaccggccaagataatcgagtttttcctgcaccttttgttgaaaactatcctctctgttttattgccttggccccctttttgaaaatcaactgactgtaaagatgagagtttatttctggactctcaattctattccattgttctttatgtttatcctaatttcaggaccagtctgtcttgattactatagcttggtggtaagttttgaaatcaagaagtgtaagttccaactttgttcttttcaagattattttggttattgtgtcgcttgcatttccatatgaattttaggatcagtttgttaatttcttttaagacgtcagctgagattttgacagaaattactttgaatctgtagattcaccatctttttaaagcatttcagggctgggcgtggtggctcatacctgtaatcccagcactttgggaggccaaggcaggcagatcacgaggtcaggagatcaagaccatcctgactaacacagtgaaactccatctctattaaaaatacaaaaaattagcccggtgtggtggcgggcgcctgtagtcccagttactcgggaggctgaggcaggagaatggcgtgaacctgggaggcggagcttgcagtgagccgagattgtgccaccgcactccagccttggcaacagagtgagactcagtctcaaaaaagaaaaaaaaaaaagcctctgtattgggtaattgaaaatgtataacctagcaggacagtgaatttagagcatgtgttttgtgatcatctcacagagcttcatagccaactttcctatatcttctgtttccactttcccatctaataataggcttttggagtatttccaattatttttaatacagatgcaagctatcattgtcctcatttaaactacttgataaattcagcatattaagtcaacattttttgtgacattgtaatttgaaatttataacattttccaggtttaaatttggacttggcttttgaaatctctatatacatgtgagaaagtgagagaaatatataactatttaccagaaagcactcttaagtccttaggattttatagctagatatttacctagttccacagttttatctgtaaagcagatagatgtagctttcctaaggagggtaggaaagtgagtgtaggtggggactattaatgactggcctaaagtttggatcataggtcttaattttttttttttttttttttttttttttgagacagggtctcactctgtcacccaggctggagtgcagtgacgtgatctcggcccaaaatgcagcctctgcctcctacgatcaagcgattctcctgcctcagcctcccaagtagctgggactacaggcgcgtgccaccaggcctggctaatttttgtatttttagcagagacggggtttccccgtgttggccaggctggtctcgaactcctgatcacaggtgatctgcctgcctcaacctcccaaagtgctgggattacaggcgtgagccaccacgcctggcccatagatcctaattttaattttaagaaaccaataaaaagaaagaggggctgggcatcgtggctcatgcctgtaatcctagtgctttgggaggccaaggcaggagaattgcttgaggccaggagttaaagaccagcctaggcaacatagtgagaccctgtctctactaaaaataaaaattaaattcaattaaaaaaaaaacagatgaactagatggggtaaaaaaagatacatgaatacaggtctagtatcccttatctgaaatgcctgggaccagaattttctggacttacgatttggggatatttgcataatatatacgatttgagcactgaaaatttgaaatccagctgagcctggtggctcatgctggtaatcccagcaccttgggaggccaaggcaggcagattacctgaggtcgggagtttgaaaccagcctgaccaacatggagaaaccctgtctctactaaaaatacaaaattagctgggcgtggtggcgcatgcctgtaatcccagctacttcggaggctaaggcaggagaatcgcttgaacctgggaggcggaggttgcagtaagccaagatcgcgccattgcactccagcctgggcaacgagagcaaaacactatctcaaaaaagaaaaaaatgaaaatctgaaatccaaaatgttccagagagcattgcgtttgagcatgaccttttgagtgtcatgttgatactcaaaaagttttggatttgggagcatgtcagatttcagcttttcagattagggatgctcaacctgtatgagtttttaaaaagtccgttttgtgtattatattttggattagttcaggaaattactcttgaaaacaaagtattgtgatttatattggctttattgtaaaggagaatttcagtatagtttatcagcagaatcaatttttttaatataaactagtggttccagcctgggtccatgatagcagtaatggaagtccataacctattttcagtgtttcaaaaagacaaacagaaatttagatttagctctaataatattgcacaggtgaatgaaactgtcaaacatttttaccctgatctaaagttattttagctaagtacactaacattgtttatttttcgctggttagaatcattaattgacagttgtacgtgtctctgggaaaatgaattttaatcttagttttcctgtaaagcattataaaatacagggtccaagtaaaggttaaaaaaaaaatggaattattcagaggtgaatttgggaactactttttcaaaagtttttcttttccttactatagtctgcttttaaaacaactgtgacatgtcccctttttggtgacaattgcaagttcaggtgttaactgttgtttgacttgtgtctccagagattgccctcagtcccaataatcacgaagtgcacatctataagaagaacgggagccagtgggtgaaagctcatgaactcaaggagcacaacggacacatcacaggtaaaggaagatagccgtgagcttagtgtgatatttccaaatcaggcactcttccttttagataaagagcctaataaacccaggtggccataatttttttttttttttttttttttttgagaaggagtatcactctttcgcccaggctggactgcaatggcgcaatctcggctcactgcaacctccacctcccgggttcaagtaattttcctgcctcagcttcctgagtagctgggattacaggcacgcgccactatgcctggctaattttttttatttttagtagagataggtttcaccatgttggtcaagctggtctcgaacccctgacctcgtgatcctcctgcctcggcctcccaatgtgctgggattacaggagtgagctaccgcacctggcccgtaatatttaaagtcatgcagcacttactgaatttccttaaaattttaaagaaaatactataatgatcttagttgttaagtgcttcttgtggccccagctggtacccagcactctaccgttgctatggaaagcactgaacctaccctgaggactaaagagctaaaattaggagatgagacgtgaaattgaaagctagataacatgaaaatgtagacaacacgaaaacgtgcgccaaactatttccaagtgtcttccaaaagtttcctttgtgtttttagggtaaggaagactttccagaatattgagaagaacaaagtaatataataaacacccatatcagataatcgccaccagaattaccaactttttccctgtgccaggaagtaatttcttttcctgtatcaggaaacttaaggaaaaaggatgtaataataaggaatattattcttgatgatggtaaagtcacctctcaccagcagtcctattcctctcccctggaaggcagactataatttgctatgacaccattccagtccatttttaatacatttacatacatacatattcataaacaagcttaggccaagcacagtggcttacacctgtaatcccagcactttgggaggctgaggcgggaggatcgcttgaacccaggaatccaagactagcctgggcaacataatgagaccccccgttagcacggtgtggtggcatgcacctgtggtcccagctacttgtgaggctgaagtgggaggaccacttgagacaagatcaaggctgcagtgagctgtgatcacaccactgcactccagcctgggtgacacagcaagaccctcatctcaaaaaaaagaaaaaagagaaaacaatctttaggactattgactagtatttttttgaagctacataaatggcatgatactatgcatctccggcagcctgcttttgcattcatgattgtttctgagatccatctatgttgctgtctagatcaagtttattccttttaaccactctttagcattttatacctcatttatttactccttcctccactgaagaacatttaggttgtttcaatttttccatattacatgaaagtgctgaataggcatcccttgatttctgtacgtatgtgtgaatgtttgtagatggtagatgtgttaataccacagggtatgcatatctgcagtgcagtgttgccaggcctcatcagattgccatcattcccacctgtcctgtatgagagtgctcattttcccacaccccgccacatacttgagatgggaagactgaagaatgcatgaaaggttcatccattgcttctgtaagttgtattttcctgattcatggaaaagttgagatactttcagacgtgtattagccatgagagtttttcttccttgtgactgtcctgttcataaatcctgatcattttttcattgagtttttgtcttttttctgtttttgtttgtttgtttgtttgtttgtttgttttgagatggagtgtcattctgtcgtctaggctgaaatggagtggtacagtcttggctgactgcagcctctgccttccaggttcaagcaattctcccgcctcagcctcccgagttgctgggattacaggtgcctgccacaatgcccagctaatttttgtatttttagtagatgtgggatttcaccacattggacaggctggtctcaagctcctgacatcaagtgatctgcctgccttggcctcccaaagtgttgagattacaggtgtgacccttttttttcttttagacagggtcttgctctgttgcccagtcacccaggctagaaggatcatggctcactacagcctcaacctcttgggctcaagtgatcctcccatctcagcctccccaggagctggtactaaaggtgtgcgccagcacacccggctaatttttttgtaaagatagatttcaccatgtcgcccaggctgattttttattcttttagttggactctgcaattttacctctaatcacctaaaatactgataagcttagagatatccttacccaaatgagagaacttagcatgttttgctattctacatcctttacagaagttgtcctgcattcttcagcaataactcatggccacccttgctttgaccagtgatttataaataatgctcttgagcaccagtagctgagtatatttccaaagcagcaccaaagacagcgtttctatttttgttgctgttcctttcccacaatcttatttctattaggtttggcctattttcttaagttcctttgccagtggcctcatagcctaagaataagaatactcatattttaaattggaattttaggccgggtgcggtggctcacacctgtaatcccaacactttaggaggctgaggcgggtggatcacctgaggtcgggagtttgagaccaacctggccaacatggtgaaaccctgtctctactaaaaatacaaaaattagccgggtgtggtggcaagcacctgtaatcccagctactcaggaggctgagacatgagaatcgcttgaacccaggaggcagaggttgcggtgagctgagatggcgccactgcactccagcctggggtatacagcaagactctgtctccaaaaaataaaaaattaggctgggtgcagtggctcaagcctgtaatcccagccctttgggaggctgaggcgggctgatcacctgaggtcgggagttcgagaccagcgtgaccaacatggagaaaccccatttctactaaaaatacacaaaattagctgggcgtggtggcacatgcctgtaatcccagctactcaggaggctgaggcaggagaattgcttgaacctgggaggcggaggttacggtgagccgagattgtgccattgcacgccagcctggacaataagagcaaaactctgtctcaaaaaaaaaaaaaaaaaaaattaattggaattttagaatttaaaaggaaatacttttaaatgagaaaaggcaaagatgaaagaccaaagaaatcgccaaaaatgtgaaatatttagttatgtgtttttttccctctacttctcttttggggtcctttgaacttgggcctgttttctgtctagctgctcacatggcattttttagatctgaaataacttgttggaaaaatctaaatataactctggggcaggagatcaaggatcagacatattttctcagaaagatagtaattttaggggaaaaaaatattttctgaagcattctagaagaaaaaactagtccatactacaaagaaaagaagtgtggcaaacatcagggatatcagagttctgaggttttattcttttgtattaaatatttttaagaaacatgttttgttaccatggaaaattttaaacagatttttaaaaaagtggaatagtataatgagccttttatacccatcacctgcattccacgattatcgagtaacagccaatcttgttcttctcaattcactttctcctttcctgtactaatttgaagcacatcccagacattatattgtttcatatttcagtttgcatctctaaaagataatgatttttctttttaataataataaatattgatcaggcttacacctgtaatcccagtgctttgggaggctgaggcaggcagatcacttgagccctggagttcaagaccagcctgggcaacatggtgaaaccccatctctacaaaaaattagccaggcatggtggcttgcacctgtagtctcagctactcaggaggctgaggtaggaggatttcatgagcctgggaggttgaggctgcagtgagctatgatcacgccactgcactccagtctaggtgataaagtgagaccctgtctcaaaaaaaaaaatctaataaagaggacagcaagcaaaattatcttgtaatgaataaataaaataaacatcacttagaacacattctcatattttcttcccttcagtggtacaaaaaattgagctgatatttcatgtgggtaaatgaatgaataaactaaactcttcatactacttttttttttttttttttttttttgagacacagtctcgctgtgtcacccaggctggagtgcagtggtgcgatctcggctcactgtaagctccgcctcccgggttcacaccattctcctgcctcagcctcctaagtagctgggactacacgcgcctgtcaccacgcccggctaattttttccatttttaatagggacagggtttcaccgtgttagccaggatagtctcgatctcctaacctcgtgatccgcctgcctcggcctcccaaagagccaccgcgcccggcctaactcttcagtcactatgacttatgggtaattgaggctcagaggtatatttgtcttttttccatataaatgtcaagaatgctaattattaatttttagagagagatctgtaataaatatttattagtaatatttctgtactttttaatgtgaaattatatttatagaaaatacctcatcaaggccaggcactgtggctcatgcctataatcccagcactttggaggctgagacaggcagatcgcctgaagtcaggagttcgagaccagcctggtcaacatggtgaaaccccgtctctactaaaaatacaaaaattagccgggcatggtggcatctgcctgtaatcccagctactcgggaggctgaggcaggagaatcgcttgaacccgggaggcggaggttgcagtgagctgagatcgtgccattgtactccaccctgggctgcaagagtgaaactccatctcaaaaaaaaaaaagaaagaaaagaaaagaaaatacctcatcaataagtgttaaatgagtcatggtgaattttgctcttggtatataagaaactgaccttgagtcttggtatatgaaaaactgaccttgactttgggattcttcacagaggtaccagataagtaaagtctcatcaaataagaaaaataaaccttacattcagatacatatttaggtatcttcctggtttagatgcaaagaaacaaggattctttcacaggacctgcatcatgtagaaaaggttttcagtatggttcaactggcagtgactttcagaagaatatatgatgaatcacaatatatagttccccctctttacactaaagattatttttatttaccctgtatgctgttttagttgaatgccatgtagcagactgttggttaatatcatagaatgaggtgtgttaatgaatacagttattttcacacacacaaaaatctaataaagaggaaagaaagaagtaatgaatcttcagatctttagaagtcttagaaatgtgtgaatgggtggaaagaatggccccgtttagttttgtaaagtctgtaattataaaacagctcttctacatgacctcatagacaatcccgagtcccagacgctttgcagagaagcatccttgcctttccttgaggcggtgatcaggacatagatagtgggaaggatgtgcctgggaggaaggtcccaagaccacgtctcatcctggcatgccagtgccacccacctgcctgtgccgcagttgtttgtcattgactgggcaaagcagatgacccatgtctcacttgcaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgagtgacatctgaattttttctatccctctctatagaatttacatttgcactgctgtgtgagggctcaccataactccagtttttctcatccggagttgtgtggttttttctctgaaattctcgattctgtctgagcattttcccttctcatgtgcatgttaagttaaatcgcacgttttttatattaacatagagctattgtgtccatgttctgatcgcctaacttgtttcttctgcaagatgctattactgttctcactctatactgcgcaaattgctgttttcttactctcatttacaaataataacattgaaagagtctccgttccctgaggaatattttttctttttttttttttttcacaggatatctatgtaggattcctacagataacaatgttctttttttttttttttttttttttttttttgagacagagtcttactctgttgcccaggctggatggagcgcagtgacacgatcatggctcactgcaacgtccgccccctggttcaagcaattctcctgcctcagcctcctgagtagctgggattacagtcacctgccatcgtgcccggctaatttttgtagttttagtagagacaaggtttcaccatcttggccaggctggtcatgaactcctgacctcatgatccaccgcctcggcctcccaaagtgctgggattacaggcgtgagccaccacgcctggtcaatgttccttctttaaagcttatttgccaaccaaatctgtgtcttggtgtaatattttacttgtttaaactgttgaagtcaaaactcaccagaatcttagaagtctaatcagctattgcacattttttaaattacttcttgctgacccagtcaaaacacaggtttattttatggccaaaacttattttaactactccttcctgtttgttttgataaggaaacaattattctccagcctggccaagatggtgaaaccccatctctactaaaaatacaaaaattagccaggcacagtggcaggtacctgtaatcccacctacttgggaggaagcaggagaattacttgaactcggagggcagaggttgcagtgagccaagatcgtgccactgcactccagcctgggcggcaaagtgagattctatctcaaaaaaaaaaaaaattatttttctgtgtggcatgtgttcagcatgactggtaaatatccttcaacgtaaagttgtcatttactactaaactggcagtgtttgtgtttctactaaaaatagcagagtatacatgactctttgtagctgttttgttatttgtattctgctgaaattgaaagaaggggattatcatgttacctttgtaatttagtaaaacttcagaaattttattcttcaaaaagagattgggaatttgcggtaaaattgagttatgggccaggtacagtggctcatgcctgtaaccccagcactttgggaggccgaggcaggtggatcacctgaggtcaggagttcgagaccagcctgaccaacacggataaaccctgtctctactaaaaatacaaaaaaattaacggggtgtggtggtgcatgcctgtaatcccagctacctgggaggctgaggcaggagaatctcttgaacccagtaggcagaggttgcggtgagccgagatcacgccattgcactccagcctgggcatcaagagtgaaactccgtctcaaaaaaaaaaaaaaaaattgagttacgaatttgaaacatacatttttctttcaaatgtgaaatcaaggctaacaaaatgttacctgctagaaactatttggaagtttcattgtaatgagataggaaactaacttcattaatattctctcaaggctaaactttatgtcagctggtactccttgcaatcttacaaatttctacaggaaacttttcttccaagttaagcttcaacctcagtaattgtttacatttttattcgttgagaattagtgtcaagtataggtaaattggactttattatggtacaaggtattgtctttgaacaagctgtatgtttagggcagtttctcagctgtagaacaattatttcatatttcataggagtactttaaaacaacttctcagaagtttataattcagccatatgaactaattattttgcttgccatcttttccttaattaaaaaaattacattataaaggccaggcacggtagctcacgcctgcaatcccagcactttgcgaggccaaggcaggcggatcacgaagtcaagagttcgaaaccatcctggccaacatggagaaaccccatctctactaaaaatacaaaatattagccaggtgtggtggtgcatgcctataatcccagctacttgggagtctgaggcaggagaatcgcttgaaccagggaggtagaggttgcaatgagccgagaccatgccactgcactccagcctgggcaacagagcaagactctgtctcaaaaaatatgtatacattatgaaacaattcgaaatactgtctttttctccttttttagagactttgtgggggattttggttttttattttatttatttatttattttttgagacagggtttctctctgtcacccagtctggagtacagtggtacaaacacggctcactgcagtctccaactcctgggatccagcagtcttgccacttcagcctcccaagtagttgggactacaggtttgcaccaccacacctggctaattttttgattacttgtggagacaggttctcacttttcttgcccaggctgatctcaaattcctgtactcaagcaatccttctgctttggtcttccaaagtgctgggagtatagttgcaagcctctgcacctggctgtctttttcagaatgaacttcttcagacaggatactaagaaagtgattctgtagccaggcgtggtggctcatgcctgtaatcctagcactttgggaggctaaggcaggcagatcacctgagaccaggagtttgagaccagcctggccaacatggtgaaagctaatctcctctaaaattacaaaaattagccgggcgtggtggcgtgagcctataatcccagctatcgggaggctgaggcacaagaattgcttgaacacaggaggcagaggttgcagtgagctgacattgcgccactgcactccagcctggatgacagagtaagactctgtctcaaaaaaataaaaaataaataaataaaagaaagtgattcttgcttgaccccgggaggtggaggttgcggtgagctgagatcacgccattgcactccagcctggacaacaagagcgaaactccatctcaaaaaaaaaaaaaaaagaaagaaagtgattctatagaaaggtaatttagcattgaaggaaaggcattggctcaatatttagtctcccaactgttgagcaaccagacgtgattggtttttaaacagcagtttgggggcagaaatgaattagttaagccaaaatactgactggtcctagacataaatcatcttttttggatggtgctagcgaattagaggctaatccccaacatgaggttcttctaatttcttggttgtgatttttcagtgaaagaaattaaaaagaatttgcagattcgtggagacttgggaaggatattaagctgtcttacaaccccaaattcaccaaaaattcagcaaatcactgaatattcataataaaaattgaagtattttcaaacttcagtttttatctcagaggttaacgtcctatgtaatccgaaatctcacgaaaacataactgagttaatcaatatctatgcttactaatgaggactgctgaaaaccagctgttgtgctgagaacatcagggccaggagtggagaaggcctgttcatggttcttttcctttctgtcctttagcaatgcaccttgtcagctgggcgtagtggctcatgcctgtaatcccagcactttgggaggctgaggccggtagatcacttgagccccagagtttgagaccagcctgggcaacatggagaaatctcatctctacaaaaaatacaaaaattagccagtctcagatcataacctggtatcaaaaaaccttgtctctggcagaaggcctggtgaccgacagaagaacgttgaatgctctgttacttttctatagaatctttttttatagaaacctatctgaaaaagtttattctgaaaaaaataatattctgaattgttttataatttttttttaaattaaggaaaagtgtggcctacttaggtattttcacctgacatacatttgtaggtcatttggggatgctggttgagtggataaactgaaacagttttcccctctcataggtgggtgagcaagcacattaaaaagccgattcgctccacagtcctcagcttggattggcatcccaacaacgttttgctggcagcaggatcatgtgacttcaaatgcaggtgggaaccagtgagaactgataaacttgagccgtgcattcttcatccttcaacaaataattttaggttctctttctttgttttttgttttgttgtggttgttgttgttttgagacagggtctcactctcacccaggctggagtgcagtggcaccatcatagctcactgcagcctccaattcctgggctcaagcgatcctccagcctcagcctccagagtagttgggactacaggtatatgccaccacacctggctaatttttttaaaattgtctttattctttgtagagacggggtcttgctacattgcccaaggttggtcttgaactcctggcctcaagtgatcctccctccttggcctcctgaagtgctgggattacaggcatgagccagtgtgcctggcctgtaagtttccttttctttgcaaggtactgcgctaggcactgtgagggactcaaaaatgaggcctggtgctgtggctcacacctgtaatcccagcactttgggaggctgaggtgggcggatcacctgaggttggaagttcaagaccaacttggccaacatggtgaaaccccgtgtctactaaaaatacaaaagaggccgggcgcagtagctcacgcccgtaatcccagcactttgggaggctgaggtgggcggatcacaaggtcaggagatcgagaccatcctggctaacacagtgaaaccccgtctctactaaaaaaatacaaaaaattagccgggcgtggtggcgggtgcctgtagtcccagctactcgggaggctgaggcaggagaatggtgtgaactcgggaggcggagcttgcagtgagccgagatcacaccactgcactccagcctgggcgacagagcgagactctgtctcaaaataaataaataaataaaagttagcctggtgtggtcacaaatgcctgtaatcccagctacttgggaggctagggcatgagaatcatttgaaccggggaggtggaggttgcagtgagctgaaatcacaccactgcactccagcctgggcgacagagtaagactccatctcaaaaaacaaacaaaaacaaaacaaaaaaatggaagcagtttgtgatccagaaaaggagctcaagcatggtgattaaaagaacaagttcataagtcactgaggtaaaaagaaatccacttggaagtggggtaggagggagaggcaagggtggggccagcgaagatttccttaagtgtaagaatatctatggtttagaggggaggattagcatgtactctctctgtctctgtctctgtctctttcttaccatctctttctgtgtctccctttctccctgtctttcttgacaacagtatttttctcatttcatattccaggcagcagtctctgcaaattccaaagtgaaacaattaataaaacatagctaaacagtgcgctgctaagctgttattgtgctgttctttcagttaaagctttttattttgtcattagcttgaagctagaagaaatgcagccactttgctaagaactttaaggatcataccatggaattccatgtaattgctttttaaagttgttctttctcaagaatatgcttttttccctttagctgaaaggaaagcaaagcaaataaatgttgctttgtgttgactatatggtaggttgggagatgaggtgcacttttttttttttttttttttttttttttttttgagacaaggtcttgctctgtcacccaggctggagtgtggtggtgcgatcatagctccctgcagcttcgacctcccggactcaagcaatcctcccacctcagtctcctgagtagctgggaccacaggcatgagccaccatgcctggctgattttgtttattttttgtagagatggggtctcactatgttgcccaggctggtctcaaactcctgggctcaaagaatccttctgccttggcctcccaaagtgctgggcttacagggatgagccactacactcagctgggatacactttcttcagtaactgtggagaattcccagaaaaccaggctagtggtttatatccaggaatactcaaagcttaaaaaaaaaagagagagagatgtgtttgagtttggcggagaggatggaggtcatgggagtgtcaaggcactttatattctggacctgtgttacttgtgatttcttaaccagagtcattggaaaatagaactaggtggcactaacccacaccacctggattctttgatggttgtgaaaataggttgcagttattttgttaatattaatttcccctagtttctctgtcacaaaagctggagtgcagtggtgtgatcctggctcactgcaacctctgcctcccaggttcaagtgattctcatgcctcagcctcccaagcagctgggattgcaggcgtacaccaccatgcctggctaatttttttttttgtattttagtagagacagggtttcaccatattggccaggctggtctcaaactcctggcctcgagctatccacctgcctcggcctcccaaagtgctggggttacaggcatgagccactgcgcctggcccagtcctgtgggtatgggtctgtcccatttgtgttcctgagttggtggctgagagccactggttctttcttggccttctaagactaaagcagccgctgtcatgatgcagatttaaagcacagtgtttctactgtctcgtcatataacctcacataactcacagtcctctgccaggcatcttccagagcctctgtactgccattgtcatttggggtggtaggggggatacctcggttcttttagggagcctttaggttcagcagttttttggagagaagaaggtgtacaaagtagaaatcacattggagggcgaaagggccctaaagggtagatttccagccgttcccctttgcccttaactctgggccagaacatcctcaaacacagctgtgtggaattagataaaagagtgagttagtggaaacgggcgacaccacctataaaggacctgcctccatcttaagctattcctgccacagagactggacagtgggcctgagggtccagggagcctgcccaccccttgtcaccagcctcccttggctttctcttggggtatgtctttaaaagggtcaacaccattagtttgttgcagggtggcaaatagtttctgctctcccaccattgactgcgcaggcttcctggagtactgtgttgagaatgatggtaaggtagacaggaaagaatgctgtggccatttagcaaggtctcatgtgggcaagggagggatgggacagcaagatctccccagaatgtgcagtccatgaggacaggtcttttgtgatcactacttcagaacctggcacccacagcctgacacacagtaggtgctttgatagtatctagagtatggattagctaggcgcagtggcacacatctgtaatcccagcactttgggaggctgaggcaggagtattacctgatcccaggagttcgagaccagcctgggcaacacagcaagaccccatctctacaaaaaattttaaaatattagctgggcataatacgaacttgtagtcccagctactcgagaggctgaggcaggaggatcacttgagcccagaagttggctgcagtgagctttgatcacaccactacactccatcccgggcaacagagccagacccccgtctcttaaaaaaaaaaaaaaagttggagcgggggatcaggtgtggtggctcatgcctgtaatcccagcactttgggaggccaaggcaggtggatcacctgaggtcaggagttcaagaccagcctggtcaacatggtgaaaccccatctctactaaaaatacaaaattagccaggcatggtggcacatgcctgtaatcccagctacttgggaggctgaggcaggagaatctcttgaacccaggaggcggaggttgtggtgagccaggatcatgccattgcactccagcctgggcaacaagagcaagactctgtcccccaaaaatatatatatatatactagaatatggatttgccaaacttgggttggcctgtagatagctctaacaataattctgttacttgagaggtttgaatatctggacttacctatcatgatttattattttagtttagtttagtttagtttatgttatgttatgttatgttatgttatgttatgttatgttatgttatgttatgttattttagagacggtgtctcgctctgttgcccagcctggagtgcagtggcgcaatctcagctcactgcaagctgtgcctcctgggttcacgccattctcttgcctcagcctccggagtagctgggactacaggcgcctgccaccacacccggctaattttctgtatttttcgtagagatggggtttcaccgtattagccaggatggtctcgatctcctgacctcatgatcctcccgccttggcctcccaaagtgctgggattacaggcatgagccaccgcacccagccttatttatttatttatttatttatttatttatttattgagaaggagtttctctcttgttgcccaggctggagtgcagtggcgtgatctcggctcactgcaacctctacctcctgggtttacgcgattctcctgactcagcctcctgagtagttgggattacaggcatgcgcccccacgcttggctaattttgtgtatttttagtagagacggggtttctccatgttggtcaggctggtctcgaactcccgacctcaggtgatccacccacctaggcctcccaaagtgctaggattacaggcttgagccaccgtgcccagctcatgttttatttttttttaatgagtcaacctctttgcattctgagattccttgtggcagctgcctatggcctgtttctatatacatatattttcatttgctttttccttttctctctgccctttaaacagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcagtgagtatttgcctttcatttggaaggtggggaacaaggggtgggatctctcaccagctgaaccaggactgcccttcctggggtgttagcacagggcacaaacataaaaaccttaatcaggccaggcgtggtggctcacgcctgtaatcccagcactttgggaggccgaggtgggtggatcacaaggtcagcagttcaagaccagcctggccaagatggtgaaaccctgtctctactaaaaataaaaaaaattatccaggtgtggtggtaggcgcctgtactcccagctactcggaaggctgaggcagagaattgcttgaacctgggaggcagaggttgtagtgagccaagatcatgccactgtactccagcctgggcgacagagtaagactccgtctcaaaaaaaaaaaaaaaaaaaaaacacctcaatgaaaactgcaggcaggcaggcctcagtggctcacgcctataatcctagcactttgagaggctgtgggcagatcacctgaggtcaagagttcaagaccagcctggccaacatggtgaaaccccgtctctactaaaaacacaaaaattagccctgctgggcacagtggctcacacctgtaatcccagtactttggtaggccatgggtggatcacctgaggtcaggagttcaaggccagcctggccaacatggtgaaaccctgtctctaataaaaatacaaaaattagccgcagtggctcacacctgtaatcccagcactttgggaggctgaggcgggcggatcacttgaggtcgggagtttgagaccagcctgactaacatggagaaaccccatctctactaaaaatacagaaaattagctggacgtggtggcacatgcctgtaatcccagctactcaggaggctgagtcaggagaattgcttgaacctgggaggcggaggttgcagtgagccaagattgcaccactgtactccagcctgggcaacaaatgcagaactccgtctcaaaaaaaaaaaaaaaaaatcagcccggcatagtggcatatgcctgtaatcccagctactcgggaggctgaggctagagaatctctggaacccaagaaacagaggttgcggtgagccgagattgtgccattgcactccagcctgggcaacaagagcaaaactatgtctcaaaaaaaaaactgcaagtcagcttttaccgtgacaggcacagacacaaattctccggttggaaaattttaaagacctaggtcttccagaaatacttcttaatggaagtactgataatgattcctttcaagaaccctcctggttggctactgataagggtcacttaaaaagggccagtttaagctgggcacagtggctcacacctataatcccagcactttgggaggccaaggtgggtggatcacttgaggtcaggagttcgagagcagcctggccaacatggtgaaaccctgtctctacaaaaatacaaaaattagcccagcatggtggcgggtgcctatagtcccagctactcgggaggctgaggaaggagaatcacttgaacccaggaggtgaaggttgcagtgaaccgagatcatgccattgcactccagcctgggcaacagagcaagactccatctcaaaaaaaaaaaggctagtttagtctgttactctgaattccttacaaaatgtaagtgccgttcaccggccttaaattaaataggagatatattcttactgggggaagtcagcgaacgatgacttcattaatttgagccttccattcagtaaggcttaaaaagcattgatgccacttctctgctgtggctggaaggactcgaattacggtggcttctttgtgagtggcgtgtctgttcagccataaagtacttggccagacatcagagttcattttgttcagtatatgttggaggaagagagaagattggaatccttcttcttttataaatctttgttcttccctggtgttccttttccattgatagctaaagggaactcaccattaaaggttttgtgatggacatggccacttgggtatcaaaaatcaatcacactgggtgacctttactccctgtcaggtcagtaagagtcacccagtgtaaacagcatgatatttcagacatgatatgtttttcctaacaggattaaatgtgcattttttagctagttttacatatttttttaaagattatcccctcaggccgggtgcagtggctcacgcctgtaatcccagcactttgggaggccgaggcgggtggatcacctcaggtaaggagttcgagaccagcatggccaacatggagaaaccccgcctctactaaaagtataaaaattagccaggtgtggtggcatgcacctgtaatcccagctactcaggaggctgaggcaggagaattgcttgaacccagcaggcagaggttgcaatgagccaagatcgcaccactgcactccagcctgggcaacaagaggaagactctgtctcaaaaaaaaaaaaaagactgggcacagtggctcacacctgtaatcccagcactttgggaggccgaggcgggcggatcacaaggtcaggagatcgagaccatcctggctaacacggtgaaaccctgtctctacaaaaaatacaaaaattagccaggcgtggtggcgggcgcttgtagtcccagctactcgggaggctgaggcaggagaatggcgtgaacctgggaggcaaagcttgcagtgagccgagattgcgccactgcactctaggctgggcgacagagcgagactccatctcaaaaaaaagaaagaaaaaaagaaagattgtcccttccattataaaatgtagtctttcagaagatttccctacataaacaggcacttatatatcttttcatttttaacagaaataagattattttatacatttttatatacatttggtaatttgccttttaatacttgataatacttttgtattttgatgccagtgttacttgatttttatatggtttattgtgacacagtaagttcttagcatacacttattacaagtccctgtctaccctcgtactgacttctttcccttttccagtcctgcaagtcagattacatgctccacctttccactcctccaacataaatatctcatgtagtaaaagtcaggtataccgcactaagggcttaagatgacacattagttcttcaattcaatgccaactttatgaagggtgtcctgagacatatacagttagcttttttttattttttaatttagagagacactctctgtcgcccaggctggaactcctgagctcaagttctcctcccacctcagcctctcaagcagctggagccacagacgtgcaccaccactctaggctaatttttttttttttttaatttttcgtagagactgggtctcactatgttgtccaggctgatctcaaactcctgcctccagcaatccttccacctcagcccctcaaagtgctgagattacaggtgtgagccaccatgcccagccacagtcagcttttgaatgcatcgtttcttgcatgaagtgaggtgctcctaactcatcagccagtgtgtctgcctgccatatctgtgtaatctctttgccacattcaagagcaaataactacatgcacacacatgtccctgcaggcacacatacacacacatggcccattcgagtgtgagctcctggctaagaccgtttggttcatcttggtagctctagctcctaacacagtgcctggccgtcagcacagatctgtgtggtcacagccctctcggagctccggtgagcacaggcaaggagaaggtcctagcacaggtgtctgctgccaagtcatagtaacaggaagagctctaggagctaagagcagggagaagccactttaggcggaagtggcccgggaaagtggaccgtgggatcatgggggtgatccctttagagctgtgctgggggtggaagggcgtgatgcaaagactgggctttgggaaccagtttgtcgtcagtgggcagggcctcagaaggaggcagagccggaacccagggctgcccctgtcttgagaggcctgcaagttgaggtcaggggctccttttcaacataagtgcccattgatactgcagaagcccctgtgagaatgggtcctttgtgatcatctgtgtctgtaaagaagctaatagtctgttgcatcttgggataacacatgttcttgtgttcagggtctcgactctgaagacagagttcctgccgctcctaagtgtgtcatttgtctcagagaacagcgtcgtggctgctgtgagtatttttcttcattctccctcggggtgcactgtatgtgatgctcagacagggaacaatgtgtgctctgtcaccctagcacaaagcagaacagttttttagaagaaacagagctcacttttttttttttttttttttttgagatggagttttgctcttgttgcccaggctggagtgcaatgggtgatcttgactcaccgcaacctctgcctcccgggttcaagcgattctcccgcctcagcctctcgaggaactgggaatataggcatgcgccaccatacctggctaattttgtatttttagaagagacggggtttctccatgttggtcaggccggtctcgaactcccatcctcaggtgatccacccaccttggcctcccaaagtgcgggcatgagccaccgtgcccggcctcagaggtcactttttttttggagactgtcttgctctgtcgcccaggctggagggcagtggcgcaattttggctcactgcaagctccgcctcccgggttcacgccattctcctgcctcagcgtcctgagtagctgggactacaggcgcccgccacctcgccgggctaattttttttatttttagtagagatggggtttcaccatgttagccaggatggtctcaatctcctgacctcgtgatccgcccaccttggcctcctaaagtgctgggattacaggtgtgagccaccgtgcccggccgctcacttttaagagtaagagggggtggggcacgatggctcacgcctgtagtcccagcactttgggaggccaaggcgggtggttcacttgaggtcaggagttcaagaccagcctggccaacatggtgaaaccccgtctctactaaaaacacaaaaattagccaggcatggtggcagacgcctgtaatcccagctacttgggaggctgaggcaggagaattacttgaacccgggaagcagaggttgtggtgacctgagattgtgccactgcactctagccagggcaacagagcaagactcggtctcaaaaaaaaaaaaaaaaagagtaagagaggcctgtcgtggtgaacactctgccaaggaggtgggcggtgggcagtgcatcctccagggactgactgagtcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtaggtgccgtctgtagagaggtggtcaggtgacaaggtgccttcctgcccctcgctgtttccttactgggttcctacaaaagctctatgcccctcaggcccagacattctttcagggacaagtgcagcaagaagtctgtatcttcccgaccgccaggctctcatttccagctcgtggtagggagggagtcgccaccacctggtcattctgtccttcaaggtgcagattacaaggcagcagccagcaggagcagtgcagaccttgttgcaatctgaggtggtggggcctcagggcagctgcttcctagggtaccctttctcagctactcgagaacaaaaggagacattcctgaatgctgcgttcccacagtagtgcacacataacagaaagcgaagttacagcctgttggaaaaggtaactgtagctgtcgtttcaagtaatggatacaaataagaagattatttaattaaaggaacagaatttcttatcatcatgatgacaaagctgaggagtgtctcgactgggttttcatcaggtatatgtaattatgtaagacaacagaattgtgttttgtccagaaagtttaatttttttttttttttttgagacagagtctcactctgttgcccaggctggagtgcaatgccacaatctcggctcactgcaacctctgcctcccgggttcaagcaattctcctgcctcagcttcccaagaagctgggattacaggcgtgtgccaccacacctggctaattttttgtatttttagtagagacggagtttcaccctgttggccatcctggtttcaaactcctgacctcaggtgatccaaccacctcagcctcccaaattgctggaattacaggcgtaagctaccgtgcctggcctgaaagtttgatttttaaggtctagaggagaggctgggcatgatggcttacacctttaatcccagcactttgggaggctgaggcaggcagatcacttgaggtcaggagttcgagaccagccttgccaacatggcaaaaccccatctctactaaaaaatacaaaaattagcttggcatggtggtacacacctgtaatcccagctactcggcaggctgaggcaggagaattgcttgaaccgggcaggtggaggttgcagtgagccaagattgagctactgcactcccgcctgggtgacagagtgagactccgtctcaaaaaaaaaaaaaaaaaaaggcacctggaggagaaatatatgcttgatattctaaattactgtgttcagagttgggtcccatgggattttcccttactgagaagccttttatgtttagaatcttattgtggtattgatggtgggagaagtaatggaaacctctagacttcctgtttgagagaattacaatgaaatgcaggttgtgcttcatcttcagcggagaaggggcagctgtatataaaataggctgcaaatgctgtattgaaaaatgagaaccagagacctggcaccatgtctcacacctgtaatgctagcgttttgggaagccaaggcaggaggatcacttgaggccagcagttcaataccatcctgggcaacacagcaagaccccatctctacaaaaaaatttttaagttagctggctgtgttggcacgcacctgtagtcccagctacttgggaggagtgagctgtgattgtgccactgtacttcagcctgggctacattgtgagatcctatctcaaaaaaaaaaaaaaaaaagaacctgaaggcatagcaaaacttaccttttctccacattcttcaggtttctccttctatagcaaaactcaccttttctccattctttaggtttctctgtcttgaatggctccgagttacttcttgtgagtttctcttacgtttctatacagaccaagtgttaaggaaagaaaaagctctcattgcctctctgacacttctagatgaaaaatgaaaagaacaaacccttgctgattagtctacttttatttgcagaaattaggtgctctttgcactagaactgtgtcagctaactttttctgtaaaggaccagatagtaaatattttagactcctagaggccataggtctctgttgcaactactgaactctggttgtggcaggaaagcaggcacagatgatgtaaacagatgaggtggctgtgttcccgtcaaactttatggacactcaaatttgaatttcatgtaattttcacttcatgaaataatagtctccttttaatttttttccagctatttaaaaacgtaaaagccgggtcaggtgcagaggctcacgcctgtaatcccagcactttgggaggctggggtgggcggatcacttgaggtcaggtggtcaagaccagcctgaccaacatggcaaaaccccgtctctattaaaaatacaaaaattcgccagcctggtggcaggtgcttgtaatcccagctactcgggagtctgaggcaggagaatcgcttgaacctgggaggtagaggttgcagtgagccgagatcgcaccactgcactccagcctgagtgacagagtgagactccatctcaataaataaataaataaaataaaaatgtaaaaccccgcccccctttttttttttttttttgagatggagtctctgtcacccaggctggagtgcagtggcacgatcttggcttactgcaagctctgcctcctgggttcacgcccttctcctgcctcagcctcccaagtagctgggactacaggcgcccgccaccatgcctggctaattttttttttttttttgtatcttttagtagagacagagtttcactgtgttagtcaggatggtctcgatctcctgacctcgtgatctgcccacctcggcctcccagagtgctgggattacaggcgtgagccactgcacctggcctttgttgttttttttttttatttaagctcacaggctgtacgggcataggcagtgtgtgccatagtttgccatccccttcccagcgtcggggaagaggcgggtaagttctagacatctcaaaggagaaagaaaaatattgtctgagcaatggatgattgtcttgaaagcttccagataattaggctaagacaagttgtttcatttatctgttcccctgcttagcttggtcggaatctagtggtgtgtctgctgctaacatttatgatgattcacttcagactcaaggagggctgttggcttatctgcactggctgtcttggaggctgatttgagaggttttgtttggagctatggaattcagtcatgcttcatcatgcctctggtttatttaaaaacaaacaaaaatactgttttcgccatggctgtggtcctacccacaacctgctcccagcatttgagtgctgtgtgggctgggtcattcctgcttccccaggtcacgctaaccaaggcaagttcttaacttctccccttgccagttttgtctttcctggacatctggtaataatatgctttggggtattttctgagccagattgttgcagcctaatgttcatggataagttcataatcaggagttaaaagataattcatttcctggtggagcgtggtggcttatgcctgtaatcccagcattttgggagactgaggcaggaggatcacttgagcccaggagttcaagaccagcttgggcaacataatgagacccgcatcccagctctatttaaaaaataaagaagaagataattcatttccttaagctgcccttacactattagtcaggaatgtttgtgttcacttccactacataccttacgatctcttttgctttgctttttttcagtcaagtctctatttatgaggtggacaagcaagattgtcgcaaattttgcactactggcatcgatggagccatgacaatttgggatttcaaggtattttctacctaacagaacaaattttgtttgtgttaaaacttttttttttttttttaagagataggctccttctctgtcacccaggttggagtaagtggcacaatcatggctcactgcagccaccaactccttgcctccagcagccctcccacctcagcctcccaagctgctgggacagcaggcatgcaccaccatgctccgtgaatatttttacaaaactcttatgagaagaatgtttctcatttcttgaaacaaaatgttaaatctagtatacagtttaatgtcctaatgtaagacattaaactggaaatctctcatttttttttctttctttttgagatggagtcttgttctgtcacccaggctgcagtgcagcggtgcaatattggctcactgcaacctccgcctcccgggttggagcgattctcctgcctcagtctcccaagtagttgggattacaggagcacactacaacacccggctatgttttgtatttttagtacagacggggtttcaccatgttggccaagctggtcttgaactcctggcctcatgtgatctgcccaccttggcctcccaaagtggtgggattacaggcgtgagccaccatgccagccttggagatctctctctttttttttttttttttttttgagacagagtttcgctcttgttgcccaggctggagtgcaatggcagaatctcggctcaccacaacctccgcctctggggttcaagcgattctcctgcctcagcctcccaagtagctgggattacagacatgtgccaccacgcccagctaattttgtgtttttagtagagatggggtttctccacgttggacatgctggtctcgaactcccaacctcaggtgatccacccgcctcagcctccccaagtgccaggattacaggcgtgagccactgcgcccagccagagatctctttaaaacctaaaagtcatccgcagaagaacggcacattctcagtgaactggaatttttacttctagatgtccatttattcattgaggaaaaatggagtgctgttttggaaacaggccctattggacaccagcccaggtttaactatatagatatatatttatagctgacactaattaatttaataaacatttagtacatatctcctgggtgccatgcatgatgctgagcactgagaatatccaatctgaatgagcctgtctggtagaagagagaggtggatacgggggctgggtaggggattcggcagagctcagaagagaagccagtgcctctgttttcacacagaggaatctagggggatgcgtggactgcagggaacaggttgcacctgagcggcatcctgagttgcgatgggttttggagggagggactgtgagttgagaagacacaggcgagcatcctcggctgcaagtgcagcacacccagggcagccctgggcttcagagagcgcacactgcctctgaggcgctgcccgtgctgtggtcctccggaagcacagatggagctagaaaaaagagctctaggtagccaggcgcagtggctcatgcctgtcttcccagcactttgggaggccgaggtgggagaatcgcttgaggccaggagttttgagaccagtttgggcaacatagcgtgaccccatctctataaaaaagccaggtgcagccaggcgcactgacccactcctgtaatcccagcactttgggaagctgaggctcgtttctcctcactgctttcctgtcttgagcacaggagttcgagaccagcctgggcaacacagtgagatcctgtctctatttaaaaatatacatatatatatttttaaaaaccaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaagaggagtgaggagtgtgcccagagcctgtgtgtgtggcagtggggaaaaggcacacctggcctggaggagccagcagggggagccccggcctggagtgtctctgcggggtgagtcctgggagatcctgtttcaggtggggcagggccaggttcagggtggggacaggcagaaccttccctgaggaagagggagtggtgtcatacctacctcggggtagacactcctcagtgacatcagtgctcttcccaccttttccaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtggttttggttttgtttccttgtagtatttcaatttttagtagaaaaatatgagcgaattcttcattcgattcagttttttttaggcaaaatcttagatccttggtttcttaaattgtaccattctatacaaccttgaaccaaaaagcaccatttagtgaggggtgagagagaaccgtttctgaacattgcaatacttctgcaaagtaggttgtgtcggtctgttttgtgttgcaataaaggaatacctgaggctgggtaatttgtttaagaaaaaagatttatttggcacacggttctgccggttggacaagaagcatggtgcctgcgtctgcttttggggaagcctcaggaaggttttactcatggcagaaggcgaaggggaagcaggcgtgtcccatggcgggagaggatgcaagagagagtggggaggaccaggctccttgaaacaaccaggtcatagagtgagaacacactcattcctgccagggggcaccaagccattcatgagggatccgccccatgacccaaacaccgcccaccaggccccaccccaacactgaggatcgcatttcagcgtgagatttggaagggacacacagccaagccctgtcagaggtacaccgttcccgtcttgcatgtgagcaacagagaagcccacctccactgagcagccaagcccgaatgggagcctgccctgggaggccctggggcccggtgcccacagcatggcagcccactgttagcagtgcacctgccaagggtacgctgtggggggtgtgcaagggggcgggaaaggggaaagtcagcatcttggcttagagttgattgtgcctacactgagctactttcatcatgatgagacgtaaagtttgacattccatggcagagaatcttaagaggtacaagtataaatgaaaagcaaaataagtaaagagtagccggagcctggccacatccttgatctcacggctcccttctagaatgctggtaacagtgcttcccaaggcacatcatgatgtgctcgagagaaggtaatttggccctcttgtgactcatgggaagagccctcactccaagagggaatcctacctagcaccaggggtgctggcctcatggccctgcctggtccctatagtgtcgtctctgggcccccagtggcaggagctcctttgtgtacacgtttgtatgcatagtgcattggcaaggctccgtgagggtagacaaaaactggccataaagcaggaattagctgaagatttctcttttagccggacgcggtggctcacgcctgtaatcccaacactttgggaggccgaggcgggcagatcacctgaggtccagagtttgagaccagcctgaccaacatggggaaaccccatccctattaaaaatacaaaattagccaggcatggtggtgcgtgcctgtaatcccagctacttgggaggctgaggcagcagaatcacttgaacccaggaggcagaggttgtggtgagccgagatcatgtcattgcactccagcctgggcaacaagagtggaattccgtctcaaaaaaaacaaacaaaaaattagccaggtgtagtggtgggtgcctgtaatcccagctactcaggaggctaaggcaggagaattgcttgaacccaggttgcagtgagctgaaatcatgccactgcactcca

SEQ ID NO: 12962 - DNA, 35804 bp, Human
aacaaaaaacaaaaaaacaaaaaacaaaactgaaatctgagacctcaaacgatgaaactgctacaagaaaacattgtggaaactcttcaggatattggtctgggcaaaactttctgaagaactaccccacaagcacaggcaaccaaagcaaaaatggacaaatggatcagatcaagttaaaaagcttctgtaccacaaagaaagcaatcaacaaagtgaagacacaaaccacagaatgggagaaaatattttcaaagtcacactctgacaacagattaatagccagaatacatgaagcgctcaaacaactctgtaaggaaaaatctaataatccaatcaaaaaatgggcaaaatttgaatagacatttttcaaaagaagacatacaaatgccacataggcatatgataaggtgctcaacatcactggtcattagagaaatgcaaatcaaaaccacaatgagatatcatcttaccccagctaaaatggtttttatccaaaagacaggcaacaacaaatgccagcgagaatgtggagaaaagggaacccttgtacactgttggtgtaaattagtgcaaccactatagagaacaatttggaggttcctcaaaacattaaaattaacattaaatagagctaccacaatatccagaaatccccatgctgggtatatacctggaagaaaggaaatcatatattgaagagataacatcactccaatattcacaatagccactattcacaaatgccaagatttggaagcaacctaagtgtccatcaacagatgaatggataaagaaagtactccaattatacacaatggagcacaattcagccatgaaaaaagcatgagatcctgttatctgtaataatatggatggaactggaggtcatcatgttaagtgaaataagccaggcacagaaacacagatattgcaagttctcacatacttgtgggatctacaaatcaaaacaactgagctaatgtctgggccttagtcagtgttgtacccaagtactgggagcacagcttttaaaatacatcatgaatgctttaatacaggaatgaatagatgagaggcacaaactggttgggtgttcttctgatacacagtatcttccttgacagattcagtacaactctcaacaggtaagtctcttcatgttatgttaccttatgaggaattaagtggcagaacatgatttctattattttcctttgcagaacaagaccaactttattagttgggacacagtgtggctgcatttgagtcccaagcaaccattagtctattgctatcaccacagagtcagaggggatgagacgcccagcaatctcacccaagacaactccaccaacattcctggttacccaccatgtgtacagtaccctgctaggaaccagggtcatgaaagtaaataataccagactgtgcccttgaggagctcacctctgctaagggaaacaggcatagaaacttacaatggtggtagagagaaaagaggacaataggactgtgtgagggggataggaggcacccagaggaggaaatggttacatttgtgtgaggaggttggtaaggaaaaattttagcagaaggggtctgtctggctgggcttggaaggatacgtaggagtcatctagagggcacaggtacactccaggcagagggaatttcgtgggtaaagatgtgtaggtgtggcttgtgaggatggatttcaattattctagaatgaaggcagccatggaggggcaggtgagaggagggttaatagatttcatgccaatggctccacttgagtttctgataagaacccagaacccttggactccccgataacactgattaagcttttcatgattcctcatagaacatgaactcaaaagaggtcagcaaaggggtgtgtgcgattctttgctattggctgcagctatagccctgcctccttctccagcacataaatctttcagcagcttggctgaagactgctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgtgagtaactgtccaaactcctctctttgtttccttggacttggggtgctaatcgggccccttttcccttatctgttttgaagatcaaaagagatgttcaaggagaagtagctgaagtgttggacgctacaaacgcatagaagttattattatcttatgcagatctatgaatgaataaataagcatttctcccatccaccttctaattttggtgactaggagggtttagggacagcatttggtagtgggaatgatttgattagcttagatctgacgaagactaatcaatgaaaacatggcagcggcagattacaaactgctgatcatgatggacagtgtgatcctcatccccttcccaggctctggggattctgggtacaggaaggagtggcttgcatttttgtctcattaattcgctttctgggttctgtgtctgctggaagggatgtgtagctgtattgcccctgtagacctggttcctgctcccccgccttccaacccaggatatcatttacataacgcaccaggggacaccaagacttcatgggaagctgtcccctggctcttccctctttcctgtgccatgcccctgaaaatcccctccctcctatgagtcactcctccaccctgtcatacacaggatggtttatcttgcaatgattaacctctagagcaaaggagacctggaggaagtttcgaggatttattctttgctttaatctttttcctcccgtctctgggaggctaggattaatatagagctttgtttctcacctaatgggaatctactagcagcctgaaaaggcaggagccatgaaagccaatttggattttacatatttttcccctttatgttacagtacaggagggcaaaccctctcactggtgggattcctggcatcctagagcaggtggagagaagagttactttccactgtgggtagtggaggctccacctgtcccattaacttctacctcaatttgacttttattaagagcagggaaccacaatgacatgaaaatagacactataaacctcattttaattctttcacagaaagcttaggaattcagtgagttgtggcaacatggtttccattgtctaacatttttaaatgaattgatatggtttaaattcattcatttttaaaccagaattttttggagatagactatttccagcatgttccttctggatggtaaaacagggctgttagttcagtatttgtgacaataagtgtgtgtaaaataatgtcacctttcctgaatgtcaggaatatgagtctaatgcacaaatgtatacctctaagacaagactgcacgtcttttcaaatatacctgtccggccatttattttaataactccttttcgaatatacctgcttagcagattgtcttaaactctcaggacaggggagtaagcaagactgtgagccagtgacgatagcaaaggcttccaggtaggatccatatgaagtgagaaaatattcctcagctctcagggtagaactccaaagagatattcatgggtcctggccccaccgtggaggtcactcaaagggcaaacaggttggcatctcatctgcttcaagcctggacacaggggcaccatctgtgtcactctgtgtgtggtctgccatgttgtgggccggtcactacagactcgggcagccaggcagacaatgccttagccttagacaatgctggtgcagcccaggagtcagaaaatgcagtgtagaccaggccctccttaggccaacacaattacatgcaatagatgactggcttttctgttagtctcttcactggacccaaaggctgcattactctaccagaggggagctggaaagaaactaaagagttcgcccagcacagcatctgccttgacatggtaccatgtgaatctagacactcaccaagatctttccttgggggccaatgctgctgacacattaactcaatagcttgtcctcacctgagaggtcaggtaatgtgtttaaagttcaggagcagagattagtgtcattgatttgacatggctgtgacaacaaaggagggaactgaagtgggaatacccaaggccaccctggctttggcaggtggtgcacgcacttccactaactgttctggggcagggaaccaaatgtatgactgggcctgctcatgctgcccctgctgagtcctccaaaccctgcccttcatgtaatttctcagttttattttatcacattttataagtcactggatgtttacaaaatgtttggaacctatactgccttgaaggctaacctctaaagaggagtaaacaaggtcttaatacaactctccgggacgttttatcattacttatcttatatgccatactgcaccatttgctatcaacaggaaagtacctggactttggaaggtccctctgtgtcttttagctgaaagtacatatgaggcatgtggattcttttatgcacatcatctttttcagccacatttttgtagtttgcctctctggagccaactgtgtggggctagcagcttcacagctgaatcagtgtctggcaacctcttccttcagcctctcttcttcctccagttttccatccctcagtcacaccggagggggaaggtctgcaaggatccagaaccatcagttggaggagtttgcacatgactcatgaaagatgagttccaggcaggcctgccatagtgaacaccaggcttaatgggtttttcctcagagatacttcacgtacagaggcagtgaactgactgctttctggttgaccaccttgaaaaagatgagtgtgcctggcactgtgcttctcaggtgagtatgacctgagaagtattagttgctggttcttctgcacacaatcattcaaggacatatggatcaaccatcctcctcaacagctcaaatcaaccagatcatctgaccacagagactgaggtgtacctgaaagctgcccacatttctataaggccaatagaagccatgaacacagttgtcaatctgtagaaataaggactccatgactcctccaaggcctctctgtgaatgaacgtttaagaagggctagatcctaaaacagggtcagagcttagagggaagaaaaagcataaacatttctgagcaaattgtaagggcagtgtcaccataggctcccagtgaccctctgtgattgagtgcatacagtgatgcaaaatctcatcatcagtgcaaaagacaaaaaaaatcttactctttctacctaggatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtgtacatattacctccctctcttgaccattccagttcctgagtaactcaccagccctctgatctataaagtcacaatccctgtgacctgatttctgtttcactttgtagatatgggacccgtacacatggactttttaagagactgggaattccagggcccacacctctgcctttgttgggaaatgttttgtcctatcgtcaggtgagttgcttgagcttcctcttttgcttcttatggttgcaaacatcagcttagttccatcagtaaaaatgcccctccttgggagggagttctgaggtttcacattttcagaaatggtgggactgggtgcagtggatcatgcctgtaatctcagcctctgtgaggccaagactggcaaattgcttgagcccaggagtttgagaacagcctgggcaacacagtgagacacctgtctctagaaagaaaaaattacctgtgcatgatatggtagcccatgcctgtagtcccagctactctgaatgttaaggtgggaggattgtatgaacccaggaagtcaaggctgtattgagctgtgatcgcaccactgcactccagcttggtcaacagaacaagacagaaaggaagaaagaaagagagagagagaaagaaagagagaggaaggagaggggaggggaggggaggggatggggaggagaggagaggagaggagagaaaaggagaggagagaggagaggagaggaaaaggtgtgtaggctccacccaaagcatggccaggtttacccctggagggaaagtcacaagctcatgtccagaaggccagtagcagcaagctgctctccagcccagatttcctatcctgtgtacctggagcttgtttctcagattctaactctcacaactgaagcctctgttgtctgattactatctgagaattctacacaattttaccctcgataaaagcagtaatttcttcttcatctttcccagatcaactcttgtagtagatcaacatttctgggaccttcttttgcatggttaaaacatcacagctgaatcttagcaacaggaaggtttgtttttatgtttcagaagtgaaagctcagagcacgcattgtaatttgctgggtgtgatgtgtagaggtggcatttctccatcttttctgtgttaagctagaaaactggaaaggaagtctactttctcattcactcactcactttctcactcaacaacatgccttagacttatctaaatctgcaagactaaaagaggttcctggtttctttaactttctaattctgctagagttctagagagagcacatgagataaatgaaaaggatactgatggaggagattaaaaaattgtgcattccctgcagacactcacttttcctcacctcagtttcacccctgcccttgcaggtgatcattcacggggttaggagactttagagagaataaaagaaaaagcaaaaatacatcagaaagacaaggaattacttactggtcatagacaagggtgagtccttcagtacttagagaaaattcaagagtgactttaaattccccacttcaaatatattctctgttttcttgtctttcccttaagacatctctgaatagcttccttcaactgccagtgaaagatagcaggcctgatttcattggacgcaactgttttcagccccaattagaggtagggtttattctatttaaaataataatcaacttgtattttgtttcctctcccagggtctctggaaatttgacacagagtgctataaaaagtatggaaaaatgtgggggtgagtattctgaaaacctccattggatagacctgctactgtgaggaggttaccccactgcaggatagtctctgcccaggtcttcatgggatgaagctcttgtcaacctaaatacaaacagagagaggttctctgaaagaagaggataattacttgggagtagaatattgcaatgggaatctgcttgccgttataaactatgtgcaaattcagggaggtaaacaagacaaagatgctccatagaaaatatgagaagaatctcataactgttttgagataattattgttagctacaaagatcaataacaagggtgatgccacaccaaggttggacaggcagttgctggacaggtgtccttgcagaaatatttttgtgtaaagttgaaatagcctttgtgcaaagttgtggtttttgtagacacttttgtaatagttttgtttccaggaacacaagcataagaatcctctcttcatagccttcttgggatttatttgtcagggttaaaaaacaattagtgacatcactttggttctgataaagttcacactcgctattgtaaaacttttcgaggcttgtcctaccaaggatcccatgtgtcaccaggtatcgaggtcttcagtctgaactaggctaggagcattgtggttaccacttttctgcaggttttggtggcccagggactcccagcatcgccttctgtccagtgtctgcctattcccctcttctttttttcttccttaggtgcccttttatcacatgcattgtctcagacccttctaatatgtgctcataaatgcatggcatcatctccttcccacattgattcactttcaattaaaagccaaaactccttcatttagactgaatttaacatgtgcttttgaaagaagggttgagagataatagagaaacagattgggaaaccacttatgctccacttttttaaactttctctgcaagtatggaattttttgttctgctttgttgtttaaatttaagccaaaacttcttaatagaaggatatacaaatatttattggtttataccattgcacttactttgaagaagagatgctgaatattattaaaccattgtgttccctggtgggctgatggactgtgattttataaggtggtctcagccaattgcagcagctgttccctgtcagaggggctagaggtttggtgagagcagtggatgaggtgcagtggtgtgtttgttcactagaagcaagtgggagaaagctttgcctctttgtacttcttcatcttctcccctcaagtcctcagaatccacagcgctgactgtggagtgctgtggagctggcatggcccatacaggcaacatgacttagtagacagatgacacagctctagatgtccatgggccccacaccaactgcccttgcagcatttagtccttgtgagcacttgatgatttacctgccttcaatttttcactgacctaatattctttttgataatgaagtattttaaacatataaaacattatggagagtggcataggagatacccacgtatgtaccacccagcttaacgaatgctctactgtcatttctaaccataatctctttaaagagctcttttgtctttcagtatctcttccctgtttggaccacattacccttcatcatatgaagccttgggtggctcctgtgtgagactcttgctgtgtgtcacaccctaatgaactagaacctaaggttgctgtgtgtcgtacaactaggggtatggattacataacataatgatcaaagtctggcttcctgggtgtggctccagctgcagaatcgggctagtgaagtttaatcagctccgttgtccccacacagaacgtatgaaggtcaactccctgtgctggccatcacagatcccgacgtgatcagaacagtgctagtgaaagaatgttattctgtcttcacaaatcgaagggtaagcatccattttttgaaatttaaataatgattgatccactgattaaatttttattttgaaaaaaacatatattcacagaaggttacctaaaaaatgtacaggaaggttccatgtactcttcatcctgtcccgcccagtggtaacatcttgcaatcttgtatattgcaatatatatctagtatattcatattatcaggttggcacaaaagttaaaatggcaaactacaggctgggcataatggctcatgcctgtaatcccagcactttgggaggccgaggcaggtggatcacgaggtcaggagttcgagatcagcctgaccaacatggtgaaaccccatctctactaaaaatacaaaaattagctgcgtgtggtggcatgcgcctgtagtcccagctactcagtagtctgagacaggagaatcgcttgaacctgggaggcggaggttgcagtgagccgagatcacgccattatactccagtctgggcaacccaatgagactccatctcaaacaacaacaacaacaacaacaacaaaaaccggcaaactgcaataacttttgcaccaacctaatactatagtacaggaaattgactttgatatagtttacagagcttttcagatttcaccagttttacatgcccttgtttgtgtgtgtttatgtgtgtgggtagttctaagcaatttttcacattcgtagatttgtgcaacgaccagcaccatcaagatgcagacccattccgtcaccatgtggctccctcctgctgtcctacagtcacaacatggagtttgtctttttctctgacaggttctatatcagagcaaacttttatttatttgaggaggccaatgtattaatatttccttttatggattgttcttttggtgttaagtctgaaaatcctttgcttagccctccttcctacattgctttttctaagagttatatagtttaacactttacaaaatgtaactctattacccattttgtgttaatatttgcataagttatgagatttagatcaaggttcattttctgtggactatggctgtccaaatgttccaacaccattttggaaaggtaggcatattgtcaaaactcagctgagtatattttgtgaatctatttcttattgtttactcctccactaataccacactgtggtgactctagtagctgtacagtaactcttaacatcatatagggcaattctttccactttattgatttatattttcagaatggctttagcttttcttgtcccttgcctttccataaaaattcagaataagcttgtaagtgtctacaaacaaacctgccataattttgataagaattaaagcagaggtgtccaatcttttggcttccctgggccacagtggaagaagaagtgtcgtgggccacacataaaatacacacacacacacacacacacacacacacacacacacacacacacaaatggtctgtgtatagttttcattatatatctaccaccacagataagcaaaaatgtccttgcataataatcctaattatgcactgccccattcagagggtctttcaaaatcattgaacaggttccaagtttgcaatcactgatacagaaaatgtacatatctagctaaacttcactacttttttgatattttttattataaaagaaaagagaacaacataaaactagtggggtacttgacattgtttttgagaaactaatccatcagtatctggcttgatggaagtagttgcaattctcagtgagttctcaaggtgctcatcagatattttggttctaattttactcttcgtgttcttcatccttgaaaatagtagctcacaaatgtaagtgctgccaaaaagcaatgacatgaacaaggtgtgattgtgaagcaagggatatttgtcattgggaagacaggtcttacaaaagtccagtaaagaggcaaaatcaaatttttctataagttgaacatcagattgcagctctaggcattccatttcaaaattgccaggtaacatatatatgtcgactgaaaatggagttgcaaatataccaaaatattgatgattttttcagaaatcttgaaatacctgttttcaaattcctgtatcaaattgaaaagcaaggctgcgtatttttggctgttcacaggaccatgtttagccaacatgtcgaaatgcataaaattgtttgccttaatttgagcttgccataatttcagtttcatatggaatgctgttatggtttgaaacattgtattgttaagttggttttcaacttgaagacacaggtttaactcacttaaatgggccgtcaaacccactaaaaatgctaaatctgtaagccagttttcattgtcaagttctggcaccaattttgtttgataccataaacagcttgatttcacatcacaaagcataaaatctttacattttgccttgacttaaccatcttacttctaaaaagtgaatgacttgctagagtcagcatccatacttttaaggaattcctgaaactagcgatgattcaattcctgggcccttgtgaaatttacagccttgatgacaatttgcatgacgttatctacttttaaagcttgtgcacatggattttcttgatgtattatgcaataatacttcatcaaatgtgagttttgtgtggcaactgcatcatctattaattgtacaagtccctctcttttacctaccatcgccagggcagcatctgtagctatatcacatatgtttacaaaggacaaagaaaattgctttaacatatttttcactgcttcatataaatctcttgatttagttgtgtcttttaatagcatggtgacatttcgatttcttcagtgacattatattcatcatcaatacctctaataaaaatagcaagttgtgccgtatctgtagtgtcagtgccttcatccatcaccaaagcataaaattttaaattagcagttttactctccaaacgtctttcaatagatttcccaatttctccaattctcctggctatagtctggtgagacaaactgattttagaaatatcagtttctcaaggcaaataatatctaccacatcttccagacattgcttaataaactcaccatcagtaaatggttttgatttttttgctattaaatttgctaccacataactaggttttaccttacgattgagtccgagttgtaactttttaaaaaatcttttttgttgaaaagacagactttttttcagttctgctattttgtccttacaacacatacacaccaaatttgtcagcacgtttttgcatataatgcctcttcaaattgtagtctttgaaaactggcacaaattccgtggaaattaagcagagtgcttcgctatttgcctcaacaagaaaaagtcatttgtccacttttcattgaacaatcttccttcatccataatttttgttttttagggttttctttttaagacattgtggaagccattctggaattaaaagcattataatagataagcaactatatttacttttattatggaaattaacagataggaaaatagaacagaaagcaaggtttaataatcaaataagaatacttacatgtcttctaaataatattaaacacctatcatctacaaaggtaggttgaaatattattgataattgctgggttttacttgccaaattgccacaaacacacctaatacctgacagtgtcaattcaactgtccgtgattagaagataacacactggaagtcgcacaccaccataaaactgaagccacacatgcgtacaaatggcgacagtgtctggtgtacagcagcgctctgccttgtccagaatacacacttgaattctttgtcacaattcacttcacgtggcactgcaatagcgtcctctcgctctttgttagttaattttaatggcttttaatttcttcttgctgaactgtttgcaattataatgcaaattatggatactagtccattatttgtggatgtgacatactctgattacccctttccattccattgttgtctacgaagttcacacttgagaatcacatagtcaaattacaaaattacaaaaaaaattgcaaaaaaactcaaaatgttttaagaaagtttccacatttgtattgggatacattcaaagccatcctggactgcatgaggcctgcaggccacaagttggacaagcttgaattaaaccaatagaacaatttgggtataatctatatctttactatgttcagcctttcatcccgtgaatatagtatgcctctccatttctttagcttttattactttcctcaacattttatagttttcagcatagaggtcctgtacatcttttgttagatttacaccagaaatatttcatttttgttggagtaactgtaaatgatactgtttttcttgtattttcagatattgattattgttacatagaaatgtgaataattttgtttgttgatcttgtatcctatagccttgcagaacttacctattcgttctagaaatttttttgtatattccttgacattttatacattgacaattatgtcacctgaaaatagagacaattctattatttcctttccaatctgtatgccttttatttctttttcttgtctagtgtattaagacatcaggtatgctctttagtaagaatgttgagagtgggcattttttagttcttcttgatcttggaaaaaccattcagtccttcatcattaaatgtgatttaactgaatgatttttttacagattgtctttatcaaatgaaggaactgtctctctcttcctagtttattgagattttatcatgacagctggaagtacacattttaaaacaaaacatagttgtggaagataagagaaagttccaagcatgctggcttgatagtccagccccaagttgggaaaagtaattatccctttctttttccttctatttatggaataaaaaattaagagaaaagaattttcaaggaaattgcattattccttcaaaacaggtttctagtctttaagtattacctacttttcaaaaaaaaatcaccacatcatggcatccctttttcaagttgcccatgctgtaggtgtattaaagacagagctggtctgaggcaacatacagtctgcccatctgtcaccaatccttttctactctgcacactcctggggaagggctaggtcttgttcctgtctattccactggaagaacagttccctaccacgtggagcatttgcaattaaaaggagactgagatatagaggcaggagaccacaccagatggctgggtctccccactcccacccccgccccacatacactcagaagaggctaggcatctaggatctccattgagcatcttgaatatggcttgccataatatcatatacagtcaataaatatttgttaaataaggatgcctcttcaatatattttgtgcaaccatgaagatcaccacaactaatgtgagaaaaaatgtttctgttgaactctagtctttaggcccagtgggatttatgaaaagtgccatctctttagctgaggatgaagaatggaagagaatacggtcattgctgtctccaaccttcaccagcggaaaactcaaggaggtatgaaaataagatgagtcttaattagaaatgtaaagaatgaatctggggacaggtagaaagtaagatcacagtccgtttccaaggggtagtccactgagttcgagcttcctaaaaatggtcttttatctttatgtacagaaaagacatcacaaaattcattacaaaatgtcacttactgctccatgctggagaaagccatatccttctgggacttgagtctgcacatttaactacaggtactgatctgttttgtgcttagatgttccccatcattgcccagtatggagatgtattggtgagaaacttgaggcgggaagcagagaaaggcaagcctgtcaccttgaaagagtaagtaggagcacagccatggggttctgagctgtcatgagcccttccagctgcctgccatggagtcgacagtcgcactgttgggttactccagtgaccagacaaaagcagggcagcgctgcaactccaaagagccacctaagagggagtggctcccatgaggcggcaagtcagcaagggaaaagggccttctctcctgtgcacaggagccaggatttacttatctgttaacttgtcaccataaatattctgggagattaaatacatactttagaaattaaaaaaacatgattgtatcaaagttttgagtgtagtggatatggaactgtgggtaagcaagcatttggtacttgttgccttgcattgggtaagatgggaaagttacaatggggaacttggaacaatttcaatcccttcatggtttttctgagaatatcagcaaactatgaactattaaaccttcccactacttccttttcctccaatctcaaaaaagaaagggtgctagaaatgctatgtgtagagcaagcctattatttgctgtctacaatggtatgtgcttcaattatgcaggaacgacaggtgtaatctgagcctgtcctgttcagacttgggacatgtggtcactcagttttgggttctccaaatcaatgttggagagatctattttttttaaccagaacattcttgattgtcacatcttacaaaaatgactctgctctcagcgcaacttcaggtcagaggagctggggatagtggggttttccagagcattagcagggagtgtagagaataaaggatgatatttctaggaactcagaacagggtgttactgttttgtaaagtgttgaagaggaattggctctgggcatagagtctgtagtcagacaacgccacctttcttgaatccactaggaagagttaattattctactcttgttctgctgaagcacagagcttacatatcttatatcatccacactcaacacatgctactgtagttgtctgataatgggtctctgtcttcctatgactgggctccttgacctcagaggtgagtctaactcagcttggtgtctccatcacccccagcatagggccagctccatcactggcaccagataaccaccttctgagggagtagatggaagatgattcagcagatagttctgaaagtctgtggctctttatgtgtcttgactggatatgtgggtttcttgctgcatgtatagtggaaggacggtaagaggtgctgattttaattttccatatctttctccactcagcatctttggggcctacagcatggatgtgattactggcacatcatttggagtgaacatcgactctctcaacaatccacaagacccctttgtggagagcactaagaagttcctaaaatttggtttcttagatccattatttctctcaataagtatgtgggctattatttctttctctctttttaaaaataactgctttcttgacatataattcacatatcgtataattcatccacttaaaaggtacaattccattgtttttaagataatcaaaaatatgtatgaccattactattgtaaactaaaatgtttttgtcaatctagagccctcacacactttagctgtcaacaccccaccacaaaccccattgccctaagcatccaataatcaactttctgcctctatagatttgcctattctggacacttcatagaaataatatcattgatttttctctgttgttttttattctctatttcatgagtttattttagtctgttattttctttcttttgctggctttaggtttcatttgctcttcttcttttagtgttttgtggtgtaaataattataatcaatttgagatattttcttcttttaaatttagatattacagctataaatttccctctgagcactggtttggctacatcctgtgttttggtacatcatgccttctttttgttcatctcaaaacaatttcttgttgcccttttgatttctgctttgactcactggtcacttaaaactgtattgtttaacttccacaaatgtatgagtttcccaaatttctttcccttattgatttctagttttattccatggaagttgatgtacatatgctgtgttaattctatcttgactatcatttcctgaacagcatgattaagttaagcagcagattatggtctacattaatccaaaaactctagtccaatagataaaggctaagaggtcagggaatttaattctattactttggtcactccaaagactcagaaggtgccattgatctcactgctgtagtggtgtttcctatgtatagacctgcccttgctcagtcgccggcctgaaagaagggcaaacatgataaaaggaatgggttccagttgagaatcatgatgttcttattcttattactggtagagaaaattataattgctccaggtaaagtttgcattttcaatgatttccttttgtttgttttgtttttcccacagtactctttccattccttaccccagtttttgaagcattaaatgtctctctgtttccaaaagataccataaattttttaagtaaatctgtaaacagaatgaagaaaagtcgcctcaacgacaaacaaaaggtaaaatctgatggtggttaaatgacgatgtttaggttttgataaatttagattttatacacatgatagagcatgtatctgtatttttaaaaataaagacagagaacttatgtttagaacaagagaagccatttggtagaaataaagaaggagattggggaaggagatgagaatgagtcagagagatagcatttaaaacttgaaatcaggcacaacaattagtatgtcatgatataaacagtattgagataaaattttaccacttctcttccctttaataaattgtcaaaggataaagtttcctgtttgaaaatatattttactggtattgtgctttcctcatatcacagattggtaaagaatcattttaagtccaagactcttattttacatattctgcaattaaaggtcctatgaggctacctgccgactgctgacatgtagtgtgtggtaaatgtgagtgtttcacagcctggagtgaacaggggtcttctctgagaattgaggttgcaaggctggctaactcagctttgccttcacgagccctagaggccagccgaaggatgtctgcaggtcagggagacaggaccaggtaacccagctgtcactgaagattatatagagtttgagaatgttggaatatttgaaaatgctcccccaaaaaagctgctgatgagttctggaaatgtcaggagattaatctatacggacactgctgaagaaaaaggtagaagaataaaagatccagtacttcttcctgggtaagcagttatgaccagagatggaaccggcaactctttggccagaaagctgtatccaaaagacagagaagatgagaaacagggagggcaaaggcgaaaaagcaattggacatgatagctagatttgtttcaggaaaacatcctgctttccaaggatttagatgaatgtttttgttcactggtgactcaggtaacacgtcttcaagaagccatagggaggttgagggagggaagtcaagaagggaggttgaggactgcacttttgatttacttctgacttcacgagtcactttctgccaaagaaatctctccttttgcttctagcaccgactagatttccttcagctgatgattgactcccagaattcgaaagaaactgagtcccacaaaggtaaccaaggagtgcttctgagggctactggcggggacactaagagggagggccttgttctgaaaatgtgcaggaagtattccaggaagatgagaatttttgccacatagcagaacaacacacatttagatgttataaatggtagctggaggcactttccagaagcccacaggtatagccatgttccaggctgaaagggcaaccctaagcaaacctagaatgcttggaggacagtcagtggtttgtggatcacctacatgagatcaaatgccagttctcagcctcctccagatccaccaagtgagaacctctacttggaaatttatatcaaacataccgatcaggaagcacactatcccagtaagggtgattttaactggcagtacttgaaagtgtgttcgcaaggttaatctactgcaaagttttatttttccctttgaaatgcataagtaactaatgggggacacctctgataccatgtaaatctacttcaatcttcagtcttgtatctactagttttatgacccatggatggttttaaccaaaaccattattactaagacagtggcaaaatgataaccatggtcaatttcaagctaccaagatttggcaaccatctcacaaaatttttgaatatttaacaattggttctagagagcaggactcagcagactccagtataccactttaaacatgtccatgtctacatctacttctgtctgtctatctatctgtcaatcatctatctgcctataatttatcaattaatcatctatctatctcaacaaaacttgctgtgataaagaaaatagtctatcatttcactgtttcatatagaaatcactagacacatatggctattgagtactggacatgtggccaatgccactgaagaacaatttttaagagtatttatttttaattgaataaaatttgaatttaaatagccacatgtggatagtggctaccagattggacagcagagctcccaactttaaaattacagttcaatttcaactcagtataatggggttcaatgtaactgagtaaaataattggatggttgaatttacccacagcagcatacagaaatattcactgataaatcagaactctgtagacctttctcacactcattttatattgtgtttggttgtgagttacatgattgctgcaggcaccatatttatttctgtgctccaggtctctaaaggtcctaatccagtcctgaccaaacagactagtgatggaccatcgtgagcttctctcaggagaaatatcaagagggaggccaacctgtaatcataagaacttctgctattttaatgccattcatcagactacagtcaatcaccatgcttctggctttttgtctatctctgctgtcttgtacatcctgagatagtccattctgagaactgtaccctagatcttgtattgcctgatgcctgtcaaagatgtaatccatgctgcttaagtgaggttgtgcacacaaatcaccatatctcctgcaagtttggattttgattcagtagttcgatggtggggtttgagattctgcatttctaataagctcccagatgtggctggtgctgctggtccatgaaacacactttgagtagcaagaggtgatctgtagctcagtattggtcctttaagttccctcaaacatatatagagaaaaggtcctaaatattgcaaattctctcaaagtttgtcaagctatattggaattctctcaaagtctgtcaagctctattgtagaaaatcaaatttttattgggaaaaagcctaccccatatttacttacagataaagtacttttaggatcattcaaggcacacacccataacactgagtatgtaagacagaaatgctctctctggaaattacagcagtgctggtgctgggatgccatgatgaggagtgtgtggcccacaatcatgtagaccttgggaaaacctggattaaaatgattttgcgtcatcctggccctgtataagatacatatcagaatgaaaaccactcccagtgtgactttgaattgcttttccattttttcttcttgggattagagagcttcacttagatttcatctaagctgtgatgttgtacgttgacctgatttacctaaaatgtctttcctctcctttcagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggtgaggggatgacccctggagatgaagggaagaggtgaagccttagcaaaaatgcctcctcaccactccccaggagaatttttataaaaagcataatcactgattccttcactgacataatgtaggaagcctctgaggagaaaaacaaagggagaaacatagagaacggttgctactggcagaagcataagatctttgtacaatattgctggccctggttcacctgtttactgttatcacaataatgctaagtaaaaaaaaaaaaaaaaaaaaaaaaaaaaaaaggagtgtggcgagaagatggccaaacaggaacagctccagtctacagctcccagcgtgagcaacacagaagacgaatgatttctgcatttccaactgaggtaccgggtgcatctcaatggggattgttggagagtgggtgcaggacagtgggtgcagtgcacccagcctgagccaaagcagggcgaggcatcacctcacctgggaagtgcaaggggtcagggaattccctttcctaggggtgacggacagcacctggaaaatcaggtcactcccaccctaatactgcgcttttctgatggtcttagcaaacggcacaccaggagattatatcccgcgcatggctcggagggtcctacgcccatggagcctcgctcattgctagcacagcagtctgagatcgaactgcaaggcagcagcaaggctgggggaggggcgcccgccattgctaaggcttgagtaggtaaacaaagctgccaggaagctcaaactgggtgaagcccaccgcagctcaaggaggtctgcctgcctctgtagactccacctctaggggcagagcatagccaaccaaaaggcagcagaaacctctgcagacttaaatgtccctgtctgacagctttgaagagagtagtggttctcccagcacacagctggagatctgagaacagacagactgcctcctcaagtgggtccctgacccccgagcagcctaactgggaggcaccccccagtaggggcagactgacacctcacacggccgggtactcctctgagacaaaacttccagaggaatgatcaggcagcagcatttgcgggtcaccaataccgctgttctgcagcctccactcctgatacccaggcaaacagggtctggagtggacctccggcaaactccaacagacctgcagctgaggatcctgactgtcagaaggaaaactaacaaacagaaaggacatccacaccaaaacccatctgtacatcaccatcatcaaagatcaaaggtagataaaaacacaaagatgggggaaaaacagcagaaaaactgaaaaatctaaaaatcagagcacctctcctcctccaaaggaacgcagctccgcaccagcaacggaaagctggatggagaatgactttgacgagttgagagaagaaggcttcagacgatcaaactactccgagctaaaggaggaagttcgaacccatggcaaagaagttaaaaaccttgaaaaaagattagacaaatggctaactagaataatcaatgcagagaagtccttaaaggacctgatggagctgaagaccatggcacgagaactacgtgatgaatgcacaagcctcagtagccaattcaatcaactggaagaaagggtatcagtgatggaagatcaaatgaatgaaatgaagaaagaagagaagtttagaagaaaaagaataaaaagaaaggaacaaagcctccaagaaatatgggactatgtgaaaagaccaaatctacgtctgattggtgtacctgaaagtgacggggagaatagaacgaagttggaaaacactctgcaggatattatccaggagaacttccccaatctagcaaggcaggccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaacacaaacccatcagactaacagtggatctctcggcagaaactctacaagccagtagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcttgaaggaagcactaaacatggaaaggaacaactggtaccagccactgcaaaaacatgccaaattgtaaagaccatcgaggctaaggagaaactgcatcaactaacgagcaaaataatcagctaacatcataatgacaggatcaaattcacatataaaaatattaaccttaaatgtaaacgggctaaatgctccaattaaaagacacagactggcaaactggatagagtcaagacccatcggtgtgctgtattcaggaaacccatctcacgtgcaaagtaacacataggctcaaaataaagggatggaggaagatctaccaagcaaatggacaacaaaaaaaggcaggggttgcaatcctactctctgataaaacaggctttaaaccaacaaagatcaaaagagacaaagaaggccattacataatggtaaagggatcaattcaacaagaagagctaactatcctaaatatatatgcacccaatacaggagcacccagattcatgaagcaagtctttagagacttacaaagagagttagactcccacacaataataatggaagactttaacaccacactgtcaacactagacagatcaacaggacagaaagttaagaaggatatccaggaattgaactcagctctgcacaaagtggacataatagacatctacagaactctccaccccaaatcaacagaatatacattcttttcagcaccacaccacacctattccaaaattaaccacatagttggaagtaaagcactcctcagcaaatgtaaaagaacagacattataacaaactgtctctcagaccacagtgcaatcaaactagaactcaggattcagaaactcactcaaaaccgctcaactacatggaaactgaacaacctgctcctgaatgactactgggtacataacgaaatgaaggcagaaataaagatgttctttgaaaccaacaagaacaaagacacaacataccagaatctctgggccacattcaaagcaatgtgtagagggaaatttatagcactaaatgcctacaagagaaagcaggaaagatctaacattgacaccctaacatcacaatgaaaagaactagagaagcaggagcaaacacattcaaaagatagcagaaggcaagaaataactaagatcagagcagaactgaaggaaacagagacacaaaaaaacccttcaaaaaaatcaatgaatccaggagctggttttttgaaaagatcaacaaaattgatagaatgctagcaagactaataaagaagaaaagagagaagaatcaaatagatgcaataaaaatgataaaggggatatcaccacccatcccacagaaatacaaactaccatcagagaatactataaacacctctatgcaaataaactagaaaatctagaagaaatggataaattcctcgacacatacactctcccaagactaaaccaggaagaagttgaaactctgaatagaccaataacaggttctgaaattgaggcaataattaatagcttaccaaccaaaaaaagtccaggaccagatggattcaccgccgaattctaccagaggtacaaggaggacctggtaccattctttctgaaactattccaatcaatagaaaaagagggaatcctccctaactcattttatgaggccagcatcatcctgataccaaagcctggcagagacacaaccaaaaaagagaattttagaccaatatccctgatgaacagtgatacaaaaatcctcaataaaatactggcaaaccgaatccagcagcacatcaaaaagcttatccaccatgatcaagtgggcttcatccctgggatgcaaggctggttcaacatacgcaaatcaataaacataatccagcatataaacagaaccaacgacaaaacccacatgattatctcaatagatgcagaaaaggcctttaacaaaattcaacagcccttcatgctaaaaactctgaataaattaggtattgatggaacctatctcaaaataataagagcaaatttatgacaaacccacagccaatatcatactgaatggacaaaaactggaatcattccctttgaaaactggcacaagacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatctagaaaaccccatcgtctcagcccaaaatctccttaagctgataaacaacttcagcaaagtatcaggatacaaaatcaatgtgcaaaaatcacaaatattcttatacaccaataacagacaaacagagagccaaatcatgagtgaactcccattcacaattgcttcaaagacaataaaatacctaggaattcaacttacaagggatgtgaaggacctcttcaaggagaattacaaaccactgctcaatgaaataaaagaagatacaaacaaatggaacaacattccatgctcatgggtaggaagaatcaatatcatgaaaatggccatactgcccaaggtaatttatagattcagtgccatcgccatcaagctaccaatgactttcttcacagaactggaaaaaactactttaaagttcatatggaaccaaaaaagagcccgcattgccaagtcaatcctaagccaaaagaacaaagccggaggcatcatgctacctgacttcaaactatactacaaggctacagtaaccaaaacagcatggtactggtaccaaaacagagatattgatcaatggagcagaacagagccctgagaaagaatgccacatatctacaaccatctgatctttgacaaacctgacaaaaacaagcagtggggaaaggattccctatttaataaatggtgctgggaaaactggctagccatatatagaaagctgaaactggatcccttccttacaccttatacaaaaattaattcaagatggattaaagacttacatgttagacctaaaaccataaaaaccctagaagaaaacctaggcaatatcattcaatacagaggcatgggcaaggacttcatgtctaaaacaccaaaagcaatggcaacaaaagccaaaattgacaaatgggatctaatgaaactaaagagcttctgcacagcaaaagaaactaccatcagagtgaacaggcaaccgacagaatgggagaaaatttttgcaacctactcatctgacaaagggctaatatccagaatctacaatgatctcaaacaaatttacaagaaaaaaacacaaccccatcaacaagtgggggaaggatatgaacagacacttctcaaaagacatttatgcagccaatagacacatgaaaaaatgttcatcatcactggccatcaaagaaatgcaaatcaaaaccacaatgagataccatctcacgccagttagaatggcgatcattaaaaagtcaggaaacaacaggtgctggagaggatgtggagaaaacaggaacacttttacactgttggtgggactgtaaactagttcaaccattgtggaagtcagtgtggtgattcctcagggatctagaactagaaataccatttgacccagccatcccattactgggtatatacccaaaggattataaatcatcctgctataaacacacatgcacacttatgtttattgcagcactattcacaatagcaaagacttggaaccaacccaaatgtccaataatgatagactggattaagaaaatgtggcacatatacaccatggaatgctatgcagccataaaaaatgatgagttcatgtcctttgtagagacatggatgaagctggaaaccatcattctcagcaaactatggcaaggacaaaaaaccaaacactgtatgttctcactcgtaggtgggaattgaacaatgagaacacatggacacaggaaggggaatatcacacactggggcctgttttggggtgggaggagtggggagggatagcattaggagatataccgaatgttaaatgacgagttaatgggtgcagcacaccaacatggcataggtatacatatgtaacaaacctgcacgttgtgtacatgtaccctaaaacttaaagtataaaaaaaaaaattcaaaaacctcagtggcatctaatgagaagcatttattgctcacaagactggatagtgagttctgctgatactgactggactcactctggtctggctatggtctgaggtagcctggccctgggggcgcgatggaggctgactcagctctccccacacctgtctcatgttccagtcaggtagccactggccaagaagccaagctaggaaccagggtatctgactcctgagctaaactctaaccctctacaatactgcctcccaaatataacaccaagtgctaggtacatatcatccacagttttcagacttctgcccaaactgggattctttttagtgtgaagagacctggcctgtggggctgaccctggtgtggctgtgaggcagacacaaagggacatttacatccagtcctgaagattacagtccagccctgaagcaacaactaggaaactattccaaaaggaggggatggggctgagtgtggggttctattctcttcataactttaactagaactcaaattgtgtaccttggtagcatccaatcataaatttattttgtcgtatttgtgatagaaaggaacaagtttatccacaaatttatttatttatttatttatttatttatttatttatttatttgagacagggtctgactctacgacccaagctggagggcagtggtgcaatctcagctcactgcaaactctgcctcccaggctcaagccatcctcccgcctctgtctcctgagtagctggaactacaggcacacgccaccacacccagctagtttttgtattttttgtagagatgggttttcaccatgtttcccaagctggtctcaaactcctcaaaagagttaccaagcaggactctgcaaccaataatccttgtgtgaagaggatatttgctcttttccctgtttttctttcttggtacagatgtgtgacctctttttgaaaggtgatagtgactttggtgtattttatttggtggtaatggtcatagccccattaatcacatttcttcccatgagaaagaaaaaccactacatggtcatgctaaggatttcagtccctggggtgaggatggtcttgaatatctcctacattcataactcctccacacatctcagtaggtcactgagcacatcaatggacatgccagttattaaaatacttcacgaatactatgatcatttaccagtatgagttattctctggagcttctaatacttcaatagtactgcatggactcagttgagagttaattcaaaatctcagattatccaattctgtttctttccttccaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggtacaagtctccagggaaatggagctcaccctgacccaggctggttcaagcatattctgcctctcttaatctacatgacaatcgtgtggttgtacaatcatttgcttgtaagtctttttatcacaaaaaagtgataattatcaaactttacaaaccacagactagaaaaaacgaaactacatccatccacagtcccagcacaagacaaagataatcaattatgtccctgtgggcatttttctacgcctatatagatttttaaaaattagaatggtatcactttttatttggtttgaattgctgcttacttgatttaacaggaaactatccactgacctatattactataaatatacatatatatgtatatatataaatatatatatatgtatatattgcatatgccataaaccatttaaccatgatgttatttcaggtgtataggctttttattcctttctgttttttctatgctgtgccctttagctctctgaatttaacagaaactttaaaacatgcttccacattccatttgctttcaacgttacttgctatttcctctgtagtaattataagagtgcaggctgaggtcctgagaagtcctcatccctaatggtttaagccacttcactgaagacacaagacagcacaggtcctcctggtcctatctgtggctgcagtcctgtgccagctcccttatactctcagtagacatctcacacactcctccttggaggtgtcttgagcatgctcttctgggaattcagggacaaggtcaggccttaggcacagttcgcactctggatatagttggtgttttcccattactgtattattaagcaaaatttagaatgaaatttttagggtactggctggtgattcaggatgcttgggatctagactttcattagcccctacctgcaagtttgctgatgggaggaaccttgtcttgttggtcatggtgtccctagtgctagcatggagtctgcacataatacttgttcacagagtaagtcagagctgaccaagttctctgttttctggagtagaggacttctatgtttcctgcaagctcagcacttccacctcctgtggctgcactaatacgaaatcagagaccactcgctgtacttcactttgaatcactcagtcaccaaaaagatagtgcttgccatgtgtcaggaacttggctaggcagggagaaattcatatgatttatataaatccataaatccatatgatttacataaatccataaattcatgtgatatatacgtatatgtgtgtgtatatatatattagagaatgtttgacatatacacaagtacatgttaccgacaccagcctatagaatagttttcgtgcatctccatatatctatcactggttccaacagccatcaatccatgttagctgccccatccaaatgccaccatcaccctcctcctgactatcatgttattttgaagcaatagcctgtaaatatttcagaatgctctccaaaatataaagactcctgtaaaaacatatgacaacaatgccattattactttctttgaatcaacattttttccttaatataatcaaatatttagaaatcaaatttgaataaaacatgggtcaatcttcaaagaatttatagcttaatggaacagatcaaggaaagcagggatgacactacagtagggtagcatcatatgcccatgtaacttatgtgacttaaactatcctgtaagggtgtgggggagaaagagaggaagagatggagagaagaaaaaggaagagaaggaggaggagaaggaggcagaggagaaggtggacggggaaggtagagaggaggaggaggggaattagaaaaaaagagatgacaggagaaggaaagggaaaaataacaacttgaaatagcacaagacgttttctccttctcctttctcaatgagcatgtgaccaacacaagtgtgagttgaggcaggaatccacttttccatccatcagtcttatcatttatgtgccttttatagtgtgaacacatcaccaccctgaatataattttagtgtttagagataaatattatttgcaacaatattcatctcatctcaagaaacgctcctatagggtatggagaatttaaaggacctgtaggttatgatgattataacgaaataaccaaagcaggatttcaatgaccagcccacaaaagtatcctgtgtactactggttgggaggtggagggggggttgttcttaagtaagaacccctaacatgtaactctgtggtttttatgtttcattaactatttaatctaccaatatggaactaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacaggtcagtacactttctgtatgttttattaagaatttttttaactgaagggtatatattttttaaaagaatatgcatgtttatcttttaataattcattctatgggccaaagaacctacttggatccatctttgatcattaaggatgcttcagttctggacttcaaaacctgtagcattaagaacatcatgtaaagtccacacagattagcatgacatgattatgtgtagtctctttgaacctgagtaagtttaaattcagtttcaagtcaattggaaagaagtgttttgcacaatcatgaagtgcaatgattacctggctgtgacttaaatggtgttctccatcaccagaacctgcagaagctctctcatgacagtggttctcaaccactagctgtatattggaatcaccagggagcttcaaaaattcatgatgcctgtgacatctcagaaattctaaactaattaacccagagcgtgactaggttctgtcatgctgtcgggtgaacccctgattagttctcacgtgaagccaaggtggagaatgactaatttcaggcatttctggtggatatgaaggactaccatagagcagggctatccttactccttgaccttatgttccaggtgatacatttaaagaaagatttagaatcttttctctgaagaagttaaagaacagatgtcattgattcatattaagcaatagcctataagtcttatttccaggaccggtgtatttaatatgcaactctaccccttaagtacactttgtgcttgggagaggaggaggatggagatggttgccatcttatctatggcttcagggcagctgtgtagctttcctatgtgtgtattcaggcagggggctcagccctgagagaaagtgggcctctggcacacctgggacagggaagatattccctggcaagctctcaggcatctcaggctggcacttctttgtatccatggcaatttgctttcccctcactgaactgagatcagaatgttactctgttggtggctcccccaacagtgaaggggtgactcagtgacaatagtgctagaagtatgagtcaaaacactgtacaacttgagaaattccccgtttgcactacgcttggaagccaagaggagatgttaaaaagaaaagaataattctttctgaagacatttcccatcattgcacttgatgggttcaactgggaagggttactagactctggaagttgaaaactgcccacataattaaactgtacaacagctactcaggattaccttgcaagttttaacctataaaaatttaactttatatagcacttccaaaatagtttgccataatacctactaatctggatttaatttttaaaactcatccttttaacttaagatttaaataaaaaaaaaaaaacacgagtccacaagaatttgtctcaggcctggcacagagtcagtgctccataaatattttgttaaacgatggatggtgagtgcttttactatccagtatttacccagcttatagattaagtatgaagagttcaagatacatggtgttaagagtcgtttttatatgcttgcaaagcatttttgtcatattttttctactttgcttccatcttttcttctttcacttcatttattaattctccatatgcttgtttaactattgtagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgtactgcatgagtagttggtgattttgtacattcattgagctctcccagagtctgtgtagagtgttgtgcattatgtagtataaaggaggtgaccaggtaagtgacagataggtagactcagcttctctgcttctcataggactacctctacccacctctagttagcattatcaactcctcctgagctctcatcagagaataaatatttctcaacaatttgatccataacttttaagaaaaataagaattatcatgatgactctaatagtgacatttatatcacgttttatttgtaatattctataagttttatattaagcgaagtgataaaatcccctttacaaaaatattatctgatgccatcctgcacactaaagagaaatctatagaactgaatgactgaaaaccagcaaataaacattttttatcattgtaatcactgttggtgtggggcctttgtcagaattccaatttgattattaacataggtgagagttaatctgctgtgactttgcccattgtttggagaaaatattcatagtttcattctgccttctttgaagaacatattttttgtaacactcaacgaagcacttatcatattattagttatgatttattatttttaccacatctcccctgacatttctggaacacaggaaacatgttttcttatacgtcttgcattccatcttcacctcccaattgtcttaatgcaatgaacactgaataaaaaattgtcaattcgtcagttgattgggcagcatgtctaaaagcactattcattttccttttttattctttcattttccctccttttctgaatactaaagccattaggtgggttgcagccatgtggtagccacacattaaggtggacaagagagtcatggtggctccaagtcagattccaagtgtgctggggaaggcatccacatggaggggcagcctgacctggaagcgggagcccaagcaatcagagaaggggtccacacagaggtgtggccttcaagagcagccagagcctaaatagggcctggagaacccacgtgaggtgaggagggtatccctgagtgggaagggatgggtgagagttggctacatagaagggattgatcacataagtaaataaagtatactggaagctaggtgtgtcacttttgcagaaaagagtcatagattcagaaagggagaaagctagcattaatcctatggtgttagattggaatggatgtatcagtgtacattcatacttttctagatagatagatggatagatagacagatgatagatagataatagatagttgatagataattagatgtaaatatatgtgtttgtatgtgtgagcatgcatgtgtgtgtgtgtgtgtgtgtgtgtgtgtgtgtgtgtgtgtgtataaaacatatattccctacttcactgatagggctagataacaatgacatttcaatagcaatgagtatacttagtgcctagatcttggcttatgaatatcattttccactgaagggaaccagagctcgttagagaaatagctgatgccagggctaggactaaaaatgttcaagatgagcccaggacactttttgtgccaggaagtaagaaaacactcaaatggtttctaaatggtatttggaaatgatttctaaatgatatttccatatgacttccaaatgatattttaaaaacctaaagactccaccaaagaactattagaactgataaacaaattcagtaaatttgcaggatacaaaatcaacgtacaaaattggtagcacttctatatgccagcaaggaacaatctgaaataaaatcaatagccacaaataaaattaaatacctaggaattaacttaatcaaagaagtgaaagatctctacaatgaaaactataaaacaccgatgaaagaaattgaagaggacacaaaaacatagaaagatattccatgtttatatatttcaagaatcaatattgttaaaaatgcccacaatacccaaag

SEQ ID NO: 12963 - DNA, 31197 bp, Human
gtcactgagcctcagtttctacatctgtaaactggggatagtagcatggcccctacttaatgtgctcagcaaagccactgaaaggagacagaaatgtatctaaattccctggacttttatcctacctctcttggggattgtcaccaccttcccatgtttgtcctttttggtttgatgcttgctgtcacttctttccttaggtgcctctctgtacggctcttttatcccagggattccagagttacagcacatgcataccaccatccaagcatgtttatttgtctcctgcttcactaggctgtccccaaggaacatgtggctcccggcacacacctggcacaacactgcacatgacattcacccacttggccttgaatctgacaaggaatctggcatgatgttcacccactcaggccaggtgccgagcagccctggaggcttaggggccagagggatgggaaaaggtgtctttctggggtgagtatcagtttctgcaggagggctgaatgtgagaaagaataaagagagaaggaagcgaacaagcacagcttaaacatcgcctatttctattgagttttaagaacgctgtgattttgtttgtcatgcaatccattcatcaggccaggcagacacagaacttgggtgtgagtgacgataatgagctgatataattttcacaccctcatcactgagatctctcccatcaggaatgggtcagggagctcacaggtggcagcaactgctattacaggcctcatctctaccagctcctggggcctgccctcctcccattagaaaatcctccacttgtcaaaaaggaagccatttgctttgaactccaattccacccccaagaggctgggaccatcttactggagtccttgatgctgtgtgacctgcagtgaccactgccccatcattgctggctgaggtggttggggtccatctggctatctgggcagctgttctcttctctcctttctctcctgtttccagacatgcagtatttccagagagaaggggccactctttggcaaagaacctgtctaacttgctatctatggcaggacctttgaagggttcacaggaagcagcacaaattgatactattccaccaagccatcagctccatctcatccatgccctgtctctcctttaggggtccccttgccaacagaatcacagaggaccagcctgaaagtgcagagacagcagctgaggcacagccaagagctctggctgtattaatgacctaagaagtcaccagaaagtcagaagggatgacatgcagaggcccagcaatctcagctaagtcaactccaccagcctttctagttgcccactgtgtgtacagcaccctggtagggaccagagccatgacagggaataagactagactatgcccttgaggagctcacctctgttcagggaaacaggcgtggaaacacaatggtggtaaagaggaaagaggacaataggattgcatgaaggggatggaaagtgcccaggggaggaaatggttacatctgtgtgaggagtttggtgaggaaagactctaagagaaggctctgtctgtctgggtttggaaggatgtgtaggagtcttctagggggcacaggcacactccaggcataggtaaagatctgtaggtgtggcttgttgggatgaatttcaagtattttggaatgaggacagccatagagacaagggcaagagagaggcgatttaatagattttatgccaatggctccacttgagtttctgataagaacccagaacccttggactccccagtaacattgattgagttgtttatgatacctcatagaatatgaactcaaaggaggtcagtgagtggtgtgtgtgtgattctttgccaacttccaaggtggagaagcctcttccaactgcaggcagagcacaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctgtgagtaactgtccaggctcctcttctctgtttccttggacttggggtgctaatcaggcctctctttcccttatctgttttgaagatcaaaaaagatgttcaggccgggcgtggtggcttacacctgtaatcccagcactttgggaggctaaggcaagtggactgcctgaggtcaggagttcaagaccagcctggctaacatggtgaaactctgtctctactaaaaatacaaaaattagctgggcatggtggtgcacgcctgtattcccagctacttgggaggctgaggcaggagaattgcttgaacccggcaggcggaggttgcagtgagctgagatcatgccagtgcacttcagcctgggtgacagagtgaggctgtctcaaaaaaaaaaaaaaaaaaaaaaagatgttcaaggagcagtagcttaagtgttggatgctacaaacatatagaggttattgtagatcttatgcagctctataaaggaataaataagcatcttccccatccatctttagtggcaagaagggttttgggatagcattgattgaggatgatctacttgacaatagtttggacccaaggaggataaggaaggaaagtagtgacggatctcattccaaacttggctgtggaaacctggcttctccttactaaactagaatttggattttacattttcccctttatgttgcagtagaagaggatgaatcctctcactggtgggatcctgccatcctagagcaggtagagagaagagtcactccccactgtgggtagtggaggcttctcacatgtcacatttcacttctacctcaatttcactcttactaagatttgggaatcataatgacaggaaaatagaaaatataaacctcattttaattctttcacagaaaggttagaaattcagtgagttgtggcaacatattttccatcttctgaccttttaacactaattgatatggcttaaattcattctattttaaaccagatttttttggagatagtctatttccaacatgttccttctaggtgacaaatgagggctgttagttcagtatttgttacaataaatgtgtgtaaaataacctcacctttccagaatcatgtcaggaatatgaatctaatgcacaaatgtataactctatgacaagattgcatatatcttttaaaatataccttcccaacgttcattttaatacccctatttcaaacaaacctgcttagcaggttatgttaaacgctcagggcagaggagtaagcaagactgtgagccagtgatgacagcaaaagcatccaggtaggatcaaaatggagtaagaaaatattcctcatccctcagggtagaactccaaagagatattcatgggtcctggccccgtagtggaggtcactcaaaggacaaacatgtttgcatctcatctgcttgaagcctggacacagaggcaccatctgtgtcactctgtgtgtggtctgccatgttgtggggtggtcactacagactcaggcagctgggcagacaataccttagccttagatgatgctgatgcagcccaggagtcagaaactgtagtgcagacaatgccctccttaggccaacacaattaagtgcaatagatgactggcttttctgttagcctcttcattggaaccaaaagcagcattactctaccaaacagaggggagctggaaagaaactacacagtttgcccagcctagcctctgccttgacacggaaccatgtgagtctagacattcacctagatcattccttggggaccaatgctgctgacacattaactcaatagtttgtcctggcctgagaggtcatgtaacttgtagaaagtttagaagcagagattagtgtcatttatttgccatggctgtgacaacaaaggaaggaacaggagtgggaaaacccaaggccaccctggttttggtagatggtgcacacgcttccactaactgttctggggcaaagatccaaatgcactattgggcctggctatgctgcttctgctgggtcccccaaacatgagcctccacgccatttctcagttgtattttaccacatattatcacagtcaccggatttgtacagaatatttggaacctatactgtcttaagggctaccctttaaagaagagaaaacaaggttttaattcaactgtctggaacattttatgtttacttatgtggaatactacatcttttgttataaacaggagggaatgtggacattcgaaggcccctaccttttagctaaaagcccatatgaagcatatggatccatttatacacaccatgcttttcagctacattttcctaatttgcctctctggggccaaccttgtgggactagcagattcatggttgagttgaaggatggtgacctcttccatcagcttttcttcttcctccagtcttccaaccctcagtaacatcagactgggaaggtcttcagacatccagaaaccccagttcggggagttcatacatgacccatcaaagatgagttgcaagcaggcctgccttagggagcaccagccttaatgggttttcctacagagatagttgatgggcagatgcaataaactgactgctttgtgattgaccaccttgagaaaaattagcatgtctggctatgttagtcttttcttgcattgttataaagaaataccagagtctgggtatttataaagaaaagggatttaattgtctcatggttctgcaggctgtacagaaagcatagtgacttcttcctctagggaggtctcaggaaatttacaatcatggcagaaggtgaaggagaagcagacagatcttacatggctggagcagaagcaagagaggctggggagaaggtgccacacattcaaaccaccagatctcataaaaactcattgtcacgaggacaacacctaaggcgggatggtgtgaaacgatgagaaactgcccctaggatccaatcatctcctaccaggccccacctccagtattggggattgcatttcaacatgagattttggtaggggcacagattcagaccatatcactggcactgtgctaatcagatgaatatcaccagttggaaggctagattccacaagaggaggaatgacctggaaattggttctttagttgtgattcttctgcacactgtcattcagggaaatatgagtcaatcatccttcccaataggtcaaatcaaccagatcatctgatcacagagactgaggtgtagctgaaagctgctcacatttctatgaggtcaatggaagccttgagcacagttgtcaatctgtagaaataaggactctgtgactcctccaagacctctctgtgaatgacggtttaagaagaaccagatcctaaaacagggtcagagcttagagggaagggaaagcataaaagcctctgagcaaattctaaagacagggtcaccataggctctcagtgaccctctgtgactgagtggctgcagtgatgcaaaatctcatcatcactgcggaagacaaaaaaatgtcaccctttctacctaggatgagaatccccaaatttggggagaggccacttactaaatagacgtaaaggaacaaagtgacctggaagaattcctgcctgaacctctcaggatcattcacatttgagaacatttatcaaatattcattccaggactgggaccatgaagacttcagctgctttgagctaatcattgtaactttttggtgtctcatggtggaggcaggaaaggacctgatgaacaaatataatcattgccgtcagagttactgttattatttcttgccttaatgttacctcgttctcttgagcattccagttcctcagtcaatgactcatcaacccctatatctataaagtcacaatcgctgtgacttgatttctgtttcactttgtagatatggaacccattcacatggactttttaagaagcttggaattccagggcccacacctctgccttttttgggaaatattttgtcctaccataaggtgagtgtttttgagctcactcttttgcttcttatgattgccaagagcagcttagttccatcagtaaaaatgcttctcctcagggggaaggtctgaagttttacactttcagaaacagtgtgtaggcatcacccagaacatggcaatgtttacccaagggctctcttgctaactctcaggaacctcaggtttgcctcagttgaacagcccaaatctcaggtagatcagcaacctgatgctcagaacttgatgtgcaaactttgtgagcgccataaagaaggttttctttttgctctatgcaggttcccaggaaggtacagtcatacttagttagtattaaaagtaggaaaaggaccccctgattgtgacttgttatctgtgtacatgagagtcaaactttcctctctgtagcaagagctcttgagtagccttttttcccttccttctggacagctttgaaactcaatttattagggagcccaggtatttacctttgggtcatttgcacctgcttcaatcctctccgaaaaatgctaaattccctgagggtatctccatggctctaccccagctcttactccccatgacatcttttgcagctttgagagacagaacaaaggggttctgctttatttcttttccttcaaaggctgcaccttatgggtgagactgatcacagactggatataactgagatgagacagtggtggtcaatcaaactcagatatttaagcacaaaatgagtttgtggggttttttttttacacaaaggcggaatcacatgcaaaatcactagaaaggggatgatttgatgaaattattaaatatttaattttgctgaatagaatataatatgtgccacgtggaccgtgaactttggccgagcctttgtgcctaacctagtctgatgctctgcccagggtctgggccctggatggaaaattaggagcccatgtccacatggccagccgcagcagtcagctctttggcttacatcatctttcccacatacctgaggcttgtttctcagattctaattctctcaggtgagggctttgttgtctaattactatccaggaatttcatattttttccctgtgcaaaagcaataatttccccgccaccttttccaggtcaactctttagtagatgtacccccaagatgcacattcctgggacctttgtttgcacagttaaaatgtcacccctgaaatgtcgatacaggaaggtttgtttttaagtttcagtgaaaactctgagcaagtgttgtaatttgctgtgtccgatgtgtagaggggacattttctcagaacttccatgttaagctggaaaactggaaagtgagttcactttgtcattctgtcactcgttcattttctcactcaacaacatgcctcatacttacctaaatctgctagactaaaggagttccctggtgtctgtaactttccaattctgctagaactctagagcgagctcatgaaataaatgaaaaggatgacaaagagataaaacactgtgcattctcttctgatgctaattcactttcccttggcctcagtttccccatgtgcccctggaggtgatcattcagggattcatgagattttcaagacaacacatgaaaaagcaaaaagacatcagaaagacaaagaggtacttagtatttatacacaaggataagtcattcagtatccacaacacttggagagaattcaagagtgattttaaatttcccttttcaaatacctcctctgttttctcttatttcctttatgacgtctccaaataagcttcctctaactgccagcaagtctgatttcattggcttcgactgttttcatcccaattagaggcagggttaagtacattaaaaataataatcaaatattattttgtttctcctcccagggcttttgtatgtttgacatggaatgtcataaaaagtatggaaaagtgtgggggtgagtattctggaaacttccattggatagacttgtttctatgatgagtttaccccactgcacagaggacagtctcagcccaaagcctcttgggatgaagctcttgtcaacctaactacaaacagagagaagttctctgaaagaagaagatatttatttgggtgtagagtattgcaatgggaatctgcatgcctttataaactatgtgcaaattcagggaagtaaagcaagacaaagaggctccaaggaaaatatgaggaggatttcttatcagttttgaaataattatccttcgctacaaagatcagtaacaagggtgacgcctcaccaaggttggacaggcagttgctgggcaggtgtccttgcagaaatattttttttaatgttgggatggcctttgtgcaagcttgtagttttgcggagtcttttgtgatagttttgttatcaggcacacaagcatgagaatcctctcttcatagccttctttgatttatttgtcagggtttttacacacacacacacacacacacacacacacacaactagtgacatcattttggttctaacaacattcacactggttattgtaaaacttttcgaaggttgtcctaccaaggatcccatgtgtcaccaggtgtcaagttctacagtctgaactaggctgggagcattgtgattacttttctccagactttggtggcccagggactcacagcatcatgctctgtccagtgtctgcctattcccctcttctttttttttttccttaggtgcccttttattacatgtgttgtctcagacccttctaatatgtgctcataaatacatcatatcatctccttcccacatcaattcactttcaattaaaagccaaaactctttcatttagactttggatttaaagtgcttttgaatgaagggttgagagataatagagaaatagattggcaaaccatttatactctgctgttgttgttttttaattttatctgcaagtgtggaacttttcattctgttttgttattaaatttaagccaagactttttaatagaagggtatataagcatttctttgtctataccttcctgctgaatttgaagaaatgctgaatattcttaaccactggcgggctgatggactgtgattttattttattttttatttttagttttttaaattatactttaagttctgggttacatgcatagaatgtgtagttttgttacataggtatacacgtgccatggtggtttgctgcacccatcaacctgtcacctacattaggtatttctcctaatgctatctctcccctagccccccacccaacaacaggccccagtgtgtgatgtttccctccccgtgtccatgtgttctcattgttcaactcctacttaggagtgagaacatgtggtgttgagttttctgatcttgtgatagtttgctgagaatgatggtttccagcttcatccttgtccctgcaaaggacatgaactcattgtttttttatggctgcatagtattccatggggtatacgtggcacattttctttatccagtctgtcactgatggacatttgggttggttccaagtctttggtattgtgaatagttctgcaataaacatatgtgtgcatgtgtctttatcatagaatgatttatgctttgggtatatgcccagtaatgggattgctgggtcaaatggtatttctagttctagatccttgaggaatcaccacactgtcttccacaatggttgaactaatttacactcccaccaacagtgtaaaagtgttcctatttctccacatcctctccagcatctgttgtttcctgactttttaatgatcaccatactacctggcatgagatggtatctcattgtggttttgatttgcatttctctaatgaccagtgatgatgagcattttttcacatgtctgttggctgcatagatgtcttcttttgagaagtgtctgttcatatcctttgcctattttttgatggggttgtttgctttttttcttgtaaatttgtttaagttctttgtagattctggatgttagcccttcgtcagatggatagattgcaaaaattttctcccattctgtaggttgcctgtttgctctgatgatagtttcttttgctgtgtagaagctctttagtttaatcatatcccatttgtcaattttggcttttgttgccattgcttttggtgttatatttatgaagcctttgcccatgcctgtgtcctgaatggtattgcccaggttttcttctaggatttttatggtcctaggtcttacatttaagtctttaatccatcttgagttaatttttgtataaggtgtaaggaaggggtccagtttcaattttctgcatatggctaggcagtttcaccaacaccatttattaaataggaaatcttttccccattgcttttgtgtgtcaggtttgtcaaacatcagatggtagtagatgcatggtgttatttctgaggcctctgttctgttccattgatctatatttctgttttggtacctgtaccatgctgttttggttactgtagccttttagtataatttgaagtcaggtagcgtgatgcctccagttttgttctttttgcttaggattgtcttgtctatgtgggctcttttttggttccatatgaactttaaagtagttttttccaattctatgaggaaagtcagtggtagcttgatggaaatagcattgaatctataaattaccttgggcagtatggccattttcatgatatggagtcttcctacccatgagcatggaatgttcttccatttgtttgtgtcctcttttatttcattgagcagcggtttgtagttctccttgaagaggagaacttcacatcccttgtaagctggattcctagatattttattctctttgtagtaattgtgaatgggagttcactcatgatttggctctctgtttgtctattattggtgtgtaggaatgcttgtgatttttgtaaattgattttgtatcctgagactttcctgaagttgcttatcagcttaaggagttttggggctgagacgatggggttttctaaatatacaatcatgtcatctgcaaacagagacaatttgacttcctcttttcctaattgaatatccatttctttctcttgcctgattgccctattcagaacttccgacactatgttgaataggagtggtgagagaggacatccttgtcttgtgccggttttcaaagggaatgcttctagtttttgcccattcagtatgatattggctgtgggtttgtcataaatagctcttactattttgagatacgttccattgatacctagtttattcagagtttttagcatgaaaggctgttgaattttgtcaaaggccttttctgcatctattgaggtaattatgtggtttttgtcattggttctgtttatgtgatggattacatttattgatttggtattttgaacccagccttgcatcccagggatgatgctgacttgatcctggtggataagctttttgatgttttgctggatttgatttgccagtattttattgaggattttcgcatcgatattcattagggatattggactaaaattctctttttttgttgtgtctctgtcaggctttggtatcaggagatactggcctcataaaatgagttagggaggattccctccttttctattgttcagaaaaatttcagaaggaatgataacagctcctctttgtatctctggtagaattcagctgtgaatccatttggtcctggactttttttggttggtagcctattaataattgcctcaattcaaaacctattattggtctattcagagattcaacttcttcctggtttagtcttgggagggggcatgtgtccaggaatttatctatttcttctagattttctagtttatttgcatagaggtgtttatagtattctctgatggtaatttgcatttctgtgggatcagtggtgatatcctttttatcattatttattgcatctatttgattcttcttttttctttattagtcttgctagcagtctatctattttgttgacctttttcaaaaaaccagctcctggattcactgattttttgaagggtttgttgtgtctctatctccttctgttctgctctgatcttagttatttcttgtcttctgctagcttttgaatttgtttactcttgcttctctagttctgttaattgtgatgttactgtgtcaattttagatctttcctgctttctctagtgggcatttaatgctataaatttccctctacacactgctttaaatgtgtcccagagattctggtacattgtgcctttgttctcattggtttcatagaacatctttatttctgccttcacttccttatttacccagtagtcattcaggagcaagttgttcagtttccatgtagttgtgtgattttgagtcactttcttaatcatgagttgtaatttgatttcactgtggtctgagagacagtttgttgtgatttcttttcttttacatttgctgaggagtatattacttccaattatgtggtcaattttagaataagtgcgatgtggtgctgagaagaatgtatattctgttaatttggggtggagatttctgtagatgtctattaggtcctcttggtccagagctgagttcaagttctgaatatccttgttaattttctgtcttgttgatctgtctaatattgacagtggggtgttaaaatctcccattattattgtgtggaaatcttagtctctttgtaggtctctaagaacttgctttatgaatctgggtgctcctgtatttgggtgcatatatatttaggatatttagctcttcctgttgaattgatcccatcaccattatgtaatgcccatctttgtctcttttgatctttgttggtttaatattctttttaaaataaaatattttaaacatatgaaacattatggagaatggcatgggaaatatccacgtatgcaccacccagcttaacaaatgctctactgtcatttctaaccatggtctctttgaagagctcttttgtctttcaatgtctcttccttgtttggcccacattatccttcatcatatgaagacttgggtggctcctgtgtcagactcttgctgtgtgtcatacctaatgaactagaacctaagattactgtgtattgtacaactaagggattatgtaaagtcaggatcaaagtctggcttcctgggttgggctccagctgtagaataaggctgttgatgtttaatcaactctgtttttttcacacagcttttatgatggtcaacagcctgtgctggctatcacagatcctgacatgatcaaaacagtgctagtgaaagaatgttattctgtcttcacaaaccggagggtaagcattcatgtgttgaaattaaaatactgattgattaaatttatattttgaaattcttatatattcatagacagttgcctaaaaaatgtccaggaaggttccacgtccacttcatcctgtcccccccgaatggtaacatcttgcaatcttgcataactataaatacagtatattcatgttactatatagtacaggaaattgacattgatacagttcacagagcttattcagatttcaccagctttatgtgccctcatttctgttctatgcaaatttatcacaatcatagatttgtgcaatgaccagcatgatcaaaacgcagaacccatttgtgttctatacaaatttatcacatcattagtagatttgtgcaatgaccagcatgatcaagatgcagatccactctgtctccatgtggctccctcctgctatcctacagtcacaagtctttttctctgacagggtccatatcagagcaaactattttttattttgaggtgatcaatgtattaatatttccttttctggattgtacttttggtgccatgtttgaaagttctttgcctagccctccttcctatattgctgtttttttctaaaagtcataaagtttaatgctttactaaatgtagctctattatcaattttgtgttattttttgtataaggtatgagatttagatcaaggttcattttttttgtggcttatggctgtccaattcctccaacgccatttttggaaagatgggtatattgttaaaaatcaactgggcatacttctttgcatctctcacgtactactgtgtcccattgatcactgtgtttattattccaccaataccacactgtgttgaccctagtagctgtacactaactcttaacctcgtgtagagtgattcttcccacttttattgacttattttttcagatttgttttaactcttcctggtcctctgcttttccataaaaattcagaatgagtttctcagtgtctacaaataaacgtgctgttattttgacaagaattgaattaaatatatagaccagtttatggaaaatgtgtatctttactgtttgatctttcaattcatgaacatagtatgcctctccatttccttagattttctttgattgcttttaacatcttgtagttttcagcatagagatcctgtacatgttttgttagatttacagctaaattatttcatttttgttggaatgactgtaaatgatattatgtttttcttgtattttcagatattgattgttgttacatagaaatgtgctttgattttgtgtgttgatctggtatcctagaaccttgcagaactgacatagtagttctagaagtctctttgtatatgccttgagattttacacattgtcagttatgtcacttgaaaatagagacaattcttttatttcctttccaatctgtatgccttttatttcttttcttttgtctattgcactaggacttcccagtataatgttgagtaaatgtggtgaatttttgaattgttcctaatcttaggagggaagccttcagttctttcatcattaagcatcatttagatgaagtgggctgtttttttgtagattctctttatcaaattgaggaattttctctccctagtttgctgagtttttatcataaatgaatgctggaagtactcattataaaaaaaatggctatggaagatgaaagaaagtttcaagcatgttggcttgataggccagttccaagttggcaaaaataattatctcttttttctttctatccatgaaataaaaaattaagagacaagaatgtttatggaattgcattatttcttcaaaatatgttcctagttttaaaggtattacctactattttttttaaaaccatcacattgaggcacttctttttcacgttgcccatgctgcaggagaacataaagacagcttgtctgaggcaacatacaatccaccaaagtcacctgcttgtctgtctccactccgtctctacactgcagaagtgctaggtcttgattctgtttattgtactggaagaacacattctctaccacgtggataatttgcatgtaaaagaagactgggatatagaggctggagacgacatcagggtctcctgaacactgccgccacccccccgccccgccccacacaaatacatcccaggacactgggcatctgggataaatctctattgagcatctagcatagggcccatcacccagtagacagtcactaaatagttgttgaataagtgttcctgtttaacacattttctacaaccatggagacctccacaactgatgtaggacaaaatgtttctgctttgaactctagccttttggtccagtgggatttatgaaaagtgccatctctatagctgaggatgaagaatggaagagattacgatcattgctgtctccaaccttcaccagtggaaaactcaaggaggtatgaaaataacatgagttttaataagaaacttaaagaatgaatctggtggggacaggtataaaataagatcacagtccctttccaaggggtagtccactgaatttgagctgcctaaaaatggtcttttatctttatgtacagaaaacacatcacaaaattcattataaaatgtcacttactgctccatgctggggaaagccatgtccttctgggactagagtctgcacatttaactatgggtggtgttgtgttttgtgcttagatggtccctatcattgcccagtatggagatgtgttggtgagaaatctgaggcgggaagcagagacaggcaagcctgtcaccttgaaagagtaagtagaagcgcagccatggggttctgagctgtcatgaacccctccagctgcctgccatggagctgatattcctgctgttgggttattccagtgaccagacaaaaggagggctgtggtaatgcaacttcaatgggtctcccaagatggggcagctccgatgaggaggtggggcagctggaggaaaaggatcttctcccctgtgcacaggggccagggtttacatatccattaaattgtcaccttggatattctagaagactaaatatatcctttagggggaaaaagtgtgattgtaccaaagttttaagcatggagtgtatgggatggtggaaggggaaggcacttggtatctgttggttggcagtgagtaggttgggagagttataatggagaacttagaataactttgatcatttcatgttttttttctgagggtatcagtagaatactaaatattaaacattcccaccatttctttttcctccagtctcaaagagagagggtggtaaaaacgctataggtggggcaagcctattatttgctgtctacacttatgcaggaacaacaggtgtaatctgagcctgtcctgggcagacaggggatatgtggtcactcactatagaagtttccaaatcaaattttgagagttttttttaaccaggacatcatttgtcattatattttacaaaaataattctgctgtcagggcaacctcagctcaccacagctggggatagtggaattttccaaagcttgagcagggagtatagagaataaggatgatatttctaggagctcagaacagggtactgttgctttgtaaagtgctgaagaggaatcggctctgggcatagagtctgcagtcaggcaatatcacctgtcttgagccccttaggaagagttaattattctactcttgttctgctgaagcacagtgcttacccatcttgtatcatccacaatcaatacatgctactgtagttgtctgatagtgggtctctgtcttcctatgatgggctccttgatctcagaggtaggtctaattcagttcagtgtctccatcacacccagcgtagggccagctgcatcactggcacctgataacaccttctgatggagtgtgatagaaggtgatctagtagatctgaaagtctgtggctgtttgtctgtcttgactggacatgtgggtttcctgttgcatgcatagaggaaggatggtaaaaaggtgctgattttaattttccacatctttctccactcagcgtctttggggcctacagcatggatgtgatcactagcacatcatttggagtgaacatcgactctctcaacaatccacaagacccctttgtggaaaacaccaagaagcttttaagatttgattttttggatccattctttctctcaataagtatgtggactactatttccttttatttatctttctctcttaaaaataactgctttattgagatataaatcaccatgtaattcatccacttaaaatatacagttcagtgatttgtagtacatttgaagatatgtgtgaccatcatcattttaaactttaaaactttttttgtcaatctagagacctcatacatttttagctatcagccccctgtcacaaaccctgtcatcatatgcaaccactaatcaactttctgcttctatggatttgcctattctggacacttcatagaaatgatattaattcatcagggttttttattctctagttcatgaatttgtactttagtctgtatcattttctttcttctgctggcttcaggcttagtttgcccttcttcgtttactatgttgtggcatgaacatagattactgatttgtgatttttttgttcctctaaatttagacattacagctgtaactttccctctgagcacttcctttgctaaatcccatgagattgtggcctatcacatcttagtttttgttcacctcaaaacagtttctatttgcccttttggtttctactttgactcattggttacttaaatgtttattatttaacttccacatatgtgtgagtttctcaattttctttcccttattgattttatctttattccatgataggtgacagagatatgctgtgttatttctatcttgactacctactatttcttgaacagcaagattaattttgagcttcagattatgatttgggttattctaggagactgtagtccaatagataaaggcaaagagattagggcattgaattttgttccttttatccttcaaaagatgcacaaggggctgctgatctcactgctgtagcggtgctccttatgcatagacctgcccttgctcagccactggcctgaaagaggggcaaaagtcatagaaggaatggcttccagttgagaaccttgatgtcttttactcttctggttggtagagaaaactagaattgctccaggtaaattttgcacattcacaatgaatttctttttctgtttttgttttgtttttcctacagcagtctttccattcctcatcccaattcttgaagtattaaatatctgtgtgtttccaagagaagttacaaattttttaagaaaatctgtaaaaaggatgaaagaaagtcgcctcgaagatacacaaaaggtaaaatgtggtggtagttataggaggatgtttagtttttcataattttttagataatatacatatgatcagtgcagttacctgtatgtttttaaagaatgcttttaacatgaagactgctcatgtttagagcaagagaattcatttggtagaaatgcagaaagtggggtttggggaaggagatatgagaatgagtcagagacagcacatgaaatttgatatcagacacaacaattagtatgccacggcataaattttattgagataaaactttaccactttacttcccttcaataaattgtcagaggataaacattactgtttggaaatatattttactgatattatgctttccccagatcataaattggtaaagactcatttcaagtacaaacctgttattttacacattctcaaatgaaagtccctatcaggccacctgctgaagtgtagcgtgtgttaaatttgagccatctcacatgatagccagatttgtttcaggaaaacatcctgctttccaaggatttagaagggtatgtttttcactggtgattcaggcaacatgcatcagatttctggtcttcaaggagccatattctcagaagggagatcaaggaccacgcttgtgatttacttctgacttcaggagccactttctgtcagtgaaatttctctttttgcttctagcaccgagtggatttccttcagctgatgattgactctcagaattcaaaagaaactgagtcccacaaaggtaaccagagtgtttctgagggctacttgtggggcactcagagggaaggccttgttctgaaaatgtgcaggaagtattccaggatgatgagaatttctgccacatagcagaacgacacatgtttgaatgttataagtggtagttggaggcactttctagaggcatgcaggcatagatagccatgttctaagagtaaagggcaaccctaagcaaacctggcatgctagaaagtcagtctgcggtctgtggatcacctacatcagatcaaatgccaattctcagcctccttcagatccactgaataaaaatttctgcctagaaatttattaggttgctgcaaaattaattgtgggtttttccattacttttaattgcaaaaaaatgcaattaaaagtaatggcaaaaaccacaataacttttgcagctacctaatacatctaacatccaatcaggagccacgctgttccaaaaggggtgattttaactggcagtacttgttgaaagtgtgttcaccaggttaatctactgcaaagttattttccactttggaatggattagtaacttgtggggaaaacctctgagaccgtgtaaatatcctctttgtcttcaatgtttcacctacgagttttacaacccatgtatgttttttactgaagtcactattactatgacagtggcaaaatgatgaccatggtcaattacaagccaccaagacttggcaaccatctcacaaaattcctgaatatttaactattggttctagagagcaggactgggcttactccagcatactgctttaaatatatccatgtctacatccacttttgtctgtatgtctatgtatctatctatgtatctatctagctatgtatctatctatctatctatcatctatctatctatcatctatccatctatcatctatcatttatccatctatcatctatctacttatatattatctatctatcatctaactattcatctatctatcccaatataacttgctgtgataaaggaaatagtctattgttttactgtttcatatagaaatcactagacacatatggctattgagcactggatatgtggctagtgccattgaagatcaattttaaatggtatttcagtttaatttaataaaatttgattttaaatagccactagtgggtagtggctaccatattggacagcagagctctaaactttgagattatagttcaatttcacatcagtatcatcaggttcatgataactgaatactatgattaggtagttgaatttacttataactgcatcacagaagtcttcactggtaaatcacagctctgtcgacctttctcacactcctttcatattggttttggttgtgaattacatggttggagcaggcattatatttatttctatgttccaggtctctaaaggtcctaatccagtcctgatcaaacagaccagtgatggaccatcctgagcttctctcaggagaaaaatcaagaggggcccaacttgtaatcataggagcttatgctattttaatgccatccatcagactacaatcaattaccactcatctagctttttgtccatctctcattcttgtacatcctgagatagtcaattctgagaactgtagcctagatctatcacctgatgcctctcaaagatataatccgtgcttctcaagctaggctatgcacacaaatcactgcatcttgtgaaagttcagattttgaatcagtagttcaagggtggggtttgagattttgcatttctaatgagctctcagatgcttctgacccatggaccacactttgaataccaagaagtggtctgtagaccaatattggtcccttaagttccctcaaacatatcttcgggaaacgtcctttgattttccctacatttaaccattagtgttgcaaattctctcaaagtttgtcaagatatattgtagctaaaataaattacatttttcttgggggagagtactacctcatattaacttacaataaagtacttttaggatcattcaaggaacacacccataacactgagtatgttatgcggaaatgctctctctggaaattacacagctgtgcaggtggcgggggtggcatgaggaggagtggatggcccacattctcgaagaccttggggaaaactggattaaaatgatttgccttattctggttctgtaagatacacatcagaatgaaaccacccccagtgtacctctgaattgcttttctattcttttcccttagggatttgagggcttcacttagatttctcttcatctaaactgtgatgccctacattgatctgatttacctaaaatgtctttcctctcctttcagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggtgagtggatggtacatggagaaggagggaggaggtgaaaccttagcaaaaatgcctcctcaccacttcccaggagaatttttataaaaagcataatcactgattctttcactgactctatgtaggaaggctctgaaaagaaaaagaaagaaacatagcaaatggttgctactggcagaagcgtaagatctttgtaaaacgtgctggctctggttcatctgctttctattactacaataatgctaagtaaaaaacctccaaaaacctcagtggcatctaacaataagcatttgttgctcacactcatttcacattggttttggttgtgaattacatgtttgcagcaggcaccatagtggtgtgtgatgtccccttagctgtatccacatatggacacaggaatttgctctttttatctctttttattttcttggttacagacatgtgacttttttttttgaaaggtaacaatcactttctcatatgttatttgatgctagtggtcatagcctattagtcacatttgtttcaatgagaaagaaaaaccagtacacggttatgctaaggatttcagtccctggggtgagagccgtctcgaatgtctccccacttcataactcctccacacatcatagttggatagtgagctctgctgatattggcaggacttgctctggtctggctgtagtctgacggagcctggccctgggtgtgctgtgcaggctgactcagctctccccacacctatctcatgttccagtcaggcagtaactggtgaagaagccaagctaggaaccaggatatctggctcctgagctaaagtcttaaaacactatcatattgccttccaaatataacaccaaatactaggtgcatatcacccacactgttttcagacctctgccaaaattgggattctttgtggtatgaagagacacggctttggggctggcccggctgtggcagtgaggtgaacacaaagggatgttcttcagagattacagtccagccctgaagcaacaactaggagactgtttcagcaagtgaggacagggctgtgtggggttctatcctctttataacttccactagcactgaaatcgtgttctctggttacatccaaccagaaccttctttgtcatttttgggatagaaagggactagtttatcctcaaattatttatggagattttatataatatagtgtttctctccacattttctgtatataacaaaagtcctccttttagtgtgtgtatacacatatatatacacatatatatgtgtgtgtgtatgtgtgtgtgtatatatatatacacatatatacacggttatgctaaggatttcagtccctggggtgagagccttcccgaatgcttcccaccttcataactcctccacacatctcagtgggccactgagcacagcaatgggcatgacagttattaaaacactttataaatgcttcgatcctttaccagtatgagttagtctctggagctcctaatacttcattagtactgcatggactgagttaaaagttaattcaaaatctcaatttatccaaatctgtttcgttctttccaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaaggtacaaggcccctgggaagggagccctccctgaaccagcctggttcaagcatattctgcctctcttaatctacaggacagtcatgtggttgtataattatttgcttgtatttttatatttagagatttttttaatcatcaaattgattattgtcacactttacaaaccatagactagaaaaaagaaaactacagtcatccacaattccaacaacttacgatgaaggtcatcagttatgtccttatgggtcatcagtgtccaaaatgtaaggactcttttaaaaacacatgatcacaatgctattattatgtcccccaaatgaatatttttttcataaatataatcaaatatttaggaataacattttaataaaaaacatgcatctaatcttcaaagaattttatagcttactggaacagatagacaaagaaagcagtgatgatactgcattacatcggtacagtagcatcatatgcctgtgtaaattatctgacttcaactattctatggaggtgtgggggagaaagagggagagatggagagaagaagaaggaggagaaggagggagaagacaaggtaaggaggagaaggaggagaattagaaaaacaagagaggagatgagaaggaaagtgcaaaataacaattttgaaatagtacaagacaatttccccttctccttcctcatgaccaatgtaagtgtgacttgaggcaggaacctacttttccatcagtcagtcccatcacttatgtgccttttatagtgtggacacatcaccaccctgaatataatttcagtgtttagaaataagtattctttgcaacactatttatctcatctcaacaagactgaaagctcctatagtgtcaggagagtagaaaggatctgtagcttacaattctcatagcaaaataagcatagcaggatttcaatgaccagcccacaaaagtatcctgtgtactactagttgaggggtggcccctaagtaagaaaccctaacatgtaactcttaggggtattatgtcattaactttttaaaaatctaccaacgtggaaccagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacaggttagtcaattttctataaaaataatgttgtattaataattcttttaactgagtggtctgtattttttaaaaagaatatgcttgtttaatcttttactaatttgttctctgggccaaagaatcaattaggcccatctgtgatctttaagggtgcttcagttctggagttcaaaagctgtagcatcaaaaacatcatgtaaagcccatgtagattagcatggcataattatctgcagtctccttgaacttgagcaaagtttacattcagtttcaagtcgattggaaagatggggaagtattttgcacagtcatgaagtgtaatgattaccttgttgtgacttttgaatgctgctcttcccaaccagaacttggagaagctttctcatgagagtggctcccaaccactagctgtacattggaatcaccagggagctttaaaaattcatgatgtctgggatatcacagaaattctaaactaatttgcccagagtgtggctttaaaagcttccccattgcttctcatgtgaagccaaggttgagaatgactaatttaaggcatttctggtggatataaaggactaccacagtccaaggccatcctgactgacctcaccttccaggtgcctagctccatccagctgggctccttttcaacccaattataactctattaatgttgttcccagccaggcatggtggctcatgcctgtaatcccagcactttgggaggccgaagcaggcggatcatgaggtcaggagatcgagaccatcctggctaacacggtgaaaccccgtctctactaaaaatacaaaaaattaccctggagaggtggcaggcacctgtagtcccagctactctggaggctgaggcaggagaatggcatgaaccccagggagcggagcctgcagtgagccgagattgggccactgcactccagcctgggtgacagcgagactctgtctcaaaaaaaaaaaaatgttgttccctttctcctcattttgttcttatctttcaagtcctagttcaatccccaagcccctccaaagtgtcttctcctcctagtccagggcccatttacttctctgctctgttattggatactggaggctattatcataaatttgacaatttgccattaaatcattgagttttattctctatattttctttgtatctaaaatgtcttcccccctccattaacaatatcctctcattttattcctttttaaaatatcccagtggtgccttgcaagggactgtatctaatgcaagcatttggtaaatgtttaaggagtgatgtgcagttgatggcttgcatacatatattaagctatttaatgtgaacctttaaacaaatgccattcgtgcatatgcatgtgtgtgtgtgtgtgtgcacatgtgggcatgcatgtctgtctgcagtgaaaatatattcagggtttttgaaaatttttaaataataaggtattatatttatagaaagatttgaaatattttctctgaagaagttaaagaacagacgtcattgattcatattaaacaataccctataaatcttatttctaggtctcatgtatttattattcaattccaccccttaagtaggctttctatataggagaggaagaagacagaaatagtttccatattatttccatattccatattatttgtggctttaggccagcagtgtagctgtattatatgtgcccagacaggggactcagccctgaataaaagtggtcctctggcacacctgggatggggaaggtactccttggtaagctcccaacctggcacttcttgatctccctggcaattttcttgcccattactccatggagatcagaatatcactctgttgtgtcccctcaacacggaaggagtgtctcaataagaatggggctaaaagttgagtccaaacactgtaggaattgagaggttccccacttgcactacccttggaagccaagagaagatgttaaaaaataaaatggtaatgcttcctgaaggtgtcttcccatctttacactggatgggttcaattgggaggaattactggactctggaagttgaagactgtccatataattaaaatgtacaataactacccaggtttaccttgcaagtttcaacatacacaaaattaactttatatgactcttcaaaaacagtttgccatcatacctaataatctggtttaaattttaaaaactcatccattttacttaaaatttaaatcaaaaaagaacacaggtttccatgaatttgtctcaggcctggcacagaatagtactccataaatattttgttaaatgatagatgatgaatgctctcactgtccaatcttcacacatcttatagactaagtataaagaatccaagatttatagtgctgaaagtagtttttatatgtttacaaagcattattgtcattactgcattttttttgcccattactccatagagatcagaatatcactctgttgtgtcccctcaacactgaaggagtgtctcactcactttgatgctatactttctacttttgtttatttaatgcttctcaatatgcttgtttaactgttgcagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcctaaaagcactcattccttttcttttccaaattcttcctttattttcccttcctgaataatttagtcctaaagccattaggtgggtggcagccagatggtggccacacattaaggtagagaagagagagtcatggtggctccaagtcagagaccaaggaggttcatgtggagagacatcctggcctgggtgtgggagtccaagcaagcagagaaggggtcgacgcagaggggtggcttgcaagagcagccagagcctaaatagggtatggagaacccacatgaggcgaggagggcatccatgagtgggaggggttgggtgaggtttggctacataaaggggattgatcaaataagtaaatgtattaaggatgatagaagccaggcttctcacctttgcagaagggagtcatggattcagaaagggagaaaactagcatgaatcctatgaaattagattggaatggatgtaaccgtgtatattcatacccttgtagatagatagatgggtagatagatgatagataggtaacagatagatgacagataatgagatagatagatgtaaatgtatgtctgtatttgtgtgtgtgtacaaaaaacatatattccctacttctctccactgatagggctaggtaacaatgacatttcaatagcaatgaacacacttagtgccccgatcttggcttatgaataccattttccactgaagggaaccagagctctttagagaaatggctgatgccagggcaagaattaagaatgttcaagataagtttaggacacattttgtgccaggaagcaagaaaattttcaaataatttccaagtaatctttggaaatgatacttgaaaatgacttccaaatgacatttccaaatgacttgcaaacgatttccaaatgatatttggaaaaacctaaagactccatcaaagaactattggaactgataaacacattcagtaaagttgcaggatacaaaatcagcatacaaaaatcagtagcatttctatatgccaatagtgaacaatctggcaaaaataaaaaagtaatcccatttacaatagccacaaataaaactaaatacctagaaattaacttaatcaaagaagagaaaggtctctacaatgaatactgtaaaacattgatgaaaggaattgaagacacaaaaaaggatatttcatgtttatatattgtgagaatcaacattgttaaaaatgtccacactactcaaagcaatgtacagattcaatgcaatccctcaaaataccaatgacattcttcaaataaatagaaaaaaatcccataatttgtatggaaccacaaaagacccataatagccaaagctatcttcagcaaaaagaacaaaactggaggaatcatgttacctgacttcaaattatactacagaggtacagtaaccaaaacagcatggttcttgtataaaaacagacacatagaccaatgaaatagaaaagagaacccagaaacaaatgcaaacacctacagtgaactcatttttgacactgctaccaagaacataccctggggaacagaacatctcttcaataaatggtgctgggaaagctggatatcaatatgcagaagaatgaaactagacacctatatctcaccagacacaaaaatcaaatcaaggtggattaaaggctgaaatctggctgagcagggtgactcatgactgtaatctcagtactttgcagaactttgagaggtcaaggtgggcagatcacttgaggtcaggagttcgagaccagcctggccaacatagtgaaaccccatctctaccaaaaaatacacaagttagctgggcatggtggtgcattcctgtagtcccagctagtccagaagctaaggtgggagaatcatttggacctgggaggtggaggctgcagtgggccgagatcattccaatgcacctcatcctgggcaacagagtgagacagactgaagtctaagacct

SEQ ID NO: 12964 - DNA, 22303 bp, Human; identical to SEQ ID NO: 12616

SEQ ID NO: 12965 - DNA, 21017 bp, Human
aggtgatccgcccgcctcggcctcgacaggcgtgagccaccatgcctggcctaattttttagtagtatttttttagtagagacgggatttcaccatgttggccaggctggtctcgaactcctgacctcaggtgatctgcccgcctcggcctcgcaaagtgctgggattacaggcatgagccaccgcgcccagctaacagcttatgttaatatggtacgtttgttataattgcaaatttgttttttgaaatacactgcagaaacattttgtactgaaaaaaaccctttcaacattttgattagaattgtaatatgttgtaaatagtcgttcgttccattccccaacagctgtgtattgagcacttccctgtgccaggcattgcagagtctagggatgctgtggacctcactgggggagggcttttctagtgaaagtgaccatgtattatgtaagtctgcctcccaagtgcatgtctccacttgttcagatctgggttcttttcccacatctgctcctgtgggttgagaacttgaatcccttcatgactgagggtcttgcctttgctccaaagtgacagtggcagaggaggcaggtcaggtagtaccgcaatcccactgacaggcacaaggtatcaaaataccagctgctgtgctggcgtggcctgcagattgccatggtggttcacaacattttgaattagctatctgtactgaaaaatcagagaatttcacttcaaagatcccaattttcagcttttctggaaaaatcaaagattttgtagcattgggtcttcctcccaaacccagccaattggcaagagccctgtagcaggggtgccctttggccacctccctgtggactccctctcctggactgaatgtctccaggattactaggcttatgcagcactttttttttttttttttgagacgaattcttgctttgtcgccaggctggagggcagtggtgcgatctcggctcactgcaacctccacctcctgggttcaagtaattctcctgcttcagcctcccaagtagctgggattacaggcacccgccaccacgcccagctaatttttgtttttgttttgttttgttttgtttttgagacggagtcttgctctgttgcccaggctagagtgcagtggcgcgatctcggctcactgcaatctccgcctccctggttcacgccaatctcctgcctcagcctcccgagtagctgggactacaggtgcgtgccatcatgcccggctaatttttgtatttttagtagagacggggtttcaccgtgttagccaggatggtctccatctcctgacctcgtgatccggccaccttgacttcccaaagttctgggattacaggcctgagccaccacgctcggcctaatttttgtattttttagtagagacggggtttcaccatgttggcaaggtggtcgcgatctcttgacctcgtgatctgcctgcctcggcctcccacagtgctgggattacaggcgtgagcctctgtgcccggcttatgcagcatttttccttctagaggatttcagagaaaagtgaaatcttgattacacccagcctgagtcattcattcacatgatcacagcgctggcccctcatacatatgcctttgagttcatggctgtggattcagctggttgttaccttccttctgctcacctctcagggctcacccgagacagcactgccttcaggaagccttccctcatatcctagactagcgagggcagactttgctgctggccaggcctccctgcagtcatcagatgttattgtaattacttattctggagctgctccttgcaggactgaatgctccatgagggaatgtcctctgtcttggtcagagactccttctcacctctagctccacatctggcatgtaataagcacttgttaactcttcagtgaataaatgtaggagtcttgtgtcctccactgtcttccttggcccctgatgtgtggttctcatcccaggcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcggtaatccaggggttggccactcaagtccatgcccaggggacacggtgggtcaggtagccttcggggatgtggaaagacagactagttctctccgtgctgcggtgctgagttcagttactcatttaacaaacactgactgaggcctgtcgtgtatccagccctgtgctgggggcagagttttagagaggggtcagccccggctgcccactacattggtgggggagtgacctcttcccagtgacagaagatgataaatgtcccaagagagggagaggatctcttcttggggctcattttagctgggcactgaatgatgaaaatgagaatggcatcttgccaaatgagttatgcatcttatgtggtgtcttaaaaaaaacattaggctgggcacagtggctcatgcgtgtaatcccagcacttgagaaggctgaggcgacttggaaagctgagatgggaggatcacttgggctcaggaagtcgaagttgcagtgagctgtgactgtgccactgcactccagcctgggtgacagagtgagaccttgtcttaaaaaaaatttttttttgaccgggagcattggctcatgcctgtaatcccagcatgttgggaggccgaggccagtggatcacttgaggtcaggagttcgagaccaacctggccaacatggcgaaaccccgtctctactaaaaatacgaaaatcatgccactgcactccagcctgggcaacagagtgagactccgtctcaaaaaaaaaaaaaaaatttccccatttaaagtccgtatacagtttagtgtcttttggtgtattcacagagccatgcattaccacaatcaattttctttctatttaaaaaatttgcagccaggtgcagtggctcacgcctgtaatcccagcactttgggaggcttaggtgggcgatcaccttatgtcaggagttcaagaccagcctggccaacatggcgaaaccccatctctactaaaaatacaaacattagccgggtgtggtgacatgtgcctgtaatcccagctactcgggaggctgaggcaggagaatcgcctgaacccaggaggtggaggttgcagtgagcggagatcgtgccactacactccagagcctgggcgacagagtgagactctgtctaaaaaaaaaaaaaaaaaaaaaaggagatggggtttcgctctgttgcgtaggttggtctccatctcctgggctcaagtgattctaccaccttggcctcccaaaatgctgggattataggcatgagccaccatgcccagccataatcaatttcagaacattgtcattgtcttgtaaagaaactctgtagtgatttgccatcacttcccaatcccccagctccccgcacccagttatctactttctgtctctatgtatttgtctattctggatatttcctataagttgaatcatataatatgtgaccttttatgactggcttctttcacttagcaaattttcaagtcatctgtattgagcatggatcagtgcttcatttgtttacagacagggtctcactctctcacccagacttcagtgccatggtgccatcatagctcactgcaacctcaaactcgcagagtcaagtgatcctcctgtctcagcctcccaagcagctaggactgtaggcacatgtaaccatgcctggttaattttttatttccttttttttttagagatgggttctcactatgttgcccaggctggtcttgaactcctggcctcaagcgatccttcttcctcggcctcccaaagtgctagaattacaggcatgagctgtcatgcctggcccttcattccttctttttttttttttgagacggagtctcgctctgttgcccaggctggagtgcagtggcacgatctcggctcactgcaagctccgcctcccaggttcacgccattctcctgcctcatcctcccgagtagctgggactacaggcgcctgccatcacgtccagctaatttttattttttgtatttttagtagagacagggtttcactttgttagccagggtggtctcgatctcctgacctcgtgatccgcccgcctcagcctcccaaagtgctgggattacaggcgtgagccactgtgcctggcccttcattcctttttatggccaaataatattccactgcctggatatatcatattttatttatccatttgtcagttaatggacatttgaattgttaccactttttggctattacgaagcatgttgctgcgaacattcttgtacagtttttttgtggagatgtagttaaatttaattccacagccacttctgggataggtcctaatctttactcatttcatcctcgaggaaaagccttgcagacctgaagtaacttatgtcaggacacatagttcctgccaggtggaatggggtcctaaaccctggtcaggacacatagttcctgccaggtggaatggggtcctaaaccctggtcaggacacatagttcctgccaggtggaatggggtcctaaaccctggtcctaccagtcttctttaatggtcacaagtctgtaagttacacagaagctccctatcattcactaccccatctactgcatctaacccagtgccagttggcccacaacaaatacttgttacaggggtgaatgagtggtggtctgtcttcttaggacctagaacaagagcgtcactctagtcttggatgcgccctgtgcctgtggctgcttgtctgggggcttctagggcaagtgtcttgtctaaatgttgatcactgaataaaatgggcccagcctggcttgccttctcttacccttgaacctgggttaggaccgcagagagcagcatttggcctttcccatgctcctcaaggccttcacagtgtctggtaactgccagctctcagacattgggcagacctggtcatctttactagagctgccctcaaaggaaccccaggaggaggtggccccgttacccactgccccttcctgcatgaggtgtctacatccctgacctctttgttctgagcctaccctgtagaaaacaagctcgtgaccttggcattaaattgggtattgaaggttagagaccaccaggagcacactgaacctctagcctgattttccatttttccttccctctccagggtctgcaagtggatgatgagattgtggagttcggctctgtgaacacccagaacttccagtcactgcataacattggcagtgtggtgcagcacagtgagggggtgagtggggctacctggtgtctcggtctgtttgggtttttctaacagtatgccatagactgcgtggcttacaaacaacagaagttcatttttcacagctctggaggcagggaagtccaagatccaggcaccagccaatttggtgtctggggagggcttgcttcctaactcctaggtggtgccttcttgctgtgtcctcacatggcagaaaggggaggaaccctgggagctcttgtataagggcactaatcccagtgggggcgccacccctcatgacctaatcaccttgcagaggccccacccctaataccatcacattggtggttaggatttcaacatatgaatttcagggggccacagacattcaggtcatagcactcggcctctggtctatagccctggagttactggaagtgttgctgaggccctggactgctgccttcatggtgttgctcagcacagccccattcaaggacttggcacctgctattccttctgtttagaatgctcttcctcttcatcctccttctgttttacactggtgacatgctcgcagggggcctttcctggctaccctaacccaaattcccctctcctctgccctgtctctgttttcatttaacaaggtttcttagagatcttttctttttttttttttttttttaagacagggtcatgctgtgtcacccaggctagagtgtggtggtgctatcataactacctcacggctaatttttttatattttgtggaggcggggtcttgctatgttgtccaggctggaatttttgttgttgttttgtagcaaagatccacacttttcaggagtgatactgtggcaaagcccaggaaaattattaactaaagtttttggttcccaaatgaagtctccagttaacccaacagttgtggattttttgactcctgcttagctgcacggttcatctacttgtaacccatcagtgcaggccaggccaggtcaggtcaggagatggctggcagttgcctatgcccctgctagtggtcaggccatcgtttctgcactgatactgtcatcaaatctgtaacttgtatggacgtttaaaatgatgattttgtgaaatttatcagtttttttgcttatggctcttgcattttgtgtccatttaaagaaattcttttttttttttttaattaagaaattcttggctgggcgtggtggctcactcctgtaatcccagcactttaggagggcgaggtgggtggatcacgaagtcaggagttggagaccatcctggctaacacggtgaaaccccgtctctactaaaaatacaaaaaattagccgggtgtggtggcacacacttgtagtcccagttacttgggagactgaggaaggagaatcgcttgaacccaggaggcagagcttgcagtgagccgagatcgcgccattgcactccagcctaggcgacagagcaagactctgtctcaaaaaaagaaattcttttaattcttttattgttttatttctgtttttcctttagtccatctgaaatttattattattattattattattattattattattattattattattatttgagatggagtctcgctctgtcacccaggctggagtgcagtggtgcaatcttggctcactgcaacctccgcctcccaggttcaagtgattctcctgcctcagcctcctgagtagctgggattacaggcgcccaccaccatgcctggctaatttttgtatttttagtagagatggggtttcgctatgttggccaggctggtctcaaactggcctcccaaagtgctgggactacagatgtgagccactgcgcctggtctatttttattatttttacaacagttttattgagatttaattcacatactacacagttcacccatttaaagtggtttttagtgtagtcacagaattatgcagccatcacaattgtacattttcatcacctctcctcctgaggcagccactttccagccacatgtccttcagaaagactgctcatataccagcacacagagctgccagttgattttattttattaaggtgtaatttacctgcaccagatccacctttttcagtgtacagtcccatgagttttcttctttttcttttctttttttttttttagatggagtcttgctctgtcgcccaggctggagtgcagtggtgcagtctcgggggggctactgcaagctctgcctcccaggttcacgccattctcctgcctcagcctcccgagtagctgggactacaggcatgtgccaccatgcccagctaatttttttgtatttttagtagagatggggtttcactgtgttagccaggatggtctcgatctcctgacctcgtgatccacctgccttggcctcccaaagtgctgggattacaggtgtgagccaccacacccagccgagttttcttttttttttctttaagatggagttttgctcttttgcccagtctggagtgcagtggcacgatctcggctcactgcaacctctgcctcccaggttcaagcgattctccagcctcagtctcccaagtagctgggattataggtgcccaccaccacgcccagctaatttttttttgtatttttagtagagacagggtttcagcatgttggccaggctggtctcaaactcctaacctcaggtgatccacccacctcagcctcccaaagttctgggattacaggagtgagccactgtggcctgccattcccgtgagttttcacaaatgtatgtagtatgtcattgccaccacgatgaaggtcaagagcattccaacaccccataaaattgcctcaggcttctttgtagttaatccctcaccgtcaacttccagaatgtcatagagagaaaaaccacacaatatattgccttttgagtctggtgttcttcactcagcccagtggattctgagacttctgtctgttgtgtggatctgtgagaagagctgctggtttttaatctgttttatccagttaaatgtattctcagcttccgtgtaggcttataaatccttctttataaaagtagtgattcaattttaagcaaaatgaatcttttcttcatgtgaaatttcacggggaattccaagatgtcactggataaaggctgagctgtcttggtgggctggaggatggagaaggtcgtgtgttgtgagtagggcctttctggcttcagcctcatcccctcaggggacctgagctcagctggagaatcaagaatccgggtttggttgtctgttttgtgagtcaagaaaaaaaaccttgcatagcgcagtggctcacacctgtaatcccagcactttgggaggctgaggcgggtggatcacctgaggtcaggagttcaagaccagcctggccaacatggtgaaaccccatctctactaaaaataagaaattaggcctggcacggtggctcacacctgtaatcccagcactttaagaggccaaagtgggcagatcacaaggtcaagagatcgagaccatcctgcccaacatggtgaaaaccggtctctactaaaaatacaaaaaaaaaaaaaaattatctgggtgtggtggtgtgtgcctgtagtcccagctacttgggctgctgaggcaggagaatcacttgaacctcggaggcagaggttgcagtgaaccaagatcacgccactgcactccagcctgggccgcacagcgagactctcccatctcaaaaaaaaaaaaattaggtgtggtggtactctccagctacttgggaggccgaggcaggagaattgcttgaacccgggaggcagaggttgcagtgagcttagatcatgccactgcaccctagcctgggcgacagagtgaggctctgtgtcaaaaaaaaaaaaaaaaccaaaaaactcacagtgttctattgtgagacatttagatagtttgccattttgtggagattaacactcttgcagatggatttctatttctttttttattttttttgagacgaagtttttctcttgttgcctaggctggagtgcaatggcatgatctcagctcactgcaacctccgcctcacagattcaagcgattctcctgcctcagcctcccaagtagctgggactacaggcacccgccaccacgcccagctaatttttgtattttcagtagagatggggtttcaccatgttggccaggcgggtcttgaactcctgacctcaggtgatctgcccgcctcggcctcccaaagtgctgggattacaggcgtgagccactgtgcccggcctttctttgtttttttttttgtttgttttttatttgagatggagtcttgctctgtcacccaggctggagtgcagtggcattatctcagctcactgcaacctctgcctcccggcacctggccttttttagcgaacttcctacagctgggatttctagatcaaatgcatacattttcaaggggaaaagatctttaaaaaattataaatgactgctgatggataatggatttctttttgggtgatgaaaatgatccagaattagatagtggtggttgtttatactaaatacattgaatatactgaactctgaatatactaaaactcacttaattgtatactttaaaatggtgaattttattgtatgcaaattatgtctcaatgataaaaataggctggctgcagtggctcacgcctgtgttcccaacactttgggaggccaaggcaggaggatcacttgaggccaggagtttgagaccagcctgggcaatattgtgagactgtgtctctccaaaatattttttaagaaattggccaagcatagtggcatgtggccaagctgctctggaggctgaggcaggaggatcacttgaccctaggagttcaagggtgcagtaagccaaggtcacaccactgcactccagcctggatgacagagtgaaaccctgtctcaaataaataaaatacatatttatccttaaaatcacatagtgcaattgtatttacaaacaaaagtcctagtgttatagctctaagaatttgtctaccaggttttctggtcgtcgctggaaacaccctctcccctcaaaaataaatttttttttttttttgagacagagttgtcgctcttgttgcccaggctggagtgcagtggcgcgatcttggctcactgcaacctccgcctcccgggttcaagcaattctcctgcctcagcctcctgagtagctgggattacaggcatgcaccaccaagcccggctaattttgtatttttagtagagatggagtttctccatgttggtcaggctggtctcttaattcctgacctcagatgatctgcccgcttcggcctcccaaagtgctgagattataggcgtgagccactgtgcctggccccaaaataattttttaaaaagtcctgtgtctctcccttccttagtgcctcttccgctgcacatgctgggtcctgggcgaggtactggggctgtaacggggaacgaaacaaacagggtccttgccttgggagcactttggtgggggagccaggccttaatcaaataatctcagctgtataatgatacacactgataagtgttatgaaggaagagtgttaagaagctcagagagtaaatcatggggccctgatttggtttgggattgaaggagtgttcctcaggaagtgaccttcagatgtgtatagaagtttctctggtcgaggggaagctggcagggagaaaagccttcaaagcaggttcataggccctggggtgggaggatcaaagaactcaaaggagggtggagcccagagcagaatggagagaaggggaggaggtgaggccaggaggtgttaaggtcaggcctgtggtccttagtaaagattgtgctgtttttttcctgaggtgcagaagggagccaccgcacagttccagattggggtgtgacaggggtaagaagccttctctggatgttaggtagagaacagattggagggtgacagagctgtagcagtcagtcaagagaggatggtggctgtgacaaatggggtggaggaaggggtcaatcaaagagacatttagggtgtaaaatccatgggccttaacctgatggagtgtgtcaaggaggcctccaggtttccagcctgcccagggctgtcatttatagaactggaagcacacaagtgtgtccctcacacagtttccacacgtgggtgcatgcgtctacagccactgcctttttttttttttttaggacagggtctctcgctctgctgcccaggctggagtgcagtggtgcaatcatagctcactgcagcctcaaactccagggcttgagcagtcctcctgccttggcctcccaggtagctgggactacaggtgtgcaccaccacacctggctaatttttttttttttcattttttgtagagacagggtcttgctatgttgcctaggccggtctagaactcctgggctcaagtgagcctccagcctcagcccctcaaaacattcagattattaagcatgagccaccacgcctggctgtgattgctttttgacaaagatgacacagaaaaggcctaatgtacatgttactctgcatttccgcccacttcgaagggaattccgtgtcggcacatttgtatcttcattcctttgaatgatcccaccatgttccattggtcggttcaccatcttttacttagccagcctcccatgttcgacatttaggttgtttccagtgtttggccgtaacaaacagtggtgtagcgagtgtccttgcctgtgggagaatttctgccatgttgctagatgtgtcattactgagttaaaagcagtgcacatttacccttcatagatcttgtcaaggtgtcctccaagaagcttgtgccagtgcaccttctctcaagtagcacctgtgagtgcgtctgtttctagctttcccaactatgttacagtctttggcaataacatagatattctttgacaatctggtaggaaatgacttttttttttttttttttttttttgagatggagtctcgctctatagccaggctggagtgcagcggcatgatctcagctcactgcagcctccgcctcccaggttcaagcgattctcctgcctcagcctcccaagtagctgggactacaggtgcctgccaccatgcccagctaatgtttgtatttttagtagagatgggttttcactatgttggccaggatggtctctatctcttgacctcatgatccgcctgccttggcctcccaaggtgctgggattacaggtgtgagctaccatgcccggcctatgctgtattttcttagatttagagattccattgatagacctgacatatttatttttttgtggtaaatatacataatataaaaattaccattttaggccgggcgcggtggctcacgcctataatcccagcactttgggaggccaaggtgggcggatcacctgaggtcaggagctggagaccagcctgccagcgtggtgaaaccctatctctactaaaaatacaaaattagccgggcgtcgtggtgggcgcctgtaatcccagttactctggaggctgaggcaggagaattgcctgaacccgggaggcagaggttgcagtgagccgagatcacgccactgcactctggcctgggtgacaagagtgaaactttgtctcaaaaaaaaaaaaattaccattttaaccattaaaaaatctacactttagtggcattaagtacattcacattattttgcaaatatcacccctacccatctcccatctccaaaactttttcaccctcctaaactgaaacccaaatctccattaaacactaactctccattcccactttccgcaggccctggcacccaccatcctactttctgtctctatgaatttgactactccagggacctcatctaggtgaaatcttacatactgtgtagtttttttgttttgttttgttttgtttttgagatggtgtctcgctctgttgccccggctggagtgcagtggctcaatctccactcactgcaccctccacctcccaggtttgagccattcttctgtctcagcctcctgagtagctgggactacaggcgtatgccaccaggcatggctaatttttgtatttttagtagagatggggttttgccatgttggccaggctggtcttaaactccttatctcagatgatctgcctgcctctgcctcccaaagtgctgggattacaggacactgtatagtttttgtctggcttatttcacttagcataatgtcctcaaggttcatccatgttacagcatgtgtcagaatttccttccttttaaaggctgtataatattcgactgtatgtatacaccacattatttttatccattcattagtcaatggacactaggattgcttccacctttttgttgtgaacaatgctgctttgaacatggttgtagcaatatctgttcaaatctctgctttcatttctttgtatatatgcccagaaatttaattgctgcatcatgtggtcattctatgtttaaagtttctaaaattttttttaacttcaatatatgaactttttttttttttttgagatggagtcttgctctcacccaggctggagtgcagtggtgcaatctcagctcactgcaacctccgcctcccaggttagtgattctcctgtcttagcctcctgagtagctgggattacaggcacccaccaccactcccagctaatttttgtatttttagtagagactgggtttcaccatgttgaccaggctcgcctcgaactcctgacctcaagtaatccacctgccttggcctcccaaagtgctgggattgcaggcgtgaaccaccacacctggcctatgaacattttaaaatgtcaaagatgacttccaggtttctggaatgagcttgcttatttatttatttatttatttatttatttatttatttatttatttatttatttattttgagacaggttctctgttgccaaggctggagtgcagtggtgtgatcttggctcactgcaatctggacttcccaggctcaagcaatcctcccacctcagccttgagagtagctgggactacaggcatgtgccaccatgcccagctaatttttgcattttgtggttttgccgtgttgcccaggctggtcttgaattcctgggctcaagcgatcccacccgtcttggcctcccaaagtgctgctattataggcgtgagccaccgtgcccggcgctttgtttaggttttggaggaccctccattactgttttccactgccgtgcaccgtttcacattcccaccagtggtgcacagggctccattttccccgcttcctcgccagcacttgttttctgtttcataatcagtgtgtggtagaatctcattgtggttttgattttcatttctcttatgattagtgacatggagcatcttttcctgtgctttttgatcatttgtatatcttctttgaagaaatgtctatttaggctgggcgctgtgtctcatgcctgtaatcccagtgctttgggaggctgaggcgggcggatcactcgagctcaggagtttgagaccagcctggggatcatggtgaaacctgtctctggaaaaaaatacaaaaattagccaggtgtggaggattgtgcctgtagtcacagctactcaggaggctgaggcaggagaatcgcttgagcccaggaggcagaggttgcagtgagctaagggattgcatcactacactccagcctgggcaacaggagtgaaaccctgtctcaaaaaaaaaaaaaaaaaaagaaagaaaaagaaaggtctattcaagtcctttgctcattttcttttcttttctttttttttttttttgagacggagtctcgctctgtcgcccaggctggagtgcagtggcacaatctcggctcactgcaaactccgcctcctgggttgacgccattctcctgcctcagcctcccgagtagctgggactacaggcgtccaccaccaagcctggctaattttttttgtgtgtgtatttttagtagagatagggtttcactgtgttagccacgatggtgtcaatctcctgactttgtgatctgcccaccttggcctcccaaagtgctgggattacaggcgtgagccaccgcgcctggcctttttttttgtatttttagtagagacggggtttcaccgtgttagccaggatggtcttgatctcctgacctcatgatccgcctgccttggcctcccaaagtgttgggattacaggcgtgagccaccacacccagccctttgctcatattctaatcagatttttttgttgatgttgaggtataggagttctttatatgttctggatgttaaatccttattagatatatgatttgcatgtattttcttttttcttttttttttttttttaagacagaatctcactctgtcacccaggctggagtgcagtggcacattcatggctcactgcagccttgagcttctgggctcaagtgatcctcccacctcagcctcccaagtagctgggactacagatgtgcgtcatcaagcctggctaattaaaaaaaatatatgttttttgtaaagacgagatctctctttgttgccgggctggtcttgaacttttgagctgaggcagtcctcctgcctgggcctctgaatgtgttgggattacaggcatgagccaccgtacccagcatgtatgtattttctcctatcatgtgggttgccttttcactctgttaatagtgtcatttgatacatagaagttttagattttgatggcatcttgttttatttatttatttttatttttttgagacagggtctcactctgttgcccaggctggagtgcagtggtgcagtcacagctcactgcagccttgacctcccttgagcaatcctcctgcctcagcctcccgagtagctgggactataggtgcacaccaccatgcctcgctaatttttatactttttgtagagtcagggtttcaccatgcccagcctggtcttcaactcctgggctcaagtgatcttcctgcctcccaaagtgctgggattactggcgtgagccaccgtgcctggatatcgtattttaatttgtaatttttttggtatgtactccccctgctttaattttaattttttaaattaaagtactatatacaggctgggtgtggtggctcatgcctgtaatcccagcactttgggaggctgaggtgggtggatcacctgagatcaggagttcaagaccagcctggccaacatggcgaaaccccatctctattaaaaatacaaaaattatctgggcatggtggcacgtgcctgtaatcccagttgctcaggaggctgaggcaggagaattgcttgaaccggggaggcggaggttgcagtgagccgagattgtgccactgtactccagcctgcgcgacagagaacccatctcaaaaaaaagaaagtaatacatacatgccaggtgtggtggcacatgcccaaaatcccagcactttgggatgctgaggtgggcagatcacttgagcccaggagtttgagaccaggctggccagtatggtgaaaccctgtctctactaaatatacagaaacattagctgagcatggtgctgcatgcctgtagtcccagctactcaggaggctgaggcacgagaattgcttgaacctaggaggctgaggttgcggtgagctgagattgcaccactacactccagcctgggcaacagagcaagactctgtctcagaaaaataaagcaatacatacgcatggttaaaaaattaatgatatggaaatatataaaagtaaacatcttctttttccaaaggactagtcctctctggaagtaaccactcttaacaagtttttccatgttcttccagaaaacttcgcacactagagcaacacaggtgtccttttagaaaatattatcggccgggcacggtggctcacacctgtaatcccagcactttgggaggctgaggtgggtggatcacctgagatcaggagttctgagaccagcctggccaacatggcgaaaccctgtctctactaaaaatactaaaattaggcgggtgtggtggcgggcacctgtagtcccagctactcaggaggctggggcatgagaattgctagaacctgggaagcagaggttgcagtgagccaagattgtgccactgcactccagcctgggtgacagagtgagactgtgtctcaaaaaaaaaaaaaaagaaagaaaatattatcaaataggttcatactttggtggggttttggtttgttttgactaaaacccttcattctctgtactgtatttgaacaatacctattgatggacatttctggtgttttcagtttttgaatttctacacagtcctggaatgaacatttcatttgtatgtctcgctaatttttatactttttgtagagtgctgggattacaggcatttgtatgtcttgtaatttgtatgtcatcttgcaattgtgtactatgtaccttggatgtaccttttaaagatcgttggtggtgggacacgtgttttttgaggaagatggtactgaggtcagcaccctggctgccctgagagtgcagtgccacgttccccaccctctcgccaaccacaggattatgctgcaaatgtaaatctttaccaatttgataggcaaaaaatgggatctcagcattttagcctgcatctctgagtactaacgaggctgaacacgaaatgagcttattttcttttcagaagcccctgaatgtgacagtgatccgcaggggggaaaaacaccagcttagacttgttccaacacgctgggcaggaaaaggactgctggggtaaagtatctgtttctgttcattctcactggggcatcatttgagtgtttgttaaacatgaagctggaggggaaggctggggagacattggggaataatgggaatccccagtttgcatggaaactgcagataaatcctcgtggtaggaacgagactacagctctagaagcagagggagccccagagtctctcctgggagtctctccagttcattcatgcactaggcatttgctttaaaagaatgaaagaacattggtgaaaaggtcagaagggctcagcctctgaccttcctgaagggagcctccaaacttacgccattccttttcttctttcttccagctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtattttccagtctcttttataaagtctcagactataataaacacagcttgcccagtttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattgtatccgagttcatacttctccaccccatcttgccaaggttgcggaaagtaaaaattggcagtattggccgctgcagcttcttaggggacgggaccatgtgaaaaggtgggatcgtgcgagcggaggaaggacagaaaagcgaggaaagtctatgccgccagcgaccggcaggaggcacgtcgggcacgctcgtcaccgtttcctggcacgtgaccaccgccctgccctgtcgctttagggcctgtcgcttccggcggtggcggttgccatggggacggagcttgggtggcaaccagaactagggagctggtggagaaggtggcggccgctggaaggaggcccggga

SEQ ID NO: 12966 - DNA, 56963 bp, Human
tgcctccccagtagctgggactacaggtgtgggccaccatgcctggctaattttttttttcaaagtcagggttttgccatgtggcccaggctggtctcaaactcctggcctcaagagatcctccttcctcggcctcccagagtgctgggattacaagcgtgagccctcactcctggcctgtgtatttttaatatacctgaacatccattctctctgtgtgttttatttaacagcctcccttagtcacctgcaaagtcttttccttgggagactgtttcctcaaccctgctgctctggggccaagccctggctcactcctttttattgaaacctgtgccatggagataataggggtagagagatcccttctgtggcagccactgacacactacagcttcgaggtggcacatccccctctcctgaagtcccctcacctccctggcgatgaagtcccacccctgatgggaggtggtgtcaggaggccttcaggtggtcaggccaggagggctccaccctgaggaatgggaccagtgccctcataaaacagaccccggagagctctccccagcccctagcgtggggagatacagggagagaactgtctgcaaccccgaagcggccctcaccagacacagagtcggccaggccttggcctcgggacaccggaaccgttagaactgaaggcttctgtgtgagcccccaggctgtggagttttttgtcatggcagccccagggggtcactaggctcccacttgattccaactcagcgtgaagtcacagccctgagtgccttctgcctgggtgccagccccggagccggggagcgggggagcggggggcggggaggggagtggtggtgtgcggggagtgcggggcgggcgcagggggtggggcaccgcgctgcgggcgggtactgcggagtcaggcaccaagggtccctgcctccctcactgctgagcgcgggctgcaggctggaatggctggagagccccagggctcgcctggacgcccagggcagggtgctcacgggagcatcgagggtacacggggaggaacgccggggttcgggcgaccctaggggcgacgcacagagctgggcgcggccactcacctcggtgccttctaaggacctggacatcctgggccttggcggcctgggggctccattcctccgcgcgctgaatggaagaaatcccgcccgggcatctcggaaggaaagcctcggagtccattcggccctggagccggataccaaccgccagggctttccaggcccgtcccgggaaatggttttcttaggcgagtgcgaggcgggcccctcggttccgatgcaggcgcactagatgccggcaaggcggggactaggcctaggggacctcggtcgcctcgaggtcgcggagaccccaaggccacggaaggacccgcgtctccgcagcccgcacgccgggaagcgtgcagagtcctcggcggggtcccgagcccgctggtcagagcgtggagcggcggggtgggagggacgtggtccccagagcgcggggccaccgtaggggcccctgatggggagggagggaagggtcggcccgacggggtcccagcagttccccgcgcgcagccgctcggctccctccccgtccagctgggagccgccagccctgggcgtccgaagatagcgggtgcccggggcagcccccaggggtgcgggcgagggcgcagggcggcccagacagttcccgcgtggaaggcgcccgtctagatccgcgacgtctcggacccccaggcccccgcaccccgtgtccgaggctccgggacgcgcaggacagtggagccgtggccgccgcttgctcccagccatctgcgtccgggaggcgggggcgggggcgcggcccggggaggtgaggaggaggagccaggacgcgagggcgaccccgacggcgggagggcggggcggggcggaccctgtctactggataagagcccgaggccgaggctgagaccgcccagcgctgcggagcgggaggggaggcttcgcggaacgctctcggcgccaggactcgcgtgcaaagcccaggcccgggcggccaggtgaggccagcgtcgctcgcggcatcggggcgccccgctccttccgcagaccccgaagtggggcgcaggggcgggggccgggggccgggcacagtctggggtccccgcgtcccgcagaccgcgccgtctccaaagtcgccaacagtcgcgggtgccgagcgccccccgatagcgccacatgggaccctgaggccgtccgaggcgcgaggagggtgcagggctgcccctggccccgctccaggctcagaaccgggtgggcacctggtgcagtcaccggcttaggggacgcgtgggtgtctatggctgtgactcgggggtcctggtttcttctcgtggaacttaaccctactaggggtgcggcgcatcccagatccgatcggagtgggttttgtacaccgccgctccatctcgcgggggctttgtctgtgttgggggtggtggcgggcgcgggctgcgcgctggtgctctgggcagggcggggaggccgggcgaggactcgccaggcagcgccgcttcttgttctgggcgcggtgaggaaggacgctttctaacgggccacattttgctgtgtagacccaaaactcgcctctgaggccccgcgttcaggagcggggtcaggtggccccagggcggcggcggcttgccggagactcgcgagctccgcacccgacgccctctcccaacgcggcctcctgctcgcgccgcggaaccccttcgtcgggtgttttacccaccggaggggtcgtgccggttgaggttgtcaccgggtgcgtggcatagctcgtgatagctcatgggtgaggttttgtgcaaacttggatgcagggaaagttgcctgttagagcctccacctgcgacctgcttcagtcgttgtgtgtgtgtgcgcacctgtgtgagtgtgagtgtgtatgtgtgtaagtgtatgtgctcgcctgtgtgtgtgtgagtgtgtatgtgtgtttgtgagtctgtgtgtgtctgtgtgtctgtgtgtgcgtgcgctcgactgaaacacgctgctgctggatccaaatgacagaagtcgccctggctggggcggtgtagacgctcctgctctcctgctcagcgttgcaggggggtttatgtagccgtttggacaggatttcccgggttaccctgctggcccaggagctagttcccgcgatgaagccctgtccatcctccgcccagctctctcacgcggggtggtgccacctgccctaggtggatgtggcttgtacagacactttttgaggaagcagttgtgatggttatgtctaaactctctttacagtggctgattttgcttatataaattttgctctttattactgagtataaacaatacaagcccaggcttggtggctcatgcctgtcatctcagcactttgggaggctgaggcaggaggatcgcttgagaccaggagttcaaaaccagccttggcaacaatagtcagaccctgtctctacaaaaaaacaacaacaacaacaaaaaaacacacacaaaaataacttagccggtgctgtggtgcacacctgtagtctcagctgctcaggaggctgaggtgcaaggatcacttgaacctaggaggttgaggcagtgagttgtaatcacaactgtattccatcctgggtgacagagcgagacctcatgttaaaaaagaaaaaaaaaagaaaaaagaatacagatgaacagtcatgaagacattattgaatgctcttagaagattgtaaaattgctctctggaagtgtgggggaaggtggaagtgatatccatgcattgttagtagaaagccacgctagagctcacacagccttgcactttgataggagtggggaggggtgcaggggaaggaggagcaaaccagagtgtctgtcttgaggcctccatgggccagtgccccagccctgtggtgagggctggcacttcccagctcccgtgccccagctgtaccatctcaggcgctgagaacgcacccatcccttcccagaggaatgcccgtgaatgcctcggggctctgccctccgcaccaggtatgtccctagccctggctgctgaattgttgcgttcctgttgtgtgtttatttttcatattggctgaagaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtaagtcccatctcagcctccctgagcatgctggccgggcgggggtcgtaggggcagccggggccaaggcacgtacggaaacgagatgaagctgttcccatgcgtgaagacggagctccctgtgagagctcacggccggtgcagatcctcccagaggatgtcacaaaaccattgagcaggactcggagctgccttgtcccacgcctgcatttcagagtttaggaaagggaggcccgcgaagaagctggggggtggggggcggcagacggggcagcttggctctgcctcctgtttccagaggctatcttcgctttggaaagaaaattctcaaaggtccaaagaacagcctgcggctgactttggcagcctttgcaaagcatgtggaggccctggagcctggagtggcagaggaggcccctggaaagtgactgtgtcccctgcaccctccagaacccagccacagagccagaaagcgaagatcgaggcagggccaccggggacgtccaagaacattggtgatcccttcccaggagcctctttgggcctcccagcctccctgcctggcctccctcattggcctctatgctaggtctgggaagggaggcctggggaagaatctggggggaagcctcacaggatgcctgcgaggaggctggcatttttatgcccatcttgaagaggggaagacagaggcctcagcaggtacaggaagttgcccaaagacagagctgaggggccccatgcctccccctccccttccccaggagagagagtggcaaagctctccctcactccagtcagaccaggggagcagagggaatttaggaggttgagaccagggttccctgggctttgtgctgggggtgggggaggtgcaggtttcagaggaactaggccttaccctggaggggctcccagcacctggggcagcaaagaccctcagccacagtcaataggggcagcctctgagggccccagaagctggggacaggacggcagggcccactcagctcaggggcagagttggggggtcacagattcacaactcaagaggcaaagaggatcagggcaaagtggggggacgcaggccagggaagggcaccccgaaccaccacggggaaggatagtacctagagcaccgctgagcatgggcagggcctccctgtgctgctcttgggtttgacttcatggctcgaggtgcgcaatgacaaggggatccaggagggacgtgtcaggcactgacagcagtggagggcgggcttcgggactcatctaccctagcctgggacttcccgttggagagtggggtgaaacggtcgggccaggacatggatggttgactggggtagccgcccaagctcccacgaggagagatgggcccttccgaggccccaaactaaaggtgcttttctgccccacaggtgccttcctggtcccctacctgctcttcatggtcattgctgggatgccacttttctacatggagctggccctcggccagttcaacagggaaggggccgctggtgtctggaagatctgccccatactgaaaggtaatatgcgggtgcctcccttcaccctggcgcagcgcggatcatggtggtgacgctggagctttcaaagcaagccagccgcatcatgggcatccagccctgctttgctaagacacaggcatggcacacgccacttgaacttgggtcccaccttaaagatctgcagtgacaaggactggatagttcattcccttgctctaggtgagggtcctgcaattcatttgtggtgttactttgtcaagatgctaaaatgtagttaagataaaacacatgtctatctatggatctgccatctacctatcatccatcggtccatccgtcaatcatctgttatctatctatccattatctatctttattattggtctttatatcaatcattcacccatctatctacctatctacctaatccatccatctatcatcatcatctatctgtatctgtttcctgtggctgctgtaacaaatgacacaaactgggaggcttaaaaggcacacgtttattgtctcacagctctggaggctggaagtccaagatcaaggtgtctgtagggttgatttcttctgaggctgtgaggaagcatctgttctagcctctctccttgtctcagagattgtcttctccctgtgcctctttatacttcttgcttctatgcatatctctgtaaccaaattccccgtttttatgaggccagaagtcctgttggattagggacaccctaatgacctcactttaacttgatcacctctgtaaagaccttgtctctaaataaagtcacattctgaggtttgcggggttagaacttcaacagatgaacttgggggagggacacatcccacaattctatctatctattatctgtcaatcatctattcacccgtctgtatctacccattcatcatctattttcttttgatccatccacctatcaatccagttcagtccagcccagtccagtgcagtccagtccagtgtcagtctattctaatggaatcgtagtcagtccagtccatgccagtccagtccagtccagttagtcgtattggagtccagtccagtcgtacgcgtatcgagtccattcgtatcgtagtccagtccagtccatgtcagttcagtccagtgtcaatctatctatggatctatccatccatccatcttctatctattcatctatccattcatccatctgttatccattgttccatccatccatccattcatctatgtatggattaatccatccatccacctatcgacctatccacctatctactagctattgatccatctagttgtcactgaacctttccggctgctgatgtcctgctctggcaccatgaaatggacacacctcgtgttgagtgcaggtggcctgcccagcaccaagccctctcccagcatttctgactccatcttcatgagaccctgggaagggcacacactaggtctctgtgttggagatgcagatgctgaggaccagagggccggggtcgttccccctggtgtccccatcagagcagagtgggatttgatcccagacgtttctgactccccaatccctgcacgcaggtcacacttgcccagtgggccaaagccacctctcaggggctggtggttcagggaggattcaggcatttactcagaggcaccactcagaaaattggcattaagaaaatgactactagaaggtcagcctctggatactcatagaagttctggaaaagctgtgtgtttagaagacagccgagcccagcacggccccaggacgcattaccaatgggtcaggggtgggccttcagaggcgagccgctgacctcccttaggagagggaacagatggcatttcacagctgctgaggtcaggctccaggaggagaagtcagtctcgcagccgtggaaatgctgagactggacaggtgtgatggttcttcccaggcacgagactcattcgttcttaatgggctgcttagtgaatcttatgacttcagtaatttcttcctgggctccacattcactggactgcactgaaatggagctacaaaaagaggcctccctccccacccccacccccacccccaccccacacacatcttcagagtgagagacagatgctttgggcatgcactggtgccagacgaccccttggcgggatctgcaggtagaagtcaaaccgtacaagaattgctcagaacatgcctccgtccccgtcgtcaggtccctgatatcaggtccccaatggaagaatgcagcagccaacggaagacccaggcctgttgttacagacagacaggggcgcgtgtcaaatccggcgttgcagtgaacccaggctaacagttcaagacacacgcgttacctgtgtcctgcctggccctggccagcggcacggacgtgtttcagagaggagtgctgcctctgagcctgcagtcgtaagcgatgctgagcttgcaccgtggtccgtgttggagagtatctgagggctcagagccttgggatgctgagtcagagatgaagccggcccactggggtaggggaaactgaggaaagatgacattgtgctctggcacaggctgcagcgacatccaactgtgctttgctggattttcaagagccaccctggagtctgtcacaagtgtcttacaaggcacagccctgtgccccactcccgccagtgagcctggtgttggagcaagttaaatcacctcttcacgtgcaggattcaggtgaggagggcaggagaaaaagggacctgtaggtccgcagataagagctcatttccttccgtctgtcacacagaaaggatgttcaccaacaaagctgccgttgtgggtcttcatggtgtagtccataaaatgtcaagaagcaatttctaagaatttcagagcaccaactcaacttgggctagtagagaacctctgacttccatcagcgtgagcagtggcacctcgttctgaagaaatgcagccggcggatgtgggcatatcatcgtgttctccacaatgcgcagccggggtaagctgggcagtcgtctcctctgtgtcacagaccctgtgcccacaatcccgcattccatgccgccagcttcgttctgaagactagtcccagaggagggctgcaaagtgtggccgcaggaaggaaggctcgtggccctgcgggcggatcttgggaagagcttgttcacactcacctagtcctggtgaggaaggaaaattgcaaatcacagaaagtgaactgttcgacccacgaagggatagatgaatcagtgcaagaaagctggacttctttttagagacgagacaccttgagttgttgaatctcagtaacgctgcaggttccggtgccagcgtcccgtttgttctgcctacctgtcaagcgcaggatgccagtttagaggagactgacattgcttatgaaatcagatgtacaccatgcacccccggcaccctgatacatgtgcctttgtcctttttaaaaatctggttaataaaaatgcatacgttttcatgtctcattgaatagaagtgccacgtggtaaattaagacatcagctaaagtgcccacaacaatcattgtggagctaaaaggccatccagccctgagcaggtggcaattccatgggggaatgaagccagctctccaggaagcctggttgttcctggcccttcccctcctgcagacctgcgagctgctccctgctcctaactgggagccaagatccacccttgaaagccagagggcggagttcatggtgaggcccagctgctcagcagccatgactcacgtgcatttcccgtagtctcaccagagcagcttgggatgggcaccacagccagaggggcctctggggccttcagccccgcagtgcaccccagggtcctgagaggtgggtctttaaaactctccgtctcctcccttcccctcgctctctttccctctccctgtgtctctttctgtctctctccctcctttcctctctgtgtctctcctgttctgtctcttctcctctctgtctctctcctgttctgtctcttctcctctctgtctctcgggtacatgcacacacagcaagcacatactaaagacacccagactgacacagagaggcgtcctctcccctctttcttttcttttcttttctttttttttttttttgtgagacggaatctcgctctgtcaccaggctggagtgcaaaggcgcgatcttggctcactgtcacctgcgcgtcccgggttcaagcgattctcctgccccagcctcccgagtagctggggctacaggtgcgtgccaccacgccccgctaattttttgtatttttagtagagacggggtttcatcgtgttagccaggatggtctcgattgcctgacctcatgatccgcctgccttggcctcccaaagtgctgggattacaggagtgagccaccgtgcccggccctctcccgtctttcttccaaagacctgcttgatgcctcctgtgaggtatggaggggctgctccaccagaggcttcctccagcgggatccgtgcatgcgttgacaacaccctctcctgaagccagctctcgtgggtgccctggggtgtactggtgttcaggggtggggcagggtggccgtgctctggtgggcgaagcaccatttgcaggcacgaccctcagccagcttctgtttgtcaggtttcggtttcattgccaagggcaaccccattttacagacgccctggaaaccccaccattcgattgtattgaatataaaatattttatagtcagtcatattttagtgtgatttctcaaacacaaaacaaactacacacaaggttaatataaagaaaaagatactaagcaaaaataaatttaaggaaatgggccttaaaagctatgcttgaaattcacacttagcgccgagcttcctgggagtcagacaggagggaagggaagcgccatgttctcatgaatgttttccctggaaacgcgagcagggactttgcctgccacctccttggggagacagtctcccgtgtcactaaatggtgtttaagaaatgtgtcaggtgaagcttcatctggagcccacagtgatgtcatgagcagagatcactagaaggttctgtagccaacagggtagtgggtttcctgcgtctgggccttcggtgagcttgaggagctcgtggtgaagttggctggttggtgaggggctacacgtcagtggcccaggtcacgggctctgccttcctgaagggcagggcttggagcaaccgaatgcctggccagtgctgacagtggccactaccgttcaagggagccatttcctcacccaggtgcccagggaagcatccaggaggggactggccaccaccgttcaagggagccatttcctcacccaggtgcccagggaagcatccaggaggggactggccaccactgttcaagggagccatttcctcaccgaggtgcccagggaagcatccaggaggggactggccaccaccgttcaaggctgtttcctcacccaggtgcccagggaagcatccaggaggggactggccaccactgttcaagggagccatttcctcacccaggtgcccagggaagcatccaggaggggactggccaccactgttcaagggagccatttcctcacccaggtgcccagggaagcatcctcaaccaggaggggtcctcttggtaagggggactctggtgtgggggctgcactgtcccatggatcagagcaggcccatttgctctgggagccgcatcagccagtgtggccagtggtgatgtcatgcacagtggccatggtgatgtcatgctcccatggtggccctgccaatctgtggtgcagggcaggaaacaaaagcagtggctctggaaggacccagggtacactcagcccttccttcggactctggattgggatccactctggtgttgtttgatcaaggacttcccagggtttcaagctaaggacttgatacagaaagttttaaccttgaaaaattttcaaattgggcatccattgtcagttaccaccatggaaaaccctccacagtgctctctggaaacaatgtggctcaccgacagtgtggctcccaacctggctgcctgggtgagttcactgtggatcacaacccagcctctctcctaagggactccggacagacggtaatatagaattatttaatatggaccagatccacgtgggagaaggccttccaaaggcaatccgtgacagactgcaatacagaattatttaatatggaccagatccatatgggagaaggcttttcaaaggcaatccatgacagactgcaatacagaattatttaatatggaccagatccacataggagaagaccttccaaaggcagcagcttggctttcatcgtcaccactactgagcatgctttccaagggggattacccgcactcctgatcttagatttgtttaaaacaaagttttgagtcttctttttgctttcaaggtaggaagagaactttactgaggtgccctgagcatgagaacagcttctcctaaggattgagactataaaaagcaacccaggccaccccctgcaaaagtcaccttgaaggtatgctcctaccccggccatgaacaggcaagacggcatggtgcctactgggttttaataaagtaaatcaaagttgtacccaaactaatcatgtcagtaaactgagaagaaatgtggaaatgaaaaaaattcttcctggagcttagtaaagtgaaccccagtagcaagaacgtgatggtgcccatccagcagtgaacaaggaggaagtcatctgaccaccaggcccatctgcccaccagtcaggctgacaccactccaaagactgctgaccactgagttctgttccagtttaccaggagaccccataaatgatggatcccaaattccaggtctgtgatcctggaaaggacactctaaaagaccgtggatggcattgcatggccatggatggccctggctggtccttgatggtcttgcatggccctggaaggcctcggaaggtcaaacatggctctgagtagtccttcatagtcatgcaaggctctgggtggcccaaggaagccctggatgatcttacctgccctgggtggaccctggtggtcttacgtggccctgggtgattctaggaaaccctggatggtcatgcatgggtagtgtgaccttggatggctccacatggctgtaaatgagctcagatgactcttctgagtagtcttgcaggagaggcatgagcagctatagatggccacagatggccatagatggctatggatggctctggatggccatgggtggctgtggatggccatgggtggccgtagatagttatgggcaaatgcagatggctgtggatggctgtggatgtctgtagatggctgtggatggttttgaatggcaatggattgttgtggatggccgggtggatgtgggaggttgtggacagccatggatgactatggatggctgtggatggatgtggatggttgtggttgggtgtggatggttgtggatggttgtggatggatggatggttgtggatggccgtggatggatgtgggtggccatgaatggttgtggatggctatggatgaccatggatagttgtggatgtctgtagatggctgtggatggttgtgaatgacagtggattgttgtggatggccaggggtggatgtggatggccatggatgactgtggatggctgtggatggatggatggttgtggatggctgcggatggatgtggatggccgtggatggccatgaatggttgaggatggctatagctgaccgtggatagttgtggatgaatggagatggctgtggatggccatggatggccctttgcgactcaaagtggccctggattagcctgggtggccatatgtggtcctgggtgccctccatagtcctgaatgagcctggtggctgtggatggctgtcaaggaccccaggtgtcccttagtgactattggcagtcttgatggctctgggagacactgggtgttcctgggtaaccctagacgacctttgatggccctatttgcatgggctccctaggtagccctgggtgcttctgggtggccgtggatgattctgatggtttcacatgggcctgatagccctggttaaccatgagttgggttgccctgggtcacccagagtaccccctagatggcctcaatgatcctggatgactcttatggatcctgagtggctgtggtggggatggatgaccatatgtggctgggggtgaccttggtgtccctgggggtctctgggtgcataagggtggccctggatactcgccatagctctgggtgaccttgctggctctggatgtctctcagagacaccctgaaagtccttgtgtaggagtgcatggttttggggagtgggcagcttcttctctgtggtcacagtgtgaaatctggtctcaggcctttcacgggccttccctgcatgtttgaagatgctgtctggcatcagggctgtccaggagttgtgggctcagggtaatgtctcccgtgaggggaggtggaagggacacgttgctgatggtggctctgtgctccacctgcgtgggctccatggcctcccccttcccgctaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgagtaagtgggagtcgggtcctcgggaacgggagagatggcgcagccaggtcccccatggtagccccttggttggacaccagcccttgctgactcccagggtgcggggagggggaatctgttcctgcactccatccctttagtgctctggaggggcacatttctgaatcactgtggtggtctccaggagctcagcaaagctcctgtagggcgagccctcagcaaggatggggcactgagcagctcccttggctgctcccagcggcagctcagggtgggagggggctgatggggaacacagcagaccctgtgcagaaggtgggcaagctccagtctctgggagctgcagtggcgcctctggagtgagtcagccccatgtctgggctcccttcctccctacccttcctctgtgcatagcatggggccgaactgcctcactccggcccttgccctctccagaaaagataactttctgggtgtcactgcgcaagaagtctctggcttcagtaggcagcccctgtctccagggtgacccagccgtccgcttttcacaagactttgttttgttgtttacctgcatggctttatttctgtctctgggcctctttccacctcccatgccagcgtatcccatgtccagcagcctcctgggtctctgtctccttctccctttgccctggccaggcctgacctgcacagtcctccccagccaggccagttcctcactgcccaccccagccaggcccaaccctcactgtccaccccagccaggcacaaaccacaaagtccaccccagccaggcccctcgctcactgtccacctcggccaggcccaccccacaccgtccaccccggccaggcccgcccctcatggtccaccccggccaggcccacccctcaccgtccaccccggccagacccaacccacactgtctaccctggtcaggcccatccctcactatccaccccggccaggcctgatcctcactgtccatcccagccaggcccaacccatacagtccaccccgaccagccccaacccgcacagtccaccccatccaggcccgtccctcactgtccacccaggccaggcccgcccctcaccatccacctgcagcacctgctttcctggaccccgatgtctccgatgaagtccttttgggccccgtgccagctcctgctggccctccctcgtcaccaatggcctggcccagcctggaagggtcgttactgacacccaggggttccctgtttcccctggacccctcccggaatctggatctggcgggtgccatccacatcttcctgccctcgccagccgggcctggggcctcgtgccgggtcgccgttctgacaggcggactcttcgactcagccgtcattttggagaggaggagaggacgtttgcgcgattctccccagatccagtgtttcccgtcagccagggcgctcctgtttggggggctcgcttgcctggttagacgcatcttattcacgtttatatgccaaaatgagtccacttcaaggtaggaaaaggaactttgaccagtaagactaattccagttttaacagccagtaggtgcctttgcaaaatttgttttgagtcagaaaacagggagcttgaaagcaaatgaagcatctcatgttaagtttgtacaagtcacggtgataggaacagccaggcgggaggtgagcagagaagcccccacctcgcctctgctgggggaggatcatccccgagaactttggtcttggtctgcaagggcaccttcggggcgcacagcctcccagagagatgctttctatatctgaaaaccgtatcaacagacatcactgaggtcttttcctgcaaggaagggaccttcgccctctcctgggggtcttgtcagagatggctgagatggagccttcgggcaggccggagggtgtggcttggagaaagtagggctgatgctgccggaaagggaccagttctcatggtgggcaggcgttcggtctctcaaactgctctgcactcagatattcagaacccaagtgcttggttctagaattcctcctcgggcatggaagcatattgccgggactggccttggaggtgaggagccggggcggaggcaggttttggggggccacccggcgtttttcttagagcatgaggaagaccatgggtcgcgtggggtgagcgttgtgtgggcctttcttgtggtttgggagtggacaagagtgacgaactctgaggaggacggtgccacgatgggagagagtggcccaccaagtacccagcaggaggagagagagtccaggctggggcgccaggaagacgctcatgggaggagggctggtttcagaaggtggggcaggtgggagagaagatgcacccgggatgagtcctggttgtttgcctgaagacacttggacgagcatcgccataggaagcgcagctgcaggcaaggtcgtgggagagtctgggcaggactctcgtgggtgacaggcaagcgggaaatgataaaatcgtccaaataatgcacagtcacaccatttgtccaagtagattttaacattctcgagggagaaaactcccattgcgtgtggatggcctgttcacacctacatttccctaattaaacaccctatgagcaccccaggcctgggctgcatgtgctcttgctgtgtgcccagctctcagggttagcatgtgatcaaagagaggggacagcaggagaaagtggggggcacacagagccaggggcagtggccgcagaggtgccaccagggcaagagcctgagagttcccggtacccaacgccctgttaaagctgccaagtgctgccatgtggggactgccttccttttgtttgggcagtgtgggaaatgttgactcattgaagtgatgttcagataacagaattggagaggaaaacttagtgtagtgattagtccagtgattcgttgttaagaatgctagaaggaaagaacacgtgttattattttaaacgatcagactagcgaagtctatttggaagttctcagtctggaaggaaggaaggaaacagaaaggtgcccagcccttcactcagaagccctgtccgcactggcacgtggtacactttagctggcggcagctcaagagcagacgtggggagttggagaaggtttaagatcaattcacaaatgattaatgacccaaggcactgaggtgcttggcactcctcccacaccttctgaaggtgattttcccaccagtgggactgaggttcccctgaaacaggccccagtgactcttggggagcagggaggacagtcataacgtactcaggtctgccaggggtgttctggatttcaaacctgctttataaagcagatcactggacaaaggatgtcgggttcctgccagcgcatgtaatcagggagtggatgtctcactgtgaaaggccataaaggccagagtggctgtgatgtgtgacagtgcagctctttgtcctagataatgggcatgcctgactttgtcagtaaacacaaaagggattgagtttcctacacaatgtacgaaacatgacgtgtcataaatttgacaactaagatgttagcaagagtagatctgaaagggctttatcgtgcgtttttactacaggtcctcaggaagtaaccgtgaggcctgggtgagacgctggccatgtcttctgggccctaagtcagaaaagactgctgagctgccccactaatggtgcttcctccatgtgccatgaatgccgtgtgcagtgctggctcctacacccagtgttcctcagggttggcaaatgaaacgtatcctgtgggagttgctggcacccctggcccccaggggtcccagccagccttcctgcattgccacttccttcttgggcagcagcccacccaccagagggaggtggcagaaatggttcctggagagaaataaaaggaacccttccttgtaggaacctggagattattgattggctgcatcccacacatttgatatgctgtgttttcatttcaaaaccccaacacaggaccacataactgtgaccagtttacagtttccccacttccataaatacttatcgacactgcctaatataaattataaagttataaattaaagctattaatttgcctcaaatggactgcattagctgcatcccacaaagtttgatatgctgtgttttcatttcattcagttcaaagtattccctaatctttcttttgatttctatttgactaacagggcatttttagaagtttgttgtttaatttgaaatatttggaagtttgctaggtatttttgttattgatttctaatttaattctgttttggcaagatgatatgcttatacatctttaatattttaaaatatattgagacttgtttatgacctactagatggtttacactggtgaatgttccacatgcacctagaaagaatatgtattctgctgtctttggttggaaagttgcataaatgtcagagaggttatgttaggtcactgtgtttttcaggttttctacatccttactggttttctgtccacttgctctatcagttactgagaaaggggtactgaaatctcaactataactgtagatttgtctatttcttttcacttctatcagtatttgcttcattcacatattttgaaactctgctatgaagtgcatacatgtttattattattagtctttgaattgaccgctttaccatttgaactatccttctgggttagatttctcattctgaagtctactttgtctgatagtaatatggccaccccaactttcgtatgattactgtttgtgtggtattatcttttccagccttttatttttaaactatatgtgtcattatatataaaatggatttattgtagacaccatcgagttggttgtgctttttatccaatatggcaatctctgttttttaattagagtttccattcaataattgtcagcatggctggctttaagtctttcattgtgctaattttttgccccctctcttctttgtttcttgtttcctctatttattccctgttttgaattaattttttaggctttcattttatcaacactattagctaataaactatagctttctgttttcatttcttcgtggattttatagggtttacaacactgaccttcaagtgacatgataccgtttcacagagcagaagggcctacaacagtagacttctgttttcctcacatcctttgtgcaattgttgtcatagattttttctacaatatgtatcaactccatgataccttgctgttatttctgctttaagcatttacattttaaataaatctaacaaagaaatgttttatatttacctgcataggcaccatctctagtgctgtccggtcctgtatgtagattggggtttccatttaagaccatcttccttccatctaaagaatttcctttaacatttctcatagcgtagacttgctggcagtgattcagcttgggctttacacaaaagtattttgccttcttggggggctattgtggtaagctatacatagcattgcttttaccaccttagccatttttcagtgcacagttcagtggcattaggtacaatcacatgttgtgcaaccatcaccatcatccattggaactttctcctcctccaaagctgaaattttgtccccattaaatactaagtccccatcctccctcactgcagcccctggcagctaccattctactttctgtctctgtgaatttgtctactctaggtccctcctctgagtagaatcacttatttttttgtgactgccttattttccttagcatatgtcttcaaggtttattgaagaatttcagaaccagaatttcattcctttttaaggccaaataatatttcaattccattgtatggatatatcatgttttgtttatccatttatctttttcctttttagagacaggatctcactctgttgtccaggctggagtgtgcagtggtatgatcacggctcactgcaggcttgaccttctgggctcaagcaatcctcctgcctcagactcccaagtagctgggactacaggtatgtgacaccacatccagctaattttttaaaattttttgtaaagtggggtcttgccatgttgcccaggcctgtcttaaactcctgggctcaagtaatcctcccgcctcagcttcccagagcactgcaattacaaatgtaagccaccacacctggccagatctatttatcttttgatggacatttgggttgcttccacattttggctactgtaaaaacatgctgctatgaacctcaatattgagtacctacttttgagtagatacccagaagttgaattgctggagctatgtgataattctgtgtttaattttttgaggaaccaccacactgtttcccacagtggatgcaaatcggaacaagggttctgatttccccacatccttgacaacacttactttctgcttgtttgttttgatcatagccatcctaatgggtgtgaagtggtctgtcattgtatttttgatttgtatttccttaatgattagtgactgttgggcatctcttcatgtgtttattggccatttgtataccatctttggagcaatgtctattcaagtcctttgcccatttttgaattgggctgtcagtttttttgttgttgagttttaggagttctttacatattttagatattattctcttttcagattaataggtgatttgcgaatattttctctcattctgtagttttcctttttactctgttgatagcatccttcagtgcacaaaagttttaaattttgatgaagtctaattcatcttttgtgtcatatctaagaaaccattgccaagtccaagattgtgaaaatttaccctatgttctcttccaagagttttatggttttagcccttatatttggctcttttatccattttgggttaatttttctatatcatgtgaagtagctgttcactgattttcctctggttgtagatcacatttcttgcttcttgtcatgtctagtaattttttattagatgctagacttggtgagttttatactaatgggtatttagctcttgtcgtctttgtttagagagtgttagatttgttctaataggaagttaacgtgctttggcacaattttatcctttggaagcttgtttcaccacctcactgccttggctccctcttggtaaaacggggtgagagggctgctgtgaggtcatcacaatgatgcatgggaggcctgagcatgcctggatcaccaccagtggctccactgtcacccaattgaatcatggccaggaattcaccaggaaaaagagcccagtagaaattgggaggtgctgtgtcttttccacgcctggtgaacatcctgggccaacacttttctggtcctcccaactattatggcttatgaaacacctgcacgtaggcctgcacttatgccccttcccggatgtcctttgatggtctcgcctgccctgccctcagaagcatggacatgctgggagacgcacagctttcccctgctcctggcatggctggttcccatgctgtggtcagctctggggacccctcttctcaggttgacagcactcaggagtgtccggttctctaaattgtctgtgggttttcaaataacctcaaagcacagtgactttctaatctcgagaaggggctcgacccagtgtgtcaaggtgctgcgtctgaagttgctttcatgtttaatgctgagccagctgtgtgtgctgtggacgcaaccttgtgagaaggccctgagtggggcagcgcactttccctgggcctccccctctggtccaggagggcctgtgccatgtatgggcattgactgagtttgccttttctccaggcacctgggcaaggggagagggtgtgctgtctggtctgggtgtataattcatgcacgtgtgtgtgtgaggcactgaggctgccaaggcgtgggcgggtggcatgctggggtcagtgacaccatgggcagtgagggaggagtggtccgggctgcacaaagttgctgggaggcctcagaagctctcagtgatgagaccttgctgggggagcagaacgacggggactggccagcaggggcagagcctggtgtgtggcaggaggagtgagaagaaggccctgggagtccccactgccccaggaagggcaggcgtgacctccaccagctcagacaactttccctgcacagtgcgggtgacggatagcctcttgactgagcggcttgcccttggagaagagcagagaatggtggcgatggtttcagtggtgcagccatctgcccacccggccaacctggggcctgtgccaacctggggcctctgcctgggcgccctccaggataggacggaggcactgtccagcgctttcagggctcgtggggccttccctgttggcaacagccagggtgtctggagtttgaagagccgaattcctgggacatggccctggaatgccttgcagctggtggaaagctccccaaggctgcattcggccgggctccaccatgggtgtcaggttttatctcctggggacctcagtggacccacaacagaagcaaacctgggcagtgggagctcctttcataacgcggcttctgtctgtcacagctcctgactctacggtggcagcggcacggctgttacagttgtcttggccccaagtcacagtctgcagtggtgacgcagctgactgcatgtagcctggtgcatgttctcccacagagagtgtcaccaggatggaatgagttcccacagacagggggcccaggacctgtgcctggggcaaggagcacagccgatggtcagctccatccctcaccctctgttctgccctttctgagggatccttcaaaaaacagtggaactgcgagtgattcctgctggagcagagtcatccactgaatctgttccttgtggaatcctcatagcagcaggggctgtgagcaggtgtcgtgagccatcccctcagaaaacagtgctggctggtgcctgtgtgcctggcattattgctagagtttgctcggcctcatccctggagagggaccctggggctgtcttgtgggcagcagtgggtacccagcagcatgggcagcactgtgggcagcggtgggtacccagcaccatgggcagcactgggcagcggtgggtacccagcactgtgggcagcagtgggtacccagcactgtgggcagcacctgtgggcagcagtgggtacccagcactgtgggcagcagtgggtacccagcactgtgggcagcacctgtgggcagcggtgggtacccagcaccatgggcagcactgtgggcagtggtgggcacctagcaccgtgggcagcactgggcagcagtgggtacccagcagcgtgggcagcactgtgggcagcggtgggcacctagcaccttgggcagcactgtgggcagcggtgggcacccagcagcgtgggcagcactgtgggcagcggtgggcacccagcagcgtgggcagcactgtgggcagcggtgggcacccagcagcgtgggcagcactgtgggcagcggtgggcacccagcagcgtgggcagcactgggcagcggtgggtacccagcagcgtgggcagcactgtgggcagcggtgggcacccagcagcgtgggcagcactgtgggcagcggtgggcacccagcagcgtgggcagcactgtgggcagcggtgggcacccagcaccgtgggcagcactgtgggcagcggtgggtacccagcagcgtgagcagcactgtgggcagcggtggttacccagcaccttgggcagtactgtgggcagcggtgggcacccagcagcgtgggcagcactgtgggcagcggtgggcacccagcagcgtgggcagcactgtgggcatcggtgggcacccagcagcgtgggcagcactgggcagcggtgggtacccagcagcgtgggcagcactgtgggcagcggtgggcacccagcaccgtgggcagcggtgggcacccagcaccgtgggcagcactgggcagcggtgggtacccagcagcgtgggcagcactgggcagcggtgggcacccagcagcgtgggcagcactgtgggcagcggtgggcacccagcaccgtgggcagcactgtgggcagcggtgggcacccagcagcgtgggcagcactgtgggcagcggtgggtacccagcagcgtgggcagcaccgtgggcagcggtgggcacccagcaccttgggcagcactgggcagtggtgggcacccagcattgctcagcaacttccttttggtttctgtggctccttttcttcaaagacccaaggtgccctccgcctccgcagctccagtgagcaggggtgccaagggcagatggtgaggcagggcttcctgggcctcccacgtgctccacgggtttcaagggcggccctgacacctctgccagggcctgtgggccagacctccctggaaggcatctcttgtccatcagactggatgctttctgccctgctgagatggggagggcaggtccccggacaagctcagccgtccagttccaggtgggttgacagccacccacagagtcccccgctgactcccctctgcagacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtgaggctcgggggtcaccaattgggcctgtagacatggggccaccaagtggacatgtggccgtggctggacaggaggtgcacgtgtggcctcagttgggttttgtgctaccaatgtggccatggccaggttggggtggacacatggccatggttgagtttgggagactcatatggccataatcaggttgggagtgtacacgtggccatgattgagggtacacctgtggctgtgccgggttggcttgggtagacgcgcggccatgggtgggtggggggacacgtggccgtggctgggctgggcggacacacggcacagttgggttttgggtccacgtgtggctgtgtttggggaagggcctcaggagggaagcactcacagcagtgtttctggcaggaaggcacacacaagatgatttttttgttgataaaaatactttgggaggctgagacgggcagatcacctgaggtcaggggttcaagaacagcctggccaacatgatgaaaccccatctctactaaaaatacgaaattagccaggcacggtggcacgtgcctataatcccagctacgtgggaggctgaggcaggagaattgcttgaacccaggaggcggaggttgcagtgagccaagatcatgccactgcactccagcctgggcaaaaagagcaaaactccatctcaaaaaaaaaaaaaaaactttggttgttatatgggccaaaaccagttttgaccaagatacgactcctcccttggaaaagtgcgtgtagtatggcaccagccacgggagcctcccgcagggacacagcccagagcagcccttcatcgtgccacagtgccgttcaccagtgtgaatccactcacgtcccacgcatcagaaaacccccatcagccactcccagctactctggcggaccgaatgcagaaaaggaatgtgctttccctgccaagttgttcttccctttccatccctggggagggtgtgcaggacagaaagtgtctgaccttctcactccaaggagcatttgctgagctggcgtcccaggaaatgtttgggaattgggcctcccaatcagaggacaagccgtcagggcaacccggtgcccttgtgccagtgtctgctcccaccaagggccctgcctgtgcagcctggtgacactgtcctctcctgcaggtggtatggatcacagccaccatgccatacgtggtcctcactgccctgctcctgcgtggggtcaccctccctggagccatagacggcatcagagcatacctgagcgttgacttctaccggctctgcgaggcgtctgtgagtacagtctgctcactgcttcacagtccacaggggctctggcattcccaggtttccatatgcattgcctgccagggctgagaggtgtcagagttgcagacaccagggttctttcctcgggaagccaaatcccaagtacctgtgatacagcacgagtcatctaaatcaaattacatcagaaactccatctagactcaggctgcagctttggtcagcaaaagaagacataattcagggttaaaatatttggagaaagcctcccggagagaggagactcagctgggccatgggggatgggacccttgtccagaaagggaggagaaagggctgcacccttcctggcaaacaggcccagaaacagaagcagctgttggcggaaggctggcatgacaaaaatggcagctcccttggggcatcgttggaaatcaggtggactaagtgggggaggtggcaggccccaaagccgcccaggggcatccatgttgctgtgggaggacaatgcagcaagaggggaagggccatctcagctggggtatgaggcaggaggccgttgagaggtgctgccctgtgtgggtgggccggtggagccaggtctgggggtcatgaggcaagtgtaaacccaaggcagaagtgggaaggaaggggagaagggatgggcgggcatggctgcaagcctcccaggaagccccagggaggcagcagctgacaggtgcagtgagagagggcacctggacatggcacctatgaggctgcaaagcagttgggtgggggtgggggtggaagtgtgcctgcagcactgaaggggaagccctgtggagacaggagccatgggtgcagcaggcgtgtggcccacgggagccaaggaagagagaggaggacaaccagggcagcaaaatcagctgtggccgggggcccacaagtgcagagctggagccagacaaaccatgaagtcagcagggcgtctggaccccagaaaggccaaaatgaagccaaggggtgtgtttgcaggaccatggcatgttacagaatcaaagaaaaataccacaaggacaacgtagagcctagtgctccagctaggaagaataggcagccccaggaggaggcaaaacaaacaccagtgcatgtgaaaagatgctcactggagaacaaattacaaagatgagatgtcagaaattaggtggagacagtgaatagattggatggatggatggatggatggatggatggatggatggatggatggatggatgaatgctaggtaagtaggtggataggatggatggatgataggtgggtagatagaatggatagataggatgggtggatggaaggctggctggctggatgtatggataatggatgggtggatggaggaatggatgataggtaggtagctggatagtatggatggatggatgatggatggatggatggatggatgaatggatgatgcatgggtgaatgggtggatgaatgatagttagctagataggatggacagatggataatggatggatgatggatgggatggatgggtggatggatgatgggtggattgctggatgatggatggctgggtggatggatgaatgataggtaggtagctggatagcatggatggatggatggatggatgatgaatggatgatggatgggtgaatgggtggatgaatgataggtaggtagctagataggatggatggatggatggataatggatggatgacgggtgggtggatggatgatgggtggattgctggatgatggatgtttgggtggatggatgaatgataggtaggtagctggacagcatggatggatggatggatgatggatgggtgggtggatggatggatggatggatgatgggtggattggtggatgatggacagatgggtggatggatgaatgataggtagctggatagcatggatggatggatcgatgatggatgggtggatggatggatgatggatgggtggatggatggatgataggtaggtagataggatggatatacaataggatggatggagatagatacatacacacacatgtacttcatatattcatagatgatagacagttgatagattatagagatgacagatagatgatagattggtgatggattgatagatgacagtgatagatgatagatagatagatgattgattgatagataatagatgatggattgatgtatagtgaagagaaatcaggaaagaaatggaaggaaaggacaattgcaggtcctggagtgaaagtgcatgaggtgaggcccagggaggcagccatgggcactggctctggtgtggcactgggcagaggcctgagctgcacacacagatcagggtgaggaggaggcaggcgctcccctgtgacacctgatccagcctgcagctacctggccaggcaggtggctgatgaccagcatgggagccacatcagggtatgagcctctccacccactgcccacccagccactctcggcttggctcctcccctcatgctgaaacactggccacctgcagagtcctgactgcggggcctggccatctgcctccaaacacactgtcccaggaactggggttgccttgaggctctgacatgctgcccaaaggacagagggccccgccccctctgcagcacccagttcccttgctcagtcaagctcaggcaagcttgacctgggacctgggatgccctgagacccacctggcctccccagcaggagcatctggtgtctctgcctcagcatcctggcccacaggcctgtaccatgggctccagggacttgcaggaacagccctaactgaccagtccctcaaatgcctccaagggggggttggctgctccttctcccccatccaaggcccagggaagggcaaggtgggcatctgagtcactgaatggtctccgcagtgccctcaccttagcaggttgtggctgactttttaaaataccacaatggtccaatcgtggacccacccacctttcctttcacgtccagagttgtgggtgccatccaccgagttgggcaggcacagcaccagtgtctaagctgcaggtgggctcctggccatgcccaggtgccactgtgcacctgtactgctcatgttttgggaaggatacaaagcaggcattgctggtgtgcgtccaatcaggacaccatcatcatgtagcatgtggatgggtccatgcctttctgagggttatcagggtgctgccatcatgcagcatgtggatgatccatgctgttctgagggttgtcagggcgccaccatcatgtagcctcaggatgagtttatgttgttctgagggttatcagggtgccgccatcatgcagcttgtggatgatccatgatgttctgagggttatcaggaagccgccatcatgtagcctgtggttgagtctgtgctgttctgagggtttcagggcactgccatcatgcagcagggcgcacatgggatggggggacacactcagggggttgtgaagctggaccctgatcaagggaggatggagaccccgctagggctggtgtgagtgtggataagtccatgctgttctgagggttatcagggcgccgcggtcatgttgtgtgtggatgagttcatgactttctgagggttatcagggtgccaccattatgcagcatgtggatgaatctgtgctgttccgagggttgttaggacgctgcggtcatgtcatgtgtggatgaggccgtgctgttccgagggctattaggacgctgcggtcatgttgtgtgtggatgagtccgtgctcttctgagggctattaggacgctgcggtcatgttgtgtgtggatgagtccgtgctgttccgagggctattaggacgctgcggtcatgccgtgtgtggatgagtccgtgctgttctgagggctattaggacgctgaggtcatgctgtgtgtgggtgagtccgtgctgttctaagggttattaggacactgtggtcatgttttgtgtagatgaggccgtgctgttccgagggttattaggatgctgtggtcatgccgtgtgtggatgagtccatgctgttctgagggctatggagcagggcacctctggttctgtggaatcgctgccttgatactccatggggaatcccagatcaatgaacacagacagccccctgcttctcaggctcttccaggccgctggcccgggagggttcacttcctgaggctgcatcttccaccagtcgtctgctgccatttacttcttgaggatggtgttgagtttagaggcctcagtgtggggctgggacaggaagggtgctcaggtcctttgcctgtggcctgcgttctcctgggacagcctctcaccgccctctggctctgcaggtttggattgacgcggccacccaggtgtgcttctccctgggcgtggggttcggggtgctgatcgccttctccagctacaacaagttcaccaacaactgctacaggtgagcccctagcagggccaggcaggggcctcatcaatactagggagaggtcgctgacttccagaaatagtgtgtccctggatgagaacagggcggatccactgaacccgcaaacctgtgagctgcgtggcctttcagacagaagcgacagcgaggcagctcccaacacgattttgatttcaactttaaagaaggcactgaagccagtgggtgtgtcgcctcctgggagggacctgcctaggtttgacctgcggccagattccccactgagggccccaagtggcaaggccagcccctccctccacaaggacacaccctcttccctcacaccagccccggggggtctctgtcctccctcgctcagggtccagcttcacaaccccctgagtgtgtccccccatcccatatgcaccccgtgttacttactggcaggcacctgaagccccgtgccggaccccaaatccttctaaaaacagaaacagaattttatccgggatctgcttgctttgacctttatggacttgtgcttactttctttcacatcatgaggctagaaacacggtaaaaatacaaggacagtgtgtgcagcagaatggccaggcagaccacaagcaggcttcactgagagtgggcgctggaaggcaggtcctgaggcagcgcctgcccgcagcccacctgcgtccacctgggtccaggtgctctgcagatgaagtgtgtggtccttccaccccagtgacaggccacacaggaacccaggaggaggacgctggtgccctgaccgaccccaggaccctccctcttcgtccttcgcttgcctccagctctctggtttctcagccctcagagtggggcccccaggcccgcagcaccagcgcccttgggagttcatgggaaacacagcccccgagaccccatgagacccgcccagtcaggatctgcatcttagcgaggtccccgggaggtgtgtgctcctagagcttctggaagatctgccctgggtgaggtgtccacagcaagactcgcggggcacaggggtggccgtctgttctgcccaccctgagccttgatggctgagccttgagcagctcagctaggggaccaaggtggcccaaggacagctctgccaggctgctaaggagctggccgtgctcactgggaaaagtagcccctccgaagacctcccgcccccttccccagacacagtaaattaagaataatgactggaaaattgcagctgctgcagctcagctggttcctgagacggcgtgtcttgttcttacagggacgcgattgtcaccacctccatcaactccctgacgagcttctcctccggcttcgtcgtcttctccttcctggggtacatggcacagaagcacagtgtgcccatcggggacgtggccaaggacggtgagcccctcctgctgcacctgggcctgctccgtgtagcaccagcgccgagctctcagcaaagcctttttccttgtgaaagaggaaggagacgcatgggccctgagcgacttcagtgagagttgctgcctcactcttgaaggatggtggtacacatcccagtacagacctgcccccacccagcgccttccccgccctgcccctcccggccccccacccagtgccttccccgccctgcccctcccggccccccacccagcgccttccccgccctgcccctcccggccccccacccagcgccttccccgccctgcccctccaggccccccacccagtgccttccccgccctgcccctccaggcccccccacccagcgccttccccgccctgcccctcccggccccccacccagtgccttccccgccctgcccctcccggccccccacccagcgccttccccgccctgcccctccaggccccccacccagtgccttccccgccctgcccctcccggccccccacccagtgccttctctgccctgcccctcccggcccccccacccagtgccttctccgccctgcccctccaggcccccccacccagtgcctttcctgccttgtgcctctcggggcctccaccctgggctggggaacctcaagcccaaatgcagctgagcagcatagttggtgcctcagtccctcgactgctccctgcagatgccacatgaggctgccccaccagggtctggcgtagatgctgtcactgagggccctctagatgtttgcttgccacgcggtgtgggaacatgcagctcagggaaggggaggaatgagctgttccagcaacacctggaggcaggctgggatgccgcaaacatcagcttggccacagagcagccgggagatccctggggcctccagcacagggtgtccctgcccgctccccaggccgacgcatgacgctgagtgtccctgcacgcctggagttgtctccgagagggtggggaggggtccaggtctcgggcaggcacaggtgagtggtggggggaggccttggccacagcaagaagtgtgccaggcaggatggagccggcaggacgggcacagatgcaggggctgagagtgggcccaggcacttggggccacgtgcctggctccggtgcttgcagtggaaagctgtggcgttggcagccctaacttgggccaaccgagagctccagggagtcccaaggcttctcggtctctgtcagccagcagagcccccgcctgcctcccggcctgctctgccacatggatgtggaggaggccctttcgctccagacacgggcctgggttgggtgggctcccatgctgcgtccccatccttgcttcctctggactgtcttctccgggggtggggtgggggcactacatttgtgaggaatgattgtgctcagaaaagcccctgtcccgtgtgggtgttgttgctgactgatctctgcctgggtgttgaggctcagtgaaggcggggagcgacaagcaccaagcgggggcagccttgaccgcacctgagtctcacagagtggggcactaggaccctcgcaccgcaggtaggaacacgctcagagacctgaaagggcccactccatgcttgcaacagaaagccagggtcggggctggagccacagctcagaggtgggcctcctaagcccatgttctttccactaggaaaaaaaattcagtcaaagcgggagaaagggaacatctgcaaataaatgcagagcagtgaaatttactcggtgccgcatttatgccttttcttcattctttttgccctttattatgataacgagcatagtttgcaaaaacctctattaacccctgaaaataaagttgaatgttcttctgtgcatttcatgacaagcaaagtaaatgtcatttacagccttaattctcaagaaaatagggtgaaatgttaacttaggtacagaaacgaaggcacgggtgttgacattacattccctgagctgatgaatatcttcccaggctcctggctggtaccatctaagccccggaacatctcaggcgagcctgcctcccccaccccacgcggaggctgtccccatccaccagggtatctgggagctgcgagagcccaggtctgaccccgctgcttggctgatagtgaggcccctgaaagacctttaggaacggcccctggctctggcctttgattatttaaaaggccaggcgcaggcctattcctgcaggctagggccagacacgtgcctgctgaggacaggggactctgttgcaggcagattgggcttgggagatggtgccagccagtggaggatgcaaggcttctgaaatggtcaaaggtcaattgcctatgggactggtttttactttggggtcatcagagaccaaactgcgttgacttttggtcgcctgcctgccacactctcgtcccctccacctccatccaagtctgcctgctggtagcaggaagcacgtgtcgtttcccgagagagctgtgggggaacacctcctccgcctttgccatgccgccctcagcctggcgtgcccctcgcttgcagggatagcaaggtagcaggtttgtctcttatctccgaagccaccatctgggcccctgtatccatcaggatgtgctgctcctctgagccctcagggccccagctgacaggagcctgtctcaatatggcctgcgggaccccgtggcaggggaggtggtgaaggagccacacactcctctaccaagcttcactcgcagggacccgctcactgtgggttcacagcacattggccaagtgcagccacgtctaacctcacgggagggtgggaggacctcagcttcctcatgtgcctggaaggcggaggtcaggaatgtatccctaaatgttttgctaattttagaaattaggctactaaatagtgtggacgtgtgtgatttgtgtgtgtttgtgtgtgtatgtttgtgcatgcacgtgcatgtttctgtttgtgtgcgtgcatgtggatgtgttcttgcatgtatgagtttgaatgcacaaatgagtgttcgtgcatgtgcgcgcatgtgtctgtgtgtgtatattgcatggtatgtgtgtctgagtgtgtatgttgcatggtatgtgtgtctgagtgtgtatgttgcatggtatgtgtgtctgagtgtgtatgttgcatggtatgtgtgtctgagtgtgtatgttgcatggtatgtgtgtctgagtgtgtatgttgcatggtatgtgcaggaaaaactaactcgaaggacattagcagatgtccctgggatgaagggcaggaccagcctggaagcccctcctgctcctccttgtttctgccccttccttccccaagcacccccatagcccaaaaggacccaggtaatttggaggagccccattgctgggtggtgggcatgaaccaaagccctctgatcagttctgggtttccgctttcctgagtcccaggcctggtctgctggacatatagaagggggcttttcagcagagccgcaccagccctagtctctacaggcctgtggcaggccatgcttctcggggcggggtggggcaggatgggcgggagagcacagcgtgggctctgtggcaagcagggcgggttctgtttcagggccagggctgatcttcatcatctacccggaagccatcgccacgctccctctgtcctcagcctgggccgtggtcttcttcatcatgctgctcaccctgggtatcgacagcgccgtgagtaacccgcaccgcccggccctgtcctcggcagttgggttccttccacccgagggggccctgccctcccagggctaggcaagatccctgggctcacgtacggcccccagacctcctgtccttgacttgggcgagccccgtgattatttgggagacctttctcggggctggagtgagtggtgactggagtttacctttccctttatccccctactctggggtacctgtgtgccctgccctgagccacctacagatcctggaaatgtgcacacacatgcacacacacacatacacgcacacacatacacacatacacgaacacacacattcacaccaccatgcacatgcatgcacacacatacacacatgcacacacgcacacatacatgaacacacacgaacacacacatgcacacacgcatgcacacacacatacacacagacatgcatgcacgtgtagcagggccccagccaccaaagacttggctccggacaccagagtggtggggccttggagggcacacagcaggtccttcatatctcgtggctttccctggaagcctcagctaccccatgaggaatgaggagggcaacagaagttcctggcacctaccaatcccaggcctggccctgaatgctttgtgtgtggcccctgcacctccagctgctgggggtggcgggtccagcccttgatcggccctgggcctgctggactttctcaggctccttcttccctgtcagctgcttgggaccaaagaacccagaatcccttgccttataaacgctggtcatgcacccggccccccactcatatcctatccacctcgtccacggctcctgggttgaccacaggcctcatgttcctgacatgagagcatgaagaggggtctggaccgagcaaggtgaagaaggtcactaagcaggagtcaggtgcctggacggtgtcccacaggaggatgccaggagtcaggaggctccgtcgggaaggcgtagccaatgacaaggccaggtgcagctgaaagctttgtgtgggggacgcatcttgctcaggaaaatctggccaagctgagcccgtgcagcagcagtggacagggtggcattgttttagccatgccgcatcttacccacccagagacatcgaagaggctgcaaaccccctaccgtggatacagtggtccctctgggtcctctctcctgcggtcgtgccgccatagaagccctcgccaacagctgtcctcactaccaggcatcctgcaccctggacggccatgtggcccctgttccgtgtccatccccgggtgtgcgtccactgggtgacaagtaggtcttggcccaggctgcggtcaggagcgccgccagcctgcagcccgaccctgtgctctgtgtgcagatgggtggtatggagtcagtgatcaccgggctcatcgatgagttccagctgctgcacagacaccgtgagctcttcacgctcttcatcgtcctggcgaccttcctcctgtccctgttctgcgtcaccaacgtacgtaccatcgccggcttcgccttctcctggtcatgtctccttagcacgtggcacggggcgccctggctgggactgtcaggccagacagaaccgcagcacttccagggagctgcgaacccacccaccccagaaaatgactcgtagcagtgcacagggtaactgcacatccagagcttggtcccagagtcacttcagcacctggacagctcccccagaagcaccccaggctgaagctgcctccttctagggtttggggactgggggacgctgggggtgtggtggcagagcctatctatgtgggagggggagcccaggccactccctctccaagggaggcactgccaagttccgcattcggttgcttccatttctaattgcacatgaagccctaggaagggaaaggagaggtcatttttatttttattttttgtaatacacgtggccctaagaagctgcatgtgggttgaattttagggactcaaaccagagttttgcagtgagtgaaacaatttgtgtgcacagtgaatccccaggctgggtttacctctggggaaagcccttctgtaggtccacaggctcccctctcttccagggtggcatctacgtcttcacgctcctggaccattttgcagccggcacgtccatcctctttggagtgctcatcgaagccatcggagtggcctggttctatggtgagtccggggggaggcagccaagccggcaccctcttgtttggtggctgtgccactccccttctgaaaaaggctccgtgaggaaacacctttcagctgcaggaagcctgggttgtggtcatcacagctccgcagaggggagaggcttggcactggtccctttgatgggatcagtgaggtgcttagcttggatggcagccagaagaggcacactgtggtcagaggtgttcacagcggctgggcgtcttctgcctcctccacgctagaggcaccggtgagcccatcccacccaggggaacacaatcagatccatgctggggtttcagcagggatgtgacatggtgcctttcaaaggtgccgtcatcgccttccctgctgaccagagctccagagcagtcgggacctgatgatcagcgggcggcgctcgaacggggtgcagctcctggcccattgtgctgccccagctgtgtcctgggacttccaccagtggtttaaacagcaacagaaaacccagcctggagccagggctgccctttccccacatgctgacctggccaagtcacctcgactccccttagttctctcttctgtaaaatgggcaggagtgccagctccgcttacctggccagctcacttccagggaagtggcgaggccgagccagggcatctcgccatgaatgtgtggtccgggcgcggtgactcacgcctgtaatcccagcactttgggaggccgaggtgggcagatcacgagatcaagagatcaagaccatcctggccaacatggtaaaaccccatctttactaaaaaaaaaaaaaaaaaaaattagccgggtgtggtggcacaaggctataatcccagctagtcaggaggctgtagattttctgaagacactgatggtatacttacgatggaatatgattcagcttgaacccggaaggcggaggttgcagtcacccgagattgcaccactgcactccagcctgggcaacagagtgagactccgtctcaaaaaagaaaaaaaaaaatgtgtggatccggctgaaagctgaatgtctgtggtgctgcgtgagccccggttttggaggacgcccagctcacctgcaaacaagggggtcattttctctgcctcagagccatggaatttatagccagataaacgccctgactttgagacaaataggacaaatagctcctattctgagaacattgttttcagtgttgctctacagaaaacggaaatatcaacctcgtactttcacgggtgtctggaatcaatactttgtctatcactttcattgtcatcttccctgaacaaaacatagaccttcacagaggaagggagaaagtgccttgaattgccatggcctccggaaccacgggagatggggagaagccggccctggcgacctgcacctcagaagaccgagatctgtgttatttttccaaagagaaatccacgcccctctcatctaaatgaaacaaaacctgtgctctaataagatgtgccggaatacgccgggcttccagcacgctgcggtcctgtaggtcttggagctgatgactcctgctccggcaggggccctgggacctgctggtgggaggcagggtctgggggccgaggggccttggggacgcccctcttggcttcttccggcctcacctctctgcatccccgctgcctcccacgtccatctctcatgttcagagctcggatgccgggtgggtgtgaagaggggattctgtgtggaggcttctttctgatgggacacgggacaaccgcaagacttgccccaaatctcagcagatcagccgcggtcacacgagtcacagaccaggccagatgtggggggagaaaccactcttaaggtcttagggtcagttcctagaagaagttagataataccagtgaaagaaaaatatgcatttctaaagtggactgctggtacttgcttttggggagaaaaaatgtttattatgtttctagaaatagcttttctgaagacacagtgacggtatactcatgacggaatatgattcggccttaaaacaaaagggaatgctgatgtgggccgcagcttaggtggcctcagggacactctacagggagtaaaccagttgcagaggccccgtgccacgtgactccactgacgggaggttcccacaggagtcacattcattgagacaaaaagcagatggtgctggggcctggcgggggttgggggtcgggaggagttggcgtttcatgagggcagaatttcattttggaggatggagttctgaagatggacggtggtgacggttacacagtatgtgaatgtattgatacattatgaactctacacgtaaaaatggctaaaatggtaagttttatgttatgtgtattttaccataatctttttaagtgaacaagaagtaccagcagcagagggagacagggagagccatgggatggggaggaggacccgaggggctgttgccggggcgcggggagcacccaccggggcacggctcttcctggtgcatctccagggtggagcaggcacgtgggctcccacccgtcagcgaggcacccagtgggctggggtgtggcctggcctcctctgcaggaggctgggtgcagccgaagcctggggccggtaggtggggcccttgggagtcagcgaggacccccacacgtgtccagcatcgggggaatgcgctgccctgatggacactgatgccacctcttctccctcaggtgttgggcagttcagcgacgacatccagcagatgaccgggcagcggcccagcctgtactggcggctgtgctggaagctggtcagcccctgctttctcctggtaagggacctcgggccacctgcccttcccccgtctgcccactgcccccactctggcacctgccccgaggtccagcgcccgcatgtgggttgtcactgtggctggagtcaggggcctcaagactcggcccagaaggacaggctgatccctgaactcatctatagtctccttaaggtggcttccaccctcccctctagacccaccgaaaaaacctcacatggtcttggacccctgtcacagtccgttgtgagtcctgcacttgggccgcgcctctgtgttgggaggggaagctggaggtgagtcgggctgtccactcacctctgcctgtgaggatcaaggtcgaagttagagcttccggggcagtggggacaaaggatgccgagtgctggatgagagcagcaggggcctcggccctgtcccgttgctcacgcaagcctccctctggctcagcagcatcactgtgtccagtaggcacttgcttctgtcatccgccaccgagtcagggcccaccgggcaaggccgtcggacgctggtgtttgtaaatagagttttgttggaaggtggccgcacactttcattagggattgcctgcagtgcttcccccactgaaccacagaggcctggaggctcacaaagcaaagctgtgctgcctgatctgggcaggcaacctaagagctgtccaagtctaagcagagtgtcccgtgagctgctcacgtagagaagcacctcccgagtccagcaggcacgaggtggggactggaacagggcaggggactcaggccgcaccctctcatggaccaagggctggtcccggagtcagcagggcccgcgtgcgtggagacccctcgtcacctgcacacagcaggtgggacagccccgtagttgccagcagaggggttccggggtacaggaaagagatgagagacaggccctatcccggaggagctcaacatagtgtgagagaacctgcccggcatcttgtagaaattccaccgtgtctgagctccaggccgcgtggtgtggctgcacgtaagtgttccaagtccagttaactgcgcttgtgaaggctcccgttgaaggttcctggattcatggggcgggcttttaatagcacacagactacatggctgttcagaggggaaagtgaggaagccctcccagaaagtcagcctcctgcccacctcccgctctcccccgccattagttgaaactgagctgttttgcatgaggacgttggctccccttgagggggtgtctcctcttaacacccagagggctgacctcgatcttaggagataaaatgttctactgatcttagactaaatcttcgaacttcatacagaaacacacttcgtagacttttagataaaactacaaactatacgaaacaggacttcattttgccaagttgagagaaacatgacaatttcattgctctatgtcattttgtatttaatatgacagcacaattcctatgaagttctgatttcagcagaaacataacgtctgtgttatcatctgtttcttcaggctgcggcatagtcccctgccctctggcgtgtgctaacctctggtcgtaaggggtgtacacgccccagtctcgttcagatgactctgtggcagatgatgccacagcactgctaaagggaaattatgccggagcaaaggcaacttacatgggcagactgtggcctggggaggcatagttctttctaagaaaggtggtatctagcaagaagttgaacaataacagagagcacattacagcaatacctccatgtcagataggcaagcccgacatgtccagggatgcacgcgtggctctttaaagcatgctcagggctctctgtgcagccaaggcagccgcccctgatcccagatgctgcaggccactggctttgctcgccaaagtgctgctcaccctggctctggtcacgtgacagacacaaccccagcccccatcccagtcctccgctagccggctccaaacctacaagtggcccgaagtagcgcatgaagaagatgctgagactggcatgagacacgcgtccaacatgcttttcaggtggaaggcttggatgttttaacttttctgaaattgaggaaaagtggacaattgggaaaaaattgcattttaagctacatcataaaccatatctatcagagcttcacttgtgtccttgggaaggacccaggtacacagaacacatatgtaggcgtgcagtacacatgtgggtgcacagaacacattcaggtgtgaggtgcatatgtaggcacatggaggatctttttagatggtggtgcatgtttgtggagtggatgaacaaatgcatgagctgcctcaggagaagcctctggagagtgggaagcttcccctccaagtggcatccaccccaccctctgttacctttgtggtggtggttctgagacaggtctgtgactttatcagatttgcttctagaatgagtagagatacggagctcagatggccctagggtggtcccgcatgggtcacagttgtgtcttcaggccatggatgatcatagattcagtgtactgggtggtggtcagttttgtttttgttgtgatttcaagcaaggaatagaacaaggtgggatacagcaggaagggatgggatgggatgagatgggatgggatagagccggatgtgatgtaatagaacaggatgggatggaatagaacatgatgggatgggatgggaggggaggggagagaacaggataggacaggacaggctagatcatgcttcaggaggacatggcttgcccgggatgcccagctgccatgtctgcaggcctggccggggtctgcacctgcacagctgtgggggctgagagacgctctgccatgaagtgcctgcccgctccctgctttgtcctggcaccgccggctgagagctgcctgacctccgtatctgctggttgcagttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagaggtgggtatttggacggggcgccttcacccgagtgtgaggccaccagaaaggctccgtgggtgtccatggccccagtcctcacctgcctgggtcatctgtgaccaagaggaggagactggaggtggccaccacaacactgtgtgtgtgtgtgcgtgtgtgtgtccacctgcacgcccgggcccatgggtgtgcgtccatatgtgtattcatgtgtgtgtctttaagtatgtccacatgtctgtgtgtgtctgtgtgtgcatgtgtctgtgtgtgcttgtgcctgtgtgtacatccactgtatctctgtgtctgtatgtgctgtctccgtgtgcacgtgtgtgtgggcctgggtctgtgctcacattcgtgtccaagtgtttgtgtgtactgagtgcatgcatgcctacacactatggtatgtggtgtggtggacacagaagccatctgagggcggtagaatcaggggtgatctaggtccccccagggccgagcccaactttggctgaacaggggcagctggagccccaggcagtggaggaagctttgcggagtcactgatatgcatctcctttcttctgcttggttttgccgcctttgtgtagaagaaaggcaggtggaccagtcacagggccctgtttaacaccctggctctgtggttccaggaagagacaaggacactccctccttggaagagggtcgccctcacctgagatcccaccactgggaactcccggaagctgcttcctcaaatcccagcctttctcagaaagaagtcgcttggccctgggcatcaaaaccccagagcagcaccagctgtgttcaaggattccaccttagggccacacggtgtcccctgggctcagacatgtggcagatgctctcaggctggcactgagccagtctctccagcagcctggccaggccaaggcccagtgcaggcaaagcacagtgtgtggctgggggcttctgtggagtgggaggagctctggggctgccatggccccaggaaagctgatggcaccctgctgtggacagtccctctcagacccccacgggctgacctgccaggacccagcacaggggaagagcaggcagccgggcagtctctgcagggagagagctcctctgggaggctggatggacgtgggaggcggggcccaggtcagcgcagagctggaggatgcctacagcccggcggacctgaacagccagcgcccttacccctcgcatggccaaactctgaacgtaagccaagtaaaacctcagcagctgagccaggtacaagtggaattgtggtgatgacgtggggtggggccacgcacaggggtccctgtgagaggtcacctggcctcagagatccagatacaggcatccaggcccgagagggtgagctcctgaagatgctgcctgctctgggaggacttggtgctgtccaggccccaggagctgccgcagcgggcagtggaaggaaggcacgttcagcgttcactctcccaagagctgcaggtgacaaaaagcaagtgctcccggaatatgtcagctgcaggtggccccgaggcagcccacctgggtgtgggcactttcttactcagagcccagcacacgtggtagcttagactcaagagccatctccaggaccacgttttattttcaagcgagtgctcaaatgctgatgttctgctctgcgctagactttaaggggaccgtcaggatgttggcttcgggcctgactggctgtctggtcggcatgggcactggcagtgtaagtcagtggtgggcgctggtgatatggatgccagcgggtgggcattggcaggtgaggagggctggtggtgagggtgctggtaggtgagggtcctggcagtgtgagtcagtggtgggtgctggcagtgggtactggtctgcactgacccctgcactctctttctctttcagaaactggcctacgccattgcacccgagaaggaccgtgagctggtggacagaggggaggtgcgccagttcacggtgaggtcgaggtccctgctgggcctctctcgggggaattcagaatgatcccaagctcagtgttcttagcccccagggggctccgaggctggtgtagatggtgctcatttactcagccagcatgtgctctatgaggacaggcagccagtggtggcaggtgacagtggagacgtgtgcccgggacggggggcacatgacgcaggggccctgggaggtgcggctgcacagacgcctgaggaaagcatggtccctgcaaagacctgggcatgtcccagaccacgggagcagtgccctgtggggccagctgagccaggttaaggaccagcaagggaccaccaccccccgcctcacgggggcacaagggacagtgccaggaggggaggcctgggcctggccatgggaagccacagggagccctggaggggctgggagaggcctgggagcctggggctggcttcgagtgagaggatggtcacgccaggtgtttcctgcaccctgggagccatccagctgtgtgcgaacatgttcatgacatgccgtggagcaggtgcattcccgggggcacacaagtaaacacttgacgtgtttttactcccacaaccctaagaggcagcccagcactctctctacacaagggtccctgagacccagagaggccccggaatgtgcccaagatcacagagctggccagcaggagaggagcctgggctgtgccctgggcctgtggcactgtcctcctccaccccagagtggcctcagccccgacctgattccatacactaatgtcagcctaatgccgacagcagagtccaatgcacagcaaaagggagagaaggccatagtgtggagggcaccgcggccccacctcggacctgcctcttccctctggccacctctctgtggctggttctcgtaaacagtcctcccagcaggggtctcatgagctcatgcctgaggagcccagcatggacctgcacatggggcaggagcaaggatacaggcagagggagggggctctgcgtgcctgggaggtgggtggtgacgtcaggcagaacaagacgctgagcagggaacaggccgggaggcagtggggagaagccgcctctgagcacacatctgcacagcttgttcctcctacctgcaagtcaggttctggtgtgggctctgcctccctccgttggcaccctttcctctgtcctcccagtgacttgcctgctccaaacacaggaggcgtgtccaggcatcccatcccatccatccagaggatgccagcccctccccactgggcctccggtcctgctccaccagagcctctctcctctgagagtcctatacctgggggtcttacactttgtacaggatcttgctagtcttctcaaatatccaactttgacttcatgtgagattcttgctgtgcttcctgtcacattaatctcagctcctgtatttatcatttcttcctctctttttcttggatctactctgttgtagttttgctaactttttaatttggactttaggttattaatttgcatccttcgttcttttctaatgtaagcactcaaggctatgaatttccctcaaaatactccatgtgctacattccgtatttttttcatagtatttttctttatcttttagttctaagtatattttaatttccattgtgactttgtcaactcataacttgcttaaaagtctgcttttaaattgccaaatatatggggatgttttactcatctttttgtttttaatttccaaattaatttcattgttctcaaacacatatgatacctattatttaaaatgtattgagacttctttagggccttatacctgatcaactttgataaacgttgcacatcttttagatgaatgtgctattctctaattgtcaatacacagttctgcttctgtccatttgagtagggttatatattatgttacccacattgtctacactttgtcaactttaggggtgcttgaccatgagtaattgagagatgcctgtggcatattcttcctcgatagtatatttgtttgctgttcccctcagttctatcaggttttgctctctgtagtctgaggctgttttctgaggttgatccatgtccagaatgatcatctcttcctggtgacatgaacccatcttcactccctaatgatgcttttggtcttaaagtctgacttgtctgggacaaatatagttgcaccaaggtgtcttttgagtttgcctgaaatatcttttgcaatctgttaactttcaactttgcagtaaccttaagatttaagtgtcttttgcaaacccagcatacacctagaattttttacgctgacagttggacaggttaatccatttacatttgttgtgattattgatatatttgaacttgattctactatctttctattccatttgtcccatttttagtgtttttctcctttattgcctttttatagattgatttttcttggttcactcatttttattattccgtttatttctctctacttgcttagaacttacatactttattctttttttttttttttttgaggtggagtcttgctctgtcacccaggctggagtgcagtggcatgatctctgctcactgcaacctccacctcccaggttcaagcaattgtcctgcctcagcctctcaagtggctgggattacaggtgcccagcaccacacctggataatttttgtgtttttagtagagacagggtttgaccatgttggccaggctggtctcgaactcctgatctcaagtgatctgcccacctctgcctcccagagtgctgggattacagccgtaagccactgtgcccggacttattctattcctttaatagctactcttgaggttgtaccatacatatttcacttaaactctacagagaaaccatattttaaccccatcccattataaggacttaaatcttcctcctactgatgaacatgctatgattgttcaaatctatttctctctttttaacccacaaattagacactgtcattgttcttgttcctgttattattttgtacggactcatcatgttccttggactaatgtgcatgcttggtgtttgttggttcccatacttttgttatagacttcttttcttctaggaccattttcttgcttttcaaaaagcatccttcagacattcctttgaggaggtctcttgctaacctccctcactattggtgtgtgggaacatctttatgctgctctcattcacgaaagcactgttgtgggctcagggctctaggctgacagggactatctctgcgttttggaggcagcagtgttccgtggctgtgctgagatgtgtggcctgtgagcctgctctgtggtgggctctgtcctcacccctgcactcggccgagtttcttctgctttcggtgtctcgggttcactgcggagtgtcgggacctgggtttcttttttgtttgtttgtttgtttgtttgtttgttttgagacggagtctcgctctgtagcccaggctggagtgcagtggcgcaatctcggctcactgcaagctccgcctcccgggttcgcgccattctcctgcctcagcctcccgagtagctgggactgcaggcacccaccaccgttaatttggtttctttttatttttcctctctggatatgttttgtggccagatctgtggattcacaaatcttgtcattctgtgaattttgcagccacacactgaaagattgccttctgcctttctgtgttttccattatgaggctctggtgtgtccactttgccccaggtcctccaggtctcttacctcacttagattttgttttcatttgaatcttaggtgcacagttgagtaacgcatcttatcattaatccacatgtggccatttttaaattattaatttgtcaccgtaacaaacagacccttgtgagcccacagcaggaaaactaggcactgtggaaactgcctgcccctcacccattctgtatctgcgtctagcttgatctttcccttgcccttcttacaatttcatttgttgcatctctagatatttctagcttcctaaaaagtgtattatttggcttcagcatttggtgtagccctaaccaacccctactgaagcaagaccttatgcacaccccatgcagatccccgagaatcatgacattctcctggctgggggaacaggcaccgtgcccagccctgtgtgggcatcagaggtggttccctctggtcctgtcggcggatctctccccagcctcctcattcacagcgggatgtgctcgtctgaaccctcagcaggggtcctgggccattgtcccgggtcttctctctgtgtggccacctcctctctggcgctctggcctgcaaactgcagccacctccgtttccctcgctctcctttccagcgtctcagctcagggagtccaccaggctgcaccctccctgtgctgcaatctagaaactccctcgaggcagcgagcagggtggcaggggggcctccttgttggcttccctcagggaccactgacccttacggtctggtgtccatggtctggaaggtcatcggcacgtgtgttttgtttatttggggcttgtttcggacagtagggtaaattcgatccctattattccatctaggtcagaaatgtttgtatccatagctacgtttcacctaccgtgactggtccctgaccgtccgtcacgtgaacaaaccacagctcagctatggacgctccgcattccactgccctgcccctggtctgcagcccagccattctcttttctacttcatctctggaagctgcgtgtgctctgctgtttcttgtgaaattctcatcactgtgatgtgcgtgtgtcacttttctgagagtcccctatgtggccatcctgtaatctgttgcaacagctctggtcctttggggtcaaattgaggtctggtttctggggactcacttagagtgggctgctgtcttctgtttctagtctttattttacatttatggcttgatcttaatctgtgggaatctgggagcccccaagcacacctccctccagaggggaccttctgcttctgtcagcgggcaggacagagaactgcttcaccctggggggaacaggactcacagctgaagtcccaagcatggcttcttcatcgctggcctgaagtggggctgccacccagagcctctgctctagggctctggccgctgggccacccgtggctgtgggtcctggccgggctccctgaccccagcttccttcactgagccccgagctgcacctggatgctgcctgtgccggcatcagctgtggctgctccaggcccccggtagacccctggcctgcagtgtgatcccaccctggctgaggaggtccctgcaggctcttggtggagtggccagaggagcctgtggtgtggccagtggtagcttcagtggctttccatggccggcgtggttttgtcagaagcaagccccgcatgcccctgtttggaaatgtttatgaagcacacttcttgccatttagtgctatcgaggggctttgacgctcacaaacaggctgaactaacagctgcataatagcaggcgatgacatttgctggtggtgtaaatagctgctcttgtctatctcatcagtccctgagcagtcagtacacgctgcacttgcgcccgcgcgggtcgcagagagcaagatggagctgcagaggtagcgtgtcactcagatggagcatctgaggcccccaggaaggtggagggacgtgggggagaggtgacatcaccacgtcacacccaagtcgctggggtacaatctggaaccagccccggactgagggtgcccggcatctctcagactcagcatctgatcaatacgccccagaggccaccatggccaccacgccaaccacagtctcgcggctttttaaaaaatcaagtaatgattgatttgtaggagtttgagtgaggcatcggatccccggcacctgtcaagggtgtgttggtccaggcccccagtgagcctccccttctcccagggcacatggccaggaggctgcaaactgtctgctcactgccttcagctgctcttagccaccttcagctgctcttaaatggggcatcgccccagggtttctgactaaacctgttttctttccagctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgcggtgtagggaacggcctgagaggagcgtgtcctatccccggacgcatgcagggcccccacaggagcgtgtcctatccccggacgcatgcagggcccccacaggagcatgtcctatccctggacgcatgcagggcccccacaggagcgtgtactaccccagaacgcatgcagggcccccacaggagcgtgtactaccccaggacgcatgcagggcccccactggagcgtgtactaccccaggacgcatgcagggcccccacaggagcgtgtcctatccccggaccggacgcatgcagggcccccacaggagcgtgtactaccccaggacgcatgcagggcccccacaggagcgtgtactaccccaggatgcatgcagggcccccacaggagcgtgtactaccccaggacgcatgcagggcccccatgcaggcagcctgcagaccacactctgcctggccttgagccgtgacctccaggaagggaccccactggaattttatttctctcaggtgcgtgccacatcaataacaacagtttttatgtttgcgaatggctttttaaaatcatatttacctgtgaatcaaaacaaattcaagaatgcagtatccgcgagcctgcttgctgatattgcagtttttgtttacaagaataattagcaatactgagtgaaggatgttggccaaaagctgctttccatggcacactgccctctgccactgacaggaaagtggatgccatagtttgaattcatgcctcaagtcggtgggcctgcctacgtgctgcccgagggcaggggccgtgcagggccagtcatggctgtcccctgcaagtggacgtgggctccagggactggagtgtaatgctcggtgggagccgtcagcctgtgaactgccaggcagctgcagttagcacagaggatggcttccccattgccttctggggagggacacagaggacggcttccccatcgccttctggccgctgcagtcagcacagagagcggcttccccattgccttctggggagggacacagaggacagcttccccatcgccttctggctgctgcagtcagcacagagagcggcttccccatcgccttctggggaggggctccgtgtagcaacccaggtgttgtccgtgtctgttgaccaatctctattcagcatcgtgtgggtccctaagcacaataaaagacatccacaatggaaaaactgcctcagcctccttgtctcgtttccgctgggccccatccatttacacaggcccagctcacctgctcacaccccgaggtcagcttctgccccaccccagcccacccacagcaaagcttcctcacctgatgcctcttggcccatctctccttccggcctcccctaaagcctagacgttagagataacacatccactacgctcccatgcaggtgtgctgggtgtgacctgtcgccctccccaggctcccacgcaggtgtgctgggtgtgacctgtcccccctccccaggctcccacgcaggtgtgctgggtgtgacctgtccccctccccaggctcccacgcaggtgtgctgggtgtgatctgtttccccttccctgggctcccacacagtgttgggtgcagtggtgaccctcacccacgtctgcactcctgcagggtcccctgtggcaggttgtggcaccttatgtcgtgcccacttgctcaggctggacctccgtgccatcctgcaccgctctcccccagcccctcacctgcctttcagcattcttgtgggctccccacatgtccagactccaaccacactgcctgaccactgccactgcccaacccaagagcctcttccaagccccatcccagatcttggtgggtcctggtcctcagtccaagcatctttcgtcgctctgtggcctaaaggattcttctagataccaacagatcaggccacagcccaaggaaaccccagggttatcctggtgcttggagtaaatgccaatgccctcagcatgacctgtgataggatggcagcaccccttccaggcagtgacctgtgataagacaagcgtcactcccgccagccccacctgcagccctgccccgaactgcctgagggcacaccccacaccgagggctttgtgcctggcagcacatggggacactgctactgctgcatcgtagcacgtggctgcgtgtggacaggaaggacgctcgcacctttcagctgggtcagtgaactctgtggcaggaaaagtgctgggctgcctacaagggctgaacctgcctgcagcctaactagtgcctcccaccgtccccattgtcacataggatgtcccttaccctcaggggtggctacaccccgcctgctacaggtgccgccctaacagctcacacctggagcccccaggtgtgatccctgctgaccactcaggtctggggtccaggcagatactgtgtgggtggccataagtcactatgtgggctgagacttgaaggactccgacagcctcatgggcgactgtattaagccccagcaatcggagaggtgggctccggggctgggtgggtctcctctgccaggtgggtctcctctgcctgtggtcccagcagctcggcagcaggggccggcccagatggccgttggtcacagagacagctgggctttgctgagtgcgtcgtggtccagcctaggcccatgccactgaagcctttctcagaggtgtggggtctgcagggaccggtcacatgtgagcccaggatcagggcattgggggaagaaccagctgaggacattccccagccccaaaacaaaggcacggcagtcctcgagcagggaggagtgaggagccacatgtgggatcccgcctctctggcgtgtgagctgtggatggcatctggtaccagccccatgcccgctggccgctggcgagcttgcaggctctgcaggcaaccggaacagcatactgcaggtgcacacggggtcctcgtgccgagtgatttactcagggagtgcctgagggagcaggtgagggaggggcacttacaccctgaatgtagaaggaactccacaagtccatagggaagaggcagacaccccatcagaaaagtggacagagaccttgaatgactgccagcaagggaaagtgcccaagtggccaacaaacctatgaaaagaggcccaacctcaccagttgtcatggaaatgcagtcagccaccacgtaa

SEQ ID NO: 12967 - DNA, 45484 bp, Human
tgagacagagccttgctctgtcatctaggctggagggcagtggcatgatctctgctcactgcaatctccacctcccaggttcaagcaattcccatgcctcagccacctgagtagctgggactacaggtccgcaccaccacacccggctaatttttgtatttttagtagaggaggggtttccatcatgttggccaggcttgtcttgaacccctgacctcaagtgatctgcctgcctcggtctcccaaagtgctgggattacaggcgtgagtcaccacgcccaggcttcaaacccaaattttttttttttttttttttttgaggcagagcttccctcttgttgccctgtctggagtgcaatggcgcaatctcggctcactgcaacctctgcctcccggtttcaagcgattctcctgcctcagcctcccgagtagctgggattacaggcctgcgccactagacccagctaattttgtatttttagtagagaggggggtttcaccatgttggccaggctggtctcaaactcctgacctcgtgatccgcccacctcggtctcccagagtgctgggattgcaggcgtgagccaccgtgcctggccaaacccaacttctactctaccaagctacaggacattaaattgttaagcatgggaatgatgtgatggatacagtgtttcagtaaagttaacttttaaaaaggctggaggaagatatgctagattacgttttggggtaattcagttatgaatgagggaaacttggggccaaaatgacagaaatatgaatggaagaaatgaggaaatgagtcatttcttaacttgcacattaccttgcactttgtaagttcataaatttaataagataaacttcagtaaagtcttctgctgggtattcatctagagcattgtactgttcaattgcaccatataaagcgaatcgctcaactaattccttcatgactcccacagcaggaactccttgtattaataagtactgagattccaaattgattgtatatacctgaaagaaatgcagagttattaaacgtatttcgcaaataagcctaggacgaatctgcctctatttttttttaaagagaactttgaaaacaagaaataatctgttcaacccagtcagcaaaagaacacaaaatgaaatttctgccattccttctgcataaagaataacagtccatgtgagaggctacctaaggcatataacagactaccttcagtcgacatttttttccagaaattgagtcggtagaagtcactgggaacaatcactcaacgaatattcactgagtgcttacctgtgccaagtagtactgtaaacacagaagatccaatgactaaaaccaaggcctattctcgtggagttgatgttctaatacttgaccaaaggcgtcgtgagaatctttggtaactgaccgagggttcttcacgccagctctaacgagagacagatctgacggaagccttgtcgtgcctttatttccgtaggctggtcatatggcgctagcactcacataaagctaccgaggagagcgaatgaaaccaaaatcactttaccttcacagcacgaggccgtcgtccctctcgatatttggcccgtgtgtcgcataccgccctctggacgtggtgatcaaataaactccctagctccccgccgctcgacgccatcttgcctactttgatcctcgcagggaggacaacatccgccctactgagctcccttttatccaataagagagcgggatgagttaaggagtgccaggattggctggagaatcgacagcgtcggccatcgtttcctgcgtgcgaagatttgatgaacgaggtgccgcccccgagcggctcggcggagaggcgcggtgggtgacagaagctttcttgtcccacccactacaggcttacggcaggatgcgcagcggggagagggggcggggccgcagggggcggggccgatcgatctcctccggctccgacgtcctcggcctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcaggtaacctgccggccccgagccacctgatcttcagcctggggtcggacgaggccgaagcctctcagggacgcggcgggacaccggctgccacccgggcgccgccgaagcgcgcagagatcagggtccctcgacggcagggcccttctgggtagtctctggatcccacaagtccagtgcagccctgggctcgtcttatcccaggtcttttcacttggtgaaactgaacctagaaacgtcctaatattctaccactgtttttataaatattccttattccaggctggaaaagctcctgagaagtggtttgtttttattattttaaaaggtgttttccttgccagccatttccagttaacctgcgctgctgccgtccgggccgcgagagcgggacgcagagttgttggcggagcccctgtcggttcccggggactaagcaccgcgtcccatgagcgggaaaggttaatacaatgatggttctgccctgcgtcgctgacgcggaacacagctgtagtgtgttaggaacacataacgtagttaagatcacttgaagctctgcgatcagtcgcccttctggacgttgtggttaggatgtttcacagttctaaccactggtggagatacagcgtccatattttcataattaaaaatagaggcacatggtctcacgagtttgagtgtacttatgggggcaaaaggacggcgtatttgaaatcctcataaatcctggatgcatggtacccaccagtggctaatctatgcaatgaatagagtttgcaataatttcaagcatcccttctttccacttgagttacttccccatacctaggggaagatatttttggtccactgaaaacatgagttcagcagaatcctcctatcatcgtcgttattattttttaccactaagtagacaatcttttggtttttgatgggctttatggctagagacaaatcagtcactgtcaccaagttccaggtagaagttggttcagtgctctgtcagcttcgatgggatttttcaacatgttttcaaatctgcacttaatagtaggaatgctttcttacagtaactctaatttgatcctaagatgtagttgttaccttacattcatcactgtttaagaatttagtggtcttgatctttgttttaaattttgagccttcgggaagtacttataagaattaattcatgcatatctttttgaaatgtaaatgtctttagccctggaacaaattgctgtttctgttcagcccatattagcagaataggtcaactttactttctaattatcaatgtaataagtttattactttatagattccataaatctatacatttattcctcgatgaattatataaatttatagaatttatgttttatagaaaatttggaaagcatggaaaattattaacaagaaaataagttacccataatcccagaacttagaggtgactaatgttgacagtttggatcaaatcttccagttttgtttctaatctttatttttaacataaatgaggtcctgtatacacacgtacagttttgtgtcctggtgtttttatttaatgttattatgagtgttttattttgttaaaaggtcatcattttaagttgttaattagtattctagcacaaatttgccataatttatttaattgtttactatgattgaccatttagattgtacttaatttttaggcattagaagtgataaactatattttaatcagacgttgaaaataacacatctttgtttagaaaacatcattttatttctggttgtctaggatagattcccagaattcttgggttagaggccatagataattatgaaagcagaaagattcacaagttgggagttaatacttgaattactttatttggggtgaagcattgagtgcataatacagatcatgcagtaatgggaagaagggttggaacaatggttttctggcctatgtcagacttaccttgaagcttttaagaatacagatgttctgatcaaccctcagacctattaaatcagacctaaaatcttagggaataggctttaggcatctctaattttaaaaaatttattcaggctacttggatgcacaaaagagttgagacctactgtcctagaatcatagaattttaatgacgatagagaccttaagcatctaggtcgtttctgtacttttacatgtaaggaaactggcattcctaggccagtaccattgccatgcagctaatttgccctcttgtctatagctcactctgcatcacccaacctaccgttctcactgtttcttctataaccaatctccttcccacttctgttctcttactcatgccattcttccctcagtcatttttcttccttccatacaaattccatgtctttaaaaaggaataatcctacctcctccacatagctttccaattctctgttgcccacatttgtctccctttcaatacttctctgttgtgttatgtgacacatcacatttgatatactctgtactgtgtttcaagtattgtattctcttgtttactcaagtcattatttcaggactgactacccagtagatgctttaagtcaggatttctcaaccttggcactgttgacattttgagctggataattttttgttttgggggctctcctgtacattttaagatgtttaacagcacccttggcctctatccagtagacgcctgtactgcctccccctatctgtgacaaccaaaaaggtcttcagacattgtcagatgtctactgaaggacaaaatcacctctggttgagaaccaccgcttcaactaagttatcttctctgtactcagaacttgatgtgattgcagcagggggagaggattcatatacacagtgaatgcaaacgaacctaaatcaccattcggatatggccacacaattttcatttcccttgtgttagcaagagataccctaggctttggacctgattattcctaaggcattctgatgtatggttttacctgcagatttcctggtaatactgatacctcagtttgggtcaaagaaggtcaattaattgattgatttgatttgactcctggaaaagacgctcctttctagctgtctctttcttctctttacctgaatagccagggctctgtggttcaagtgaagtattttgacataaaaattaacttagaacattggtctgcagagtttgctcaatataactgagcacatattgtggctttatggagctggttactactttttgaccaaataaataattagaagtatttttcctcctcaataaggttcatttttccttttttcagtgagctggtagagtttccttttttgatatttcagggcatctttcatatttccatctcttaagtttcttcatatgaagtagaatttatctggattatgtattgctgactctgatgaaaacccatagaaagcatctggggcttgatcaccttcattcttgtaatagctcacacggttacagctgatatggtaacttaagacttttgattccaaatctaggcaaaatacactcagttgaaagaatttgtcagccagaacagttggactgttctgtgaaaattgtgagaaaaattacacaactaagtgatacatgatgatggctttcttaaatataaaattgtaataacatggttaatttccagtacgttatattgtcccagaagtggctccaacattgtttgaaatttgtctcatttaaagaaacataagctggctatggtggctcacgcctgtaatcccagcactttgggaggctgaggcaggcagatcacctgaggtcaggagttcgagaccagcctggccaacatggtaaaaccccatctctactaaaaatacaaaaattagccgggcatttggtgggggcctgtaatcccagctacttgggaggctgaggcaggagaattgcttgaatctgggaggtggaggttgcagtgagccgagattgtgccactgccctccagcctgggtgacagagtgagtctccgtctcaagaaaaaaaaaaaaaaaagcaagaaacataaagactgggcatgttggctcatgcctgtaatcccagcactttgagagactgaggtgggaagatcacttgagcccaggaggttaaggctgcagtgagccgtgattttgccactgtactcgagcctgggcaacacagtgagatcctgtctcaggaaaaaaaaaattgcatgtaaatgaatgaatttgatatttaatattttaaattatgaaaactgttctgtagagatgtagatcttgccatgttgcccaggctggctttgaacttctgggctcaaacaatcctcctgtctcagtctcccaaagtataaagattacacatgtgagccactgcacctggcctaatatttttaacttaatgaatttattttgatataaataaattaataacactgaagcttcctgatataataagtctttttgtgtgtgtgacgggttctcactctgttgcccagactggagtgtaatggcactatcatggctcactgtagcctcaacctccctgactcaagtgatcctcccacctcggcttcctgagtagatgggaccacaggcgtatgccaccacacctggctgatttttaaaatttattattgatacatattaataaaattatttttattttaaaaatgatatatgtggctgggcatggtggctcatgcctgtaatcccgacagtttgggaggccgaggtgggaggatcacttgagaccaggagcttaagaccagcctaagcaacatagtgagatcccatctctatagaaaaaaaaaatggctaggtgtggtggtgtatgcctatattcccagctactcaggagactgaggtgagaggattgctagagcccaggagtttcaagttacagtgacctatgattgtgccagtgcactccagcctgggcaacagagcaaaatcctgtctcaaaaaaaaaaaaagttcgaaaatgcttatgatgcaatataagtagtggaaaaggatattaaattgtgcctatatgaacacaactatatgaaaaacttgcacatagagaaaaggattaacaagaaatagaccaaattgttcacatggttgtcttgtttgtggagagaatatcagtagttcatttgtttccttccaagtttatatgttttccgaggtctctataatgagtttgtaattgtttaatcatagaaaacccttttttggtccttggccacaaacttacatgttttaatgtaattgcttttttaatgagaataaatgttatattttgcttttttaaaacctatattcccatagttatatgagcccttacaattattaagaggctgcataatataacgtttctggaagggtacagaagaaacagcagtaattacctctgagaacagagacatggcttcacattttacccttttgtacgttttgtgcttttgccacatgcatttattattcttccaataaataagtaaataaatatggattgtatactccatctggttggtgtttcataattctaaaattatattgctacatttttaaagatgatatgtgtttctacttattaacgtatatgttaaaatagtaaatttatatcttatttaataatttccctattgatagacatttaagacagtctcaagtgttcactatcatagaaaatactgcacagatagcttttgctatagtttcttttttctttgaatcgttaattgggaataaatgctcaaatagttatatgtggctcaactgctatttaagtttattgactgactgctgccattttgaattctgaaggggttgattaaatttataatgctgccataagaatataagggtattggcttcattagcatccaccagcattgggtgttggaaatgattatagatttttaaatgctacaacaaatgtagataacagagaactatctatagaactctttttggacatgtgaattgtaataatagtttattttcatgtgaatccagaaaaatgtatacgaaaaccttttttcctctcatttcttatatgaatagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtaagcacatgtgatggcaataactttcttctaatatcacataatatagcaatagaaataaaattaaaagtttagattttttgttaaaggaggtgagatgtcacctaatttgtatgctattatgtaactagtctaggatattgaagctgactatactctgtttttaggtcattatcttgtagtttaccatactccctacttgcttcttattctactatttaactcattttccacatcccctaattttggtttcatgaaattatttttccttctgaattactaggttctacttactattattaaactttatttctgacatattttataaccttccatggtctcacttgattaaaaataaaaaattcagctgggtgcggtggctcacacctataatcccagcactttgggaggccaaggtgggcggataatttgaggtcaggagttggagaccagcctgcccaacgtggtgaaaccccccctctctactaaaaattcaaaaattagctgggcatggtggcaggtgcctgtaatcccagctactcaggaggctgaggcaggagaattgcttgaacctgggaggtggaggttgcagtgagctgagattgcactgctgcacttcagctgggtgacaagagcgaaacaatgtcttgaaaaaaaataaaaaataaaaaattctacaacacagggttattatttttccatttttgttttcccttatgagtttaatatgtttagattataaacctgaaagcttgaatacctatgtctatcttttgttttcttatgtttatcaagttattcctttaaacattttctaaactgtaagaataatgtgaggctgggctcaatggcttatgcctgtaatcccagtgctttgggaggccaaggtgggaggaccacttgaggccacgagttcaagattagcctggctaggcaacatagcaagaccctatctctataaaaaaattaaaaaaattagctgggcatggtagcaaatgcttgtagtcccagctactcagcagactgaggtaggaggaatgcttgagaccaggaatttgagtgacctatgattatgcactccagcccgggcaatagcaagaccctatctcttaaaagaagaagatgtagtaataatacatattcattataactattttaccattgaaagtaaaaaatgagtttttaccttttcccagtcccatcctcagaatggggatctcagtagacctttaggattggaagaatgagatcattcatattttctgcaattattaccccacaaaatatttcagatacctttccatgtattacaaacaatgtgcatttaacatgtctctctctttctctctctctctgtgtgcgtcttcatgatcctctgttgcagccctgccagtaagacactatctcctgaagaatcactgataggaacagaaagtggactggctaggccaggagtccttagcttcttagggggcaggagctgctttgtgctttctcagaatcagatatatatgtggactgaaacatttaaaaacagaatagccaagggtgctatacgtttaaaacttatatagatggggctacattgctctctattactaatttcccatgacaatacacgagagtgccatgtctttttaacttgttttgagcacagactaatcttgtttatgcatgttttttgatgagaataggctactcatgagaaatctgtaaacctaacactagtcccttgcatactctaaattgttgctagaatcttaaaattttagcaccagacggaccttagaaatcattaactttggtgctttgttctacaatacaaggagatggaatattttacccaggattgcttagcaggttacagttctgccctctgagtacccagcacttccctgtgggcaacatcaacttcctgattttcaagtcttaattagtactctgaagaatcctacttgtttttaactcccatttgctttgaagtgactttacctgatttttttagatcccttattgcagcaatgccactaagaaactgagtctctagcttcttggtgggcaggagctgctttgtgcttgctcagaatcatccttttcagtaagggagatattgaagagaaatctactgaggagtctgggggtgaggcactcagggaaatcctgctccagtccacaaaagcagagaggaagggttggttacctagagtatttaacatgcagaggctttggattttactcctttaatccttggaaatgcctatggaaggggaaaggaagtaagatggtgactccagcttatagacatactagtgttacatatatttaaactataataggagggtattattagttttacttaactttcaactgtgaaggattatacttctcaatatttgtctccagtgtctatttcagtgtatttttcacttttcttgaagcagcatgtctgttgcaaaacttctagaaataatgagaatatttatatattagatcaagccataacttgatgatatagtcatttcttcttatattttttacttacatttttacattttaatgattactttcatttttgaaaaacatgtcatgctgagatgtatttttcttcattctgtaattagttatgaaacagtttttcctaaaatgctgagtatatcaagtcttggctaagaataagtaataaatatttgccacatgaaagactacacatatagccaggtgcagtggcttgcacctgttttcccagctacccaggaggctgaggcaggaggattgcttgagcccagggtttccaggctgcagtgaactatgattgtaccactctactccagaatgggtgacagagccaggccccatctctcaaaacagaaaagaaagattacatagactacatatacacccccatccaaaacatacacacacatctacttaacctaaaatggtaagaagataacttcttattttctaatatatgacacagaaaagtttttttaaagtagttttaaatttttaattttttctaggtatttctcaagccatgttcccatgtggtatcttgtcaacaagttgaggtggaacccctctcagcagatgattgggagatactggtaaagaaaaccaaataagaactatctcatttaaggttaaattacttcacaatatcaatgtctttagctttctctaagctttattatatattctgagttggttttgaattataagaatgaattggggccaggcacagtagctcatgcctatagtcccagcactttgggaggccaaggcaggtggattgcttgagtccaggagttcaagaccaggctgggcaacatggtgaaaccccgtatctactaaaaatacaaaaattagccaggcatggtagtgcatgccattagtcccagtcacttgggaggctgaggcaggagaatcgcttgagcccgtaaagtcaaggctgcagtgagtcaggatcttgccattgtactccagtctggaaaacagagtgagaccttgtctcaaataaaaaaagaatgaattgatagagatctaatgtacaacctgacaactataggtaataaaattgtattggggattcatgttaaatgagtagattttaactactcttaccacaaaaacacaaaagtgggtaactgtgagatgatgtatatgttaatttacttcactatagtaaccattatactatctatatgtagctcataacaccatgtcgtgtatattaaatatgcacattaaaatttgttttttaaaaaaagaattgagattttttttaactagatatggagtggacaaaatgtaaagtgaattgatcttttcgtctgttggttctaggagctgcatgctgtttcccttgaacaacatcttctagatcaaattcgaatagtttttccaaaagccatttttcctgtttgggttgatcaacaaacgtacatatttatccaaattggtaggtgctattgtaatatttgctgtcatattctacactatagcattgagtccaaagtagaaatgaatgtgcactaatgagctttattttctacacagttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctgggttagtataaattttataacttgggagaaattttatgtggcttaaacatccccaaattatgaattagaatagtatttcatatataaattgaaaatcaattaaaaagaaacacagtgcctaaaggcacttgggggacacatttacgctttgcagtaaagtccttgtttggataaagattgtatgttttctggccaagtaagcttgaataggtacaagcttagataggttcaggccagagaggtcaaaattacttgcctgagattgcatagctagtgttacaactaggattcaaacccaggcagattgacttgggggttcatcaggatggagtgccctacaaagcctcccatctttaatgcttgcagatttgttccccagttaccgaaagcaacttgttaatattagggaaaagggccagtgtagggagagatccatggcatgaggtaaccttcctgctgcatgtggtggcacctggattggaatgcatccaggagctgcttaccctgccggtgtctgctctttaatttgtgtataacggagaggaagtagacagggcaactagtgctccagcccctcatcctggccacaaatattaatgctacctttatatgacataagtcactagtccatttattggaagctaaatttgaaccactgtaaagtaagacttcatagtgataaagagaggaacttgttaggaaagagaataaaatagaaagagaaggttgtctccttttgtagattttttttttttctccaacagttttacctgtgacctttatacaaataactgacaaagcattaatctctttggcctacatcattttcttttctattttttttttccacaagatggagtttcactcttcttgcccaagctggagtgcagtggcatgatctggctcactgcaacctccgcctcccacgttcaagtggttctcctgcctcagcctcctgagtagctgggactacaggcatgcaccaccacgcctggctaattttttgtatttttagtagaaactgggtttcaccatgttagccagcctggtctggaactcctgacctcaggtgatctgcctgcctcggcctcccaaagtgctgggattacaggcatgagccactgctcctggccggcctacatcattttctaaagctccagaccattcttttcttttcttttcttttcttttcttttcttttcttttcttttcttttcttttttctcttctcttctcttctcttctcttctcttctcttctcttctcttttcttttctttttttgagttagaagcttgctttgttgcccaggctggagtgcagtggcaccacctccactcactacaacctccacctcccaggttcaaatgattctcctgcctcagccttcagagtagctgggactacaagtgtgcgccaccactcctggctaatttttgtatttttagtagggacgaggtttcaccatgttggccaggctagtcttgaactcctggtctcaagtgatccgcctgcctcagtctcccaaggtgctgggattacaggcgtgagccactgtgcctggcctcagatcattattttctgttagctttaaactgtccgttcaggagatcccactgcatcctcaaattcaaaatatctaacactgagcttatgatttagctggttctgtcattagatgggaatatccttttatttccttgaaattatatggtgagaacagggagaagtgctgatggtaaagtcctgtgattaagatagcaataaggactccgcccttcccactccactgaaggttgaagagccatggacaatgagaagtcacagtaggtgaaatcaggtactaaaatggacttggcttgagagatcaaaattgatcacttggtgatacaactaacaaattcatgttaacttgaacctttattaccctgtgaagcatggtgattaaaaaaaaacaacaaacaaacaggaaacttgattgttaaattctctttaagtcagaatatgtaccttagagtttttatttatgcttttgtctaccattaatatgtctgcacctgctctttagaagttaatagagagtaaagtcgtctttatgtctttcagtgcttacttatatttgggaagttgagaaaaatttttaacatcattattgatatatatatatatatatatatatatatatatatatatatatatatatatatatagataatttttttttttttcttgagacggagtctcactctgtcgcccaggccggagtgtggtggcgatctccactcaatgcaagctctgcctcccaggttcaagcgattctcttgcctcagcctcccgagtagctaggatacaggctcccaccaccacgcctggctaatttttgtagttttagtagagacgaggtttcaccatattggccacgctggtctcaaactcctgaccttgtgatccgcccacctcggcctcccaaagtgctgggattacaggcgtgagccactgcgcccggctgaggtaaaatttaaagtgtacaattcagtcatttttagtatatttatactagttgtacagccatcaccacaatctaagtttagaacattttcattagggggtgggagaaattttactctgctttttagattaagtttctgtctggatctaatcatttaatcagacaatcaggcagattgtctgtgattagttttggccattccagcttcttcattggttgttaactttcacaaataaaggctgctcaaagattagaaataacatttaatttgaatgtaaatgtgccatagtttaaaagatgggtttggtgaatacagtcaaatacatacatttaaagctctaattctgaagattatgtaaagaaaaggaaagaaatgtagggagaggattgaaatgttcatggtataacaatatctgaacatccatctggtcacaccgttggtatttgaatgttttgtcctcctcaaattcatatgtcgaaatcccaactcccaaggtgatcgtattaggaggtgtggtctttgggaagtgattaggtcatgaaggtgaagccttcatgaatgggattcgtgctcttataaaagagaactgtgagaaataagtttctgtcgtttgttagccacccagtttaggatattttgatatagcagcctgcatggactgagacaactatgagttattatgatagcttctgttatttcacctaaattcatagaagctaatatatcaatatttatgctatgaaatatttcttaaccaagctttgaatatatttatatttttgtttatttttaaatttcagattccagatgacctgaggaagagactaaatatagaaatgcatgccgtagtcaggataactccagtggaagttacccctaaaattccaagatctctaaagttacaacctagagagaatttagtgagttcaaatatatatgttacatcaaaattcttttacacgttttgtaagatttctagttgctttagctaagtaataagaatgttgtattcctttttgatacaaatctttttttattgtgttaaactatatataacataaaatatgccatgttagccatttttaagtgtataattcaaaggcattaattacattcataatattgtacaaccatcaccactatctatatccagaacttttccatcaccccaaagagaaacttggtacccattaaacaataattccccgtccactcctttccccagtccctggtaatctctaatgtatattgtgtctctatgaatttacttattctagatatttcatatataagtagaagtatgcatttgtcttatgtatctgacttatttcatttaacataatgttttcaaggctcatctgtgttgtatgtatcagaatgttattccttttcatggctgaatactattccattgactgcatataccacatttgtttatccattcatctgttgatggacacttgggttgtttccacatttttggctgctgtgaataatgctacagtgaacattggtgtacaagtatctgtttgagttcctcttttcagctcctttgggatatacctaggaattatgtttaactttttgagaagctgagaaatctttaataaatgataacacaaatacttatatttgccaatgcaaatatgaatatttttggcttttaagagattgatcattttgccacgtggttgtaattaaaaaaaattgtcccatgttgtttcagtattaatattgtagcctaaaagagtgctagactgttttactttttactcagttaattctttggatactggtagagtcaggaaatgagatattgaacttaaagatctttgcaggtggggtccagtggctcacacctgtaatcctagcactttgggaagctgaggtgggaggattgcttgaggccaagagtttgagaatagcctgggcaacatagcaagaccccatctctacaaaaaaattaaaaaaaaaattaagccaggcgtggtagctcacgcctgttatcccaacacttcgggaggctgagatgggtggatcacttgaggtcaggagttggagaccagcctggccaacatggtgaaaccccatctctactaaaaataccaaaattatcggggcgtggtgctaatcctgtaatctcagctactcaggaggctgaggcaggagaaccacttgaactgaggaggtggaagttgcagtgagcctagatctcaccactgcactccagcctgggtaacagagcgagactctatttcaaaaaaagtaaaaataaaaattagacacatgtggtggcacatgcctgtagtcctagctactcaggaggctgactgaagtgggaggatctcttgagcccaggagttccacactgcagtgagctatgattgtgccactgcactccagcctaggcaatatctcaaaaaaaatttttttaaatagattattaggccagacgtggtggctcatgccagtaatcccagcactttggaaggccaaggcaggcggatcacctgaggccaggagtttgagaccagcctggccaacatggtgaaaccccatgtctaccaaaaatacaaaaattagctgcaatgtctataatcccagctacttgggagcctgaggcaagcgaatcgcttgaacccgggaggcagaggttgcagtgagtggagactgcgccactgcactccagcctgggcgatacagcgagattctgtctcaaagaaaaaggaatttgttttcctgtctttatcgtagagggaggaaagggagaatggggttggaatggttattgagtgagccacattatggtagatgtatcactgggcatagagaaaaggagcatttaaaacttttccgcctaacagatgtttcttcaggctacactgcactcattgtgctaactgtaatgtcaaatcccagacctgtgcctatagaacatgaacatccttcattggatttgtttggtcaggcttacactttattaggaagatcagatgttaaaataagggtgttaaagttaagttcagatatgaggataattcattactattcctttttctggcagcctaaagacataagtgaagaagacataaaaactgtattttattcatggctacagcagtctactaccaccatgcttcctttggtaatatcagaggaagaatttattaagctggaaactaaagatggtgagtacatttgttattttgacttttttttctatttaaatagttgtacatttttaattgttcttgcaacctgtcatacctgtgaacagtatgtgaatagtgaaatataattatgataattaaacagtagtttttatgtattgaaaaatatctttggccgggtgcagtggctcatgcctgtaatcccagcactttgggaggccgaggcaggcggatcacttgaggccaggagttcgagagcagcctgccaacatggcgcaaccctatctatacaaaaaaatacaaaaattagcctgacatagtggtgtatgcctgtagtcccagctacttgggaggctgaggcagaaggatcacttgagcccaggaggtctgtgttcctgccactgcactccagcctgggcagcagagtgagaccctgttggggggaaaaaaaaaaaagtctttaacttaaataaatttgacatttaaaatcttaaattatttcatctctgtttcagtactaactctgcatttattactttctttttaataggactgaaggaattttctctgagtatagttcattcttgggaaaaagaaaaagataaaaatatttttctgttgagtcccaatttgctgcagaagactacaatacaagtaatagcatgttattgaatatttaataaaatactatttgttacatatgattgataataaagtatgaagttccttgtaacaccttgcattgtgaagtgtattaaaaacctgctaagagtaaggaataacttgatttaaaatattttattctgtaatctctttaaattatctgtacaaattattgacttaacctaaatttaaaaatgaatgccttagcacaattaagttccaagaatagagttgatcatgttaactggtaaatggatcatgatttaaaattcttctaggattgaaacaaatgaaaacgtagttttaagggtttgattttttaaattcctatttttacatgcaattttactgcacaacccatcttattttgacagttcttaaattcgcaactcttcagaaatattatcagatcacttttctttgcttccataagtttttttattattatattattattatttttttttaaaagacggtgtctcactttgtcgcccaggctggagtgcagtggcatgatcatggctcactgcagcctcgacctcccaggctcaggtgattctcccacctcagcctcccaagtagctgggaccacaggcgaatgccatgatgcctggctaatttttgtatgttttgtagagatagggtttcaccatgttgcccagaattgtcttgaactcctgggttcaagcagttgttctgccttgcccacccaaagttgtgggattacaagtgtgagccactgcgcccagctattctagaagtattttaagagtcgtctttttttttttttgagatggagtctcactctgtcacccaggctggagtgcagtggcacactctcggctcactgcaacctccacctcctgggttcaagtgattctcctgcctcagcttccctagtagctaggattacaggcgcatgccaccatgccctgctattttttgtagttttagtagagacgagatttcaccatgttggccaggctgctcttgaactcctgacctcaagtgatctgccctcctcagcctcccaaagtgctgggattctaagtgtaaaccaccacacccagccaagagtggtctttttacaatattattttttgattaggacattcattcttgtcataaaattgaagatactctagtcatttagaatttcattgttttggaactagacattgtttctttatttttgaaatgttattgaaggaataccatttggagaagatacaaatgtaagaattgtgaaaaggataattgtgacacaaatcaaaattatagataaaaatatacctgtaaaatgtattaaggcaataacattctttctgcttgttgaccataaatatttatattccctggatgggtacattgttattgtcaagggtgtttaaataatgatcttgcatgcataatttattctctctggtataacagaatcagcaatttagttttctgggacccgagaaaaacatgcaaaagacatactttgaaatgtaaaactgatttttccttgcaactgtaggtccttctagatcctatggtaaaagaagaaaacagtgaggaaattgactttattcttccttttttaaagctgagctctttggggtaagaagttatggccaaactagcatgttagacatgtttttaacactatatctggcagagttttcaatgtaaatattaaagtagatgttaatgtcaataagtgatcttaataatgcatcagtagatattttttcaaggattgtctctatcttcacgcctagcttataatttgccttgtcgtctttttttttttctctttatttttatgtttttatccatccctggtggtaggggataaccttgtcttcttcgataacaagaagtctgaagcttattagaaattttactttgagaattgatcgatgagaagaaagcaactagatatcacgtggatcatatatgcttgaataaaacaataattcttagaacaaataaatacattttaaaagttaaagccaaaaacattagttgaatgtttaaaaatatttcaaattaagttattccttcactgtcttgtattactgtaataatttggattatttgtgtttttctcaacttttaaaacaaatatttaaaaaattcctcttttgattaagtagggctagataaaatataaaaaatattttttaaactcctcttaatttccatatttcttatataatatgagaatctcttataaacactacctcttagaagtctccacagaagctttggtagatgtagtagtagggatttgatttcttagaatggtataatctgtaaatgttttagtaaaaggattaaacgataaagtcaaaatgtttatagcacagtgtttattaatataaaataaaatctctttttttttttttgagatggactctcactttgtcactcaggctggagtgcagtgttgcaatctcagctcattgcaacctccgcctcctgggttcaagcaatccttccgcatcagcctcctaagtagctgggattacaagcatgcaccaccacacctgcctaattttttgtatttttagtagagatggggtttcaccatgttggccaggctggtctcaagtgatccgcctgcctcagcctcccaaagtgctgggattacaggcgtgaaccactgtgcccagcataaagtaaaatctcttcagactctcatgtgatcatgtaaagtggcaggcagtcacagtcaagaagtagtttaaagttcatgtttgtaaaatataatctacagattgatactggatttcataggtaatgtttaagagaaaataagtttttagttatcctcagtacttcaaaagcacccatttatgattatgttgattactaaactaaatcatttgggggctagaggtgtttttttatgtgttaagattccttaaggagttctattagggcaaaacttttagtaactgcatattttaaaagtaataaaactaattttaaaagcttggaggctgggcgcggtggctcacacctgtaattccagcactttgggaggccaaggcgggtggatcacttgaggtcaggagtttgagacgagcctgagcaacatggtgaaaccttgtctctactaaaaatacagaaattagccaggtgtggtggtgggcacctgtaatcccagctactcgggaggctaaggcaggagaattgctcgaacttgggaggcagaggttgcagtgagccgagatcatgccactgcactccagcctgggtgacagagcaagactccgtctcaaaaaaaaaaaaaaaaaaaagcttgaagtcagattcgacattaatcagtatactttctctcaagtaggggacaatttctaagattttagtcttttaaaatttattaactagtctgagcatggtggcttgtgtctataatcccagcactttgtggggccgaggcagatggatcacttgagcccaggagttggagactagcctgggcaacatggcaaaaccccgtctctacaacaaatgcacacacaaaaaacccaatcagctgggtgtggtgttacactcctgaagtcccagctactcgggaggctgaggcaggaggatcacctttgccagggcgtttgaggctgcagggagctgggttcacaccactgcgctccagcctggatgacacagcaagcccctttctcaaaaaaaaaaagataaaaaattaaattaaattaattaactacactgggaaggcaaaattcagcatttttttatagctaaattttatcctgcttcagtcttttatcatgtaactatgtatattttttacagaggagtgaattccttaggcgtatcctccttggagcacatcactcacagcctcctgggacgccctttgtctcggcagctgatgtctcttgttgcaggacttaggaatggagctcttttactcacaggaggaaaggtaagtggttaaggtgtgttcatttttctgtaacatttaataacttttcatttatctttctttgggttttgaccatctattatatagggtgggttttgaccatctattatatagggtttatacgacatatggaaagcattcatttattcactaatatttctgtgtgtctgcttttaggtgttgggggagtgatgacgaataagactgatgttctccatgccctttttctgtgtcagttgatacaattatatggtttttcttttttaggctattaggtgttgatagggttgagtaacttacaaatgttgaaccagccttgcatacctgtgataaataccacgtagttgtggtgtatcattctttctacattgctgagttttatctgctaatgttctgttgagcttttgtccatttaagtttgaaagtgattagtttgcagttttctgtttttgtgttgtctttgtctggttttgctatccgtgtaaatctggcctcataaaatgagttgggaagtattctctcctcttcttttgtttttttggaagaggttgtataaaattgaggctgaatcttggtggttgccacaatgacaggaactatttctgtgactgaatatattgggaattcctataaagcaattattttctagggaagtggaaaatcaactttagccaaagcaatctgtaaagaagcatttgacaaactggatgcccatgtggagagagttgactgtaaagctttacgaggtatgagtatggtaacactctatataaatccctttttcattagaaagacaggaatgttatacataatgctgtcaatctaataaatacacatatcatctagtctttaacttttctgtttatcatttagtcattaaaatttcttagaaattttaagtctttggctttctaatgtttttgataaaatttctaaaactctccatatttaatggaggcctatttttttttctagccagaactttttgtagactacatttctggaagtgctcactgacaccactctgaaaaattagtacttagaatatactctaattggtataaatgatctctgaattgctatggaaaactgggagaatggttgcttcaggggagagaaagtaggaggctgtggacagcaatgaggagaattacagttcaccatataacacttttgtacttttaaagtccttaacatttacattattatctattcaattaaaaaatattgggaagattttactttgaacagttaatttttcccccatgggtaccgctgtcatatagttccaactaatcatgaacttgtgtatttcctgttctttgtaaatttaaactttgtaactcaccaggaagtttgaagccaaatttgtgtttcaaatatagcaactccaggatctctaggcagatgcatttgcatttgattttaaatgaatcttgatcccttactctcacttatgttttcccacatcctactttttttattttgttgtaagccatctaaaattctcaatgggatgaaactgggtataaatgaatacatgcatacaggaattatagtagcatattccttttcttttttctttttttttttttttgagacagagtcttgctctgtagcccaggctggagtgcagtggtgcgatctcggctcactatagcctccacctcccaggttcaagcaattctcgtgcctcaacctcccgagtaattgggactacaggtgcatgccaccacacctggctaatttttgtattttttagtagagatggggtttcaccatgttggccaggctgatctcaaactcctgacctcaaagtgatctgcctgccttggtttcccaaagtgctgggattactagcataagccactgcacctggcctccttttctgagttttataaaatttgatactttactgcacgctttgagactgtattaattgaaccatgttgatgaacaagtttttgtgatgggtatattaataaaatatagatcaaatttttatagttaaatcaatatcgagcttttctagtgctttcaaaaggacaacctgaattttcccagcactgaaatgatactgaaaccatttcatatcttctgtattaaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatggtaaatgcatccaccactggcttaaggtcttgttcttttgtcagtcagcatttttagtcttaacaataaatctactctcttcagagaataatatatgtgttatgttaagtgttgtgtttgaggcccctgatggcattctacagttgtcctatagactgtaatagcaaaattggtagagtaaaaacagtgtgaaaattctgcaacttcatggttagtcctttagggtttttcattctcccttacttattgtttaatttacagatttactcttttgttcatttgacaaatatttgtcaaatgcttgtgcacagtctgtattctcaaattctaggagaaaaagaagggtgaacagtattagcgcagaacgatactaataatgatggctactgtgtatgagtagccagccctttcttggctttcttggattgctttgtattctacatgaagatattccctgggctttacaggtcaataaatggaaattcagagagattaatttgaccagggtgaccaacaaggagatgacagcatacactatgcgagaagtatacacagagtagtgtaggagcatataacctaaactgggggtgaggtgggataaggagttatcagggaaggctttttggaggagttgacaactgagccgagttttgatggaagagtagaaattagcatgaaccaatttcatgctaataaagaagcaaaggaagcgtggtctacaggcaaaagcacagaggtacaggaagtaatgatatgttggggaataccctgttgactggagcttagagtgcaaggagaggagtgctagggaggtgaggttggagggtttggcagcattgacttgcttcaaggttcttaagagctgaaatagatataaaatgcaactaagagtggcttggattattattacctagtgtgttaatctcaaattttgaaatctatagcatctataggactggtgttactaatcttacactcgatctgttactgttcttatactagatctattagtccagtgtttaagggagtggtgcagatttctaggtcaggacaggactcagatgtacattattaatgcctatttcagttctgaccttctcatatgaaaccttataagacctggggtaggaagagattgttctggaagtcataggaatatgaactgtattttgtttaacaaacaatacagtatggaaatttatcacccttccagaatatttatttcagagacaaatttttatcattcgttcatttatttcataagatccacgagtagggaacctcactagacattgctctgagtatatggtctgagtttgcagtacctcttgtgtctccattagatttattaggtcctcaatagataaatcagggaataactagatggattcattttttaaagacatgaaagagcgataccatacatactgcaccttaaaggtcaaccttagagtatcattatttttaatgaatgtataatttttaaatttcatgtttacttttcctaagcttttgcactatattgcttaattccagctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggtaatacactacttgtaaggattattgaattatgtcccttttatagaaattatttttcaattttattagtaattcgtggctttaaatttatgcttctcttaatgattttaaggatatgtaagtcaacatttggtgcatattgtgctagaggcataaattataatttatagccacctgaaatgttagtatgcgctttccaagaaaatgacttttttgaaaatggtatttctttgaatgagaaagaacagagagaaatagatagatggcttttaaacacttcattaattaaactttttttttccaccatcacataatggcacttagtcccctttgggaactcatgagggttttagtggtagtgagctgaaagaaatatgttccaggactggcaaacatattctaaattctttaaaattttcacctagcatctaccctaaatattcagaccctgtgctagttaactgctattgaagaacaaaggtattatatctattattaaggataatagaatggtatttgagatattggtcattgaatatgaatatgttttgagaaataagttttataggaaccaaaaaaaaattcttaaaggaaccatatattactaaaaatgcttcttattggagaaagaaatgacaatcatttattaatgtgattttttcacaactttattaagatataatttaagtacaacaaactcacataaagtgtacaatttgatcagttttaacatatgtagatgccatgaaaccatcaccacaattaaggaaacaaacattttcatcactccagaagtctcctagcccttttactacccattcctcccctgctccatccccagacaactaccaatttgctttctgtcactatagatttgtcaacctgattttctccaaatatacattcaaaaatatacagttgaatacaattggaaattcgaattttgtgtttttttctttaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaagtatgttttactattaaaacctgaacttggaatcttctttctattgtggagaaatgtaattgtagtaagacaagaattaaatatattccattgtagtatttgaataagcagttatttgagtagaaaattagtgtttccagctaagatgatggcatattttgaaaattcatatagtgaatataactagtaaaagaagttttgtttatttttaaacagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaaggtatgtttaaaaaaagaaaaagtgaatacttactcccagaagaaccactgtattattggctttggctttatgtgtcagcttgcccaatctccgtgtgagtcaacaagtgtttactgagttaccaaataaatgtcttaacactattttaggtactttaacaaattttaattttattaattaattttttattagaattgagacctcactctgtcatctaggctggagtacactcacagctcactgcaacctcaaactcctgggctcaagcaatcctcctgcctcagcctccccagtagctagaactacaggcatgaaccaccatgcccggccaactctttaattttcttagagacggagtcttgctatgttgcccaggcagacagattttaatgtgtatgatgcagtctttgatgataagaaacttataatggaaagctgaggtgatagttacagtaaatacattttgatgtataattctgtttgctttaatcattcaaattgtagtaaagcaagatgaactgtctgctgggatttgagcagaaatggataggaataaactaggaggtagaagagttatcaaggttcacaggactgatgggtgaagctagatttccagacccgggatgtcagtccttgaaaagcagacttggcaggcatagacgaggcagatagcaggataaaggagacaaatgtagattgttcttcagaagatcagatggtagagtctaggaggtagtgtgttttaatcagagatctgagaggcaaagatcattgcatgagatcagggacccatgcaaaggagtgagaaaaaaaactgggttaaggagcctgctgcatggcaactcctgggaacagtggccactggggcctgggacatgttgattgcagcccaggactgttaaaaccagtgtgagagaacatgggtatggaagtactagctagcaggatcatgaccccgatgctgggatggggcatcaagcattagtacatggagattcagtacatccagatgcagtacatggagactatatgcgtaactgctgactttgggcttctttcagattggagcagaggtagaggtgagtgggaatattctcaatagagggaactaaataggcatacctaataaaggagaccaggatattgcagacagtagcctcatgtttggctcacctgttcaaaaagttctcttgttcttgagcagtggtgccttaaaaggtaacttgagaagcagtcgattatttgttcagcctggagactcttgggatattttactatctttgattgaatagatttaaatgtacacagctctcataacttgccccatgaagcatatccatgaaaggcactatacttgttaaaagattggtttgtactttttaaatgtagtacttttaataaaacaggaaaaatagaagttctgttgcagttatatgcattttatatagaatgtgttcttaattggaaaaaatttgtcgtagttcctttgagttcatttacagtttttagtaggaattgtattttctactgttgtacttgctgttactaaagaaagatggtcgtgattaccatctgaattttttttctatacattgatctttagctgctacttagtcatttctgtttagacttgagctctttttcatattttttttttttgtttctcagtatccagaattatttgcaaacttgcccatacgacaaagaacaggaatactgttgtatggtccgcctggaacaggaaaaaccttactagctggggtaattgcacgagagagtagaatgaattttataagtgtcaaggtatgttgtctacttatcttctttttttatttaggtaaaattaacataaatgcagttagccatttcaaagtgtaaattcactggcatttagtgcattcacaatgctatgcaaccaccacctctctctaatttcaaaactttttcattccactcctcctcttgcttatcccctggcaaccattcatctgctttttgtctctatggatttgccttttctgtatatttcatataaaacaaatcatgcaatatgtgaccttttttgtctggcttctttcacttatgtaatgttttcatggttcatccaggtagtagcatgtatcagtacttcattcctttgcatgactgaataatgttaccatactttgtttatccacttatcagtggtgaacatttgaattgtttctaccttttgactattatgaataatgttgctgtaaatattcatgcacaaatttctccacggatatgttttcatttctcttgggtataaactgaggagtagaattcttgggtcttagggtaattctctaacttttcaaagaaccaccaaactgtctttcacaccaactgcaccattcccactagcagtgtggggggttcctgattctccacatctttaccaacaccattatgtttctcaattgtgggctagtctcacatttggaaagctagtgggagcagcgatccatctattaaaagttgtatgaaattgagtaatgagccacctctctcttgtagggcttattatgttcttgcttaaggcaatcttcatgcattgtgaacagaattatacataaatgctcagataaaagggcaaaccattcttaaagggagtagacaactagaggcaggagaccatactgaggcaggaagctggggtttttatggttctgttacttttgactatatctcaccattgcttttgtcaaagtgagactaggtctaagtttttttcaggtataaggtgagtgtggtaattaaggggcatgctagcagatcattttgggtaatgcttcacagtccaccactggtgtgtcattgtggtcgcagatccagtatcttagctgtgtaatttcagacatcagcaatattagtttaacaaagggcaattagattccaagacaaaggaatcgtgtattattctagccttattcaaacttgatttataaatcagtttagtaatttatttatttgtttctgtatttatttttatttctttgagatggagtctcactctattggccaggctggagtgtagtgatgcaatcttggcttactgcaacctctgcctcctgggttcaagctattctcctgcctcagcctcccgagtagctgggattacaggctaatttttgtatttttagtagagatggggtttcaccatgttggccaggctggtcttgaactcctgacctcgagtgatctgcccgccttggcctcccaaagttctgggattacagacgtgagctaccgtgcccagctcagtttagtaatgtataactgggttttacccagttgtaaattactcttttgtcgtgtttttttgagaactggcaatgacggagaaactaaaagtgccaggctgttgccttgttcctgttattttgccttagttttttttttttttttttttttctctgagactgagtcttgttgtgttaccaggctagagtggagtggcatgatctcggctcactgcaacctctgcctcctgggttcaagtgattcctgcctcagcctcccgagtagctgggattacaggcgcctgccaccgcacccggtgaatttttgtatttttagtagagacgggattttaccatgttggccaggctggcctcgacctcctgacctcatgatccaccagcttcggcctcccaaagtgctgggattacaggcgagaaccaccgtgcccggtcttgccttagttatttcttgttccctcctctagtcctatagttctctgactgtattgaggaaatgtaattaaatattattatgttaatagatatttatgtggttgaatattagaaattccttattttggtcacatatcctgatcagtagttggtcttctggagatagtgatttttcactagagatgactttaggacctattcaggttttttttaagatcccaatttaaggaaagactattctcattattgattttgctatatgcagggaaatttatttcgaaaggtttttcagttggcttttagggaagattatatattctctttttttttttttggccttttcccacatgttctaaaaatgatatattctttaactcctatgaaaatacattgtttcagtaattgaagatgctgattaaagtcatatctctacacattttttaaaatttgagatagatgggactttgtcccttcttacaccattcacttattcacttggaaaaactattatccaatacttatgtggcagacactgtttctggcacaagggattcagcagtgaacaaaactgcctttttggagtttacattctactagtggaaagcgacaacaagcagatagacacattcagtatataattcactgtcagatggtggtggtaagtcctatgtaggaagaaaagcagggtaaggaggcttggagtaactggagtgagtcatagatggacttgtcaggaaagggtttctgaagaggtggtatttgggcagagatctaaataaaatgaagcaacaagccatgagaatatccgggggaaaatgttctgggcagaagcatcaagcatagaacttgtggtatgatatttattctagcacacattaattttaaaaatgtataaaagacatccatttaatcatattaaagatttccatgattcatttagacttagtcagaaaccaaatttatattttctttttaaataattttatctcaactcttattttacccaataggggccagagttactcagcaaatacattggagcaagtgaacaagctgttcgggatatttttattaggttggtagcctatgaatgtttttaaagtaactgactctgttattatttatcaatcagtgctttttttggtcttgttttttgaagaactgatatttgaaacctgtggtttatgtgaattattaataagctagaggacgtggattctctatttcatcaaataatacaaaacattttagatattaaattttggaaattatttggttttgttttacaatagaaatactcctcaaagtggaatcgaagtggttattcaaagaaatctcagagtagattcttatatgaagcaaataattgcccctaatttatctctaaattttgtaagttctaaattcttttttcccccagtttctaatttatctcttataagtcaagagtccatctggccaatttaatttcagtgagtgtaactattttgcatatattaaaaaactgtatatgaatacagaagatggtatttaaggatgaaaataattattcaaatgtgatagcattatggggagttttaaaataaaagttactgttttattcttccaaaaattttattataaagtatacagttaagagaatatacataaaatacatatgcagcttaaggaagaataataaaatgaatacttcatgtattcaccaccgagtttaccaggaaaaagcataaacaaaataaacctcttccacgtaattcctgggttaaagagaagttatagtggaaaatatttgggagcaaacgataatgaaaatactatccattaaaattgttagatgttgcaaaactgatttcaaggaaaatttatagtgttaaatgtttagaaaagaaaaaaggttagaagttaaccacttatgtatctatctcatgaaattaggaaaattatagatataaactaaaaaatatgttaaaagggaaataataaagataagaatgaagtttaatgaaacacaaaacagagaagctcacaaagccaagatttattttttgaacaccgagtacaattgacaaatctctaacaagtttgattaagaaaaaagaaagcatgaataaacaattttagggataaaaagggaaacatcgctaaagatatcccagaaatgtaaaagataataagggaatattatgaaaatattcatgccaatacatttgaaaacttaggtgacatagacaaaaacaaaattgaccaaaattgagcaaaaaagaaacaaaatctgagtagtcctataacttagtaaaaattgagttagaaaagttaaagaagtctttacacaaatcaaacatcagactcagttttctaggagagttttgccaaacattcaagtagcagataattctggtctatttttggccccagaagatatattttacttgccatgcatttaatgagatagctgttgatttttttcaatcaccgtgacaggtgttttatattaggtgttattcgccagacatctagtccacctgttgccagatatggaattaatattcacttattttgaattaaaatttgttaataaattaataaaacaaagtcaaagttcaaattattaaaaaagtaaaagaaataaaatatattttatagagagcccttacaaaacagtaccaacataatgagctttccaaattttgaatgggcaaaataaatgaataggcatttcacaaaagaaggaagggtggccaataagtatatattaatataaaaatggttacttgtaataggaatcaaaagtgtttgacttattgactaagagtcagtttttgttttgatccctgttagtctatccagaaggcatgggtcttaataaacaccttgacctcaacagtttactgaatacaagggtaatttcatatgccttgccttctttaagggtttgttgtaaagattaaaataaatacataaatatatataaatacatttatatgtatttatatgtaattacatacaacttgccttctttaagggtttgttgtaaaaattaaaagaagtatataaatatatataaatacataaaataaatacattcatatatgtatatgaaatcactttgccaactatgaagcctgattcaaatatgaaatgttgtttgtttttcccagagcacaggctgcaaagccctgcattcttttctttgatgaatttgaatccattgctcctcggcggggtcatgataatacaggagttacagaccgagtagttaaccagttgctgactcagttggatggagtagaaggcttacagggtaataattataaatacagaaatagaatgttataacaaaatgtcatcatgtcatcagattttggtaaaaaaatgttcttttttcctctaggtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaatgcaagaaacctaatgtattatattttcacattatcttctgttcaaagattacatacttccattatcctgtcaaaaaaaaaactctgatacagaatcaagcatgtgaatcgtaagcatgtaagcaggtttcatagagataatttttcaactcttccttgtcctgtgttgttccaactcttattctccaatttagaagcaaacaaataaatgaatgaaagaacagatagacaaatgaatagtcaaaggtataaagtatctgtatatatgttacatgtagctattatttaaattatttagattttccttttgaaataccttcttggcacacttgcctaaatctagaaaataagcactgtgtgaataagaaattatttacactgaatattttgtaggtttttgggtttttgtttttcagacaaggtctcactttgtcacccaggctggagtacactggtacgatcacaactcactgcagcctctatggcccaggctcaagcaatctccccacctcagcctcccgagtagctgggaccacaggcacacgctaccatgcccagataattttattattaatttttgtatagagatggggtctccctgtgttgcccaggctttcttgaactccagggctcaagtgatcctcccacctcaacctcccaaagtgttgggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggcaagttatatgaggaagttgttatgacattttatgagtgataaaagaagtacaatgtcaaaatttccaccttaaaaaatgctattttttaaacaactttggtaaaactgtatagaaacataaatttacctttagttgaatgttccatagttggaatatgggttttgcagagaatttataattatgaagtttgatgtctgtttctttaacattaccttaatattggcaaaaacatgttggtgtttgcaaggatattatttaaattgggataccatgaattaaatactacaaacaaaaataattagagttttttgtttgtttgtactttaacttttaaaaaataatcagttaaagttgttgttttgaagctcacattgttccaatctggccaataggagccccttttgtatggctcctgtatctttatgacatgtcctcatcattcttgaatcacttcctcacttccagatacagtaagttattcttggccaggtgcagtggttcacgcctgtaatcccagcactttggcaggccaaggcaggaggatcatttgggcctagtttgagaccaaatcatggttgcacaaactgtacccactatggacaacagagtgggatcttgtctctatgaaaaatttaaaaattagctgggcatggtggcacatacctgtagtcctagcttcttgggagaggctgtggcaggaggatcgcttgagtaaatccaggatgcagtgagccatgcttgtgccactgcactccagcatggatgacagaatgagaccctgcccccaaaaaagaaaaatattcttggtttatcttgtactttctgtatcccagccctagcatcagccttttctctaaagacagtattatgattttaatatttacagtagatatttgaactgttacattatagactttaccatatattttctaggaaggattattctattactcttctttaccacatttgtttggaatgtctacagaacctacagtttctaaatcagaaactccctaggtttttgctattttggcaagccattgaagttcttccctctccctttactaccagaaaggtgtgtatttgtagagctctctataatgagaaagcactctataacatggttgattcatcattttggagtagaaaagtatgaatggaaagtcagagacataaaaataaagcccagaggtctgagtcttagcttcattacagactttcttgggggatggttggtaaattatctacacattctatcttgtctttataattttaatagttaaatttttaccatgtgcctcaaaaccgttagagaattaatgagctctttgaaaaatgcttctaagtttcttgtattgctctaatagaatgctatctatgttattatttatttctgagactaaaattgtttacatctttaaactggttgtccttttgtgtattttaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttggtatcttgtgcagtcatcattatacagttctgaaatataaagctatatgttggtgtaaagttgcagtgatttctctcctaaccagccccacatattcttcctggttggttggttcttcagtaaaatagtcttgtttcttgcttacactaattggtaatttgcattccttgttaagattttcaagacagggctgggagcaaggaaccaaagtagcgcgtggttgtgattacctttggtttctttgaggtttctcttacctagtggctttaaaacatctttaggagcagttccattttatagtaaacttaaattctgttatcatgaacagttgaggataatgaataatttgatacaataatgtaagaaattcctgaaaacaaagtgttatctgtgatacttttgctgcatagtaagcacaatgaagtgtactgataatgtttcaacaggaaagtgttttgattaaatgtgggcagtatcactgttctactagcattcaacatctcttctaaaaattaatagtggttcactgtaattttattggtacatgtaacatctgtacatgtgtttggttatctatatgtttcctggttttttgtacatttgctttattaatttaggctttttttttttttttttttgagacagtctcactctatcatccagactagagtgcagtggcacaattatggctcactgcagccttgacctcctgggcttaggtgattcttccacctcagcctcctgagtagctgggactacaggcacatgccaccatgcccagctaatttttgtatgttttgtagagacgaggtttcaccatattgcccaggctggtctcaaactcctgggctcaagctatctgcgtgccttgacctcccaaagtgctaggattacaggtgtgagccactatgcctagcctaactcagactttaaaaatataaaagcaattcatttttattcccaagaacagtaaggtggtggtttaattttagtctttaattctgtttttaatttattctatttagaaatgtcccagaaacttagtataactttactttctgaaaatgaagaaacctgtccttgggcattagtgtgttggatttaagcaacaaagttaaaaaaacctaccctgtgttatggcaattttcacttgatggtggttctataacacaggtatcagtgaacctttataaaagatgaacaacttttcagcttgcttaatttcagttaattaacatgtatacttatctatgttaatgttttattgcttaaaatgtttaatttttatatttggtaaacagatagttttttctctccccctcttccttccatctttcattactacaatttaccatgcagagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagtatggctttttccccctcattataattgttaaaacttcttaaaaattgtttcacccttttgatatatatttctttgacttataaacgagctatatttataaacaagggaccagaacacattaactcagtcatggttatgtgcttccttgctttcaatgtttcattatcttataaggaagagaacgtatggtctcttgaaaaaactgacaataagaagtaacaactggactaccacatttttttttacatccttaatttaactcttcgtcaatttctttttttacttaaggaggacgaatccatgaaccaaccaggaccaatcaaaaccagactggctattagtcagtcacatttaatgactgcacttggtcacacaagaccatccattagtgaagatgactggaagaattttgctgagctgtaagtaacagattctgttttggaagtacagctactattacaagtgacatagtattacacttaaacctttaaagttcgtgtttaaaataaaaatattttgaatatttaaaagctaattcaaaaaatatgtgtcgtagctatgcattaaaaaaccccaaaatgtcagaagtacagaagtcaaaattgagttttcattaaccagttcatttgattatatttgaattattcataatggactcatttaattttagtaactttgggctgggtgctgtggctcatgcctgtaatcccagctctttgggaggccaaggcaggtggatcacctgaggtcaggagttcgaggcaagcctaaccaacacggggaaaccccatctctactaaaaatacaaaaattagccaggtgtggtggcatgcgcctgtagtcccagctacttgggaggctgagacaggagaattgcttgaacccaggaggtggaggttgcagtgagccgagattgcaccactgcactccatccagcctgggccacagagcgagactgtgtctcaaaaaaaaaaaaaaaaaatttagtaacttcgaagaaataagaaggaaaattaaaagttgaaagtgattctaatgtatagtttataaaattttgttataaaaatacctgttttgccttcaaaataatttatattaatattttattgacctcaagaacatttaaatacattcagatttattcatttgtggaccacatttgttatacattggatttaaaggatccttgcaattgagtttatggccacctatgcatctgagacccatggactgggaaccattctaggtcaatgattcagtgtgattcaatttaagagatgtttattcctggtctttagaagctgctaccttttgttatctaattttgcagtactttgaagtatgtatgtatgtgtacatacgttagtgctatgtatttattaaagaagaatcagaaaacagaggtaaggaaaaataaggaaacaaatttctgttaagcccaccacctcccaaagcatatttgtttatatgcttatatatgttttcctattatggtaagaacagtctgtacatattgctatatagcagtccccctttatccacatacatcctgaaaattgttttacattttaaatgttaactactttattgtttttaaatgtcattttatagtgtagctatgccacaatatccaatttttagacatttaaattgctcccaggcaatgtggtaatgaacattcttgcagctgaatatatgcacatatctaattgtttcactaggatagaggtggaattgtataacagggagctcacattttttaaggcttttgaaatgtattgccaaattgcctgccagatatactgcaccatcactaacattgtgtgttgcagtatttttctaaacttggcccttttgattttagaaaaatgatatcaataatttacatttctttgattaaagtgtagaagttataatttttcatattattcattgtcatttgtattttatcttttctaacttgtctcttcatcccctttgctccgttttctattggagtgcaactttatttgtaagaattctttttaatttctgtgactggaatttttttttctagtttgttatttcccgttcatttcttaaaatataattgtgtttgccaacaatccattatcttttgttttgtaatggtagtatttatacatattaaattatctctttcttttttcagatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgatacaattatctgttctttgtatatcaaaaaatgtgaaatttacacataattcaaatacatttaattatccgctcaaccagaaatgaaatcacatccctctactatactacatccagctccaagcccaagatatttaaatgacatccattcctctcctagttccagttatgattttatcttgatattctctcatatatgaactaaattataaagttagccaccatcaatacaatctgcgtatctaatatcttaactatatagtaatggggtaagggaacagcaaaaaggagaacattaattaaaatatacaagtaagcctgggcaacatagtgagaccccatctcttaaaaaaaaaattagccatgcatgatggtatgcctctagtcccagctacttgggaggctgaggtaggaggatcacttgctcccaggaggttcaaggttctaaaccagcaaagctcagaatcccaggggatagaaacaaagacttagtggatcactagtattaaactgagacacgtcaccctgcattgcactttgtttctcagttctttgatgaaatcactgagctgacatacctgccctcttttcaccataaagtgagtttcatgatcagaagcaatgtctatgggatagcctaacaaacaatgtaaaaaccatttagtaagttcatgaagggtggtggtggtaaaaatttggagaacatacaaaacaaatacaattccaaggtgtgtcccctccaggaaggacaaattgctgcctgctctgtgatagaagaggatcagatgtaatcaacctgccgtcagacttgggctgttctctcctgggtgtggacttgcctggttggtcactgctgctgacaagtaggctgtcaatatagctgggttgtcatgtcagctgtggtgagggggaagtccacattgtggaggccacatccctgcactcttggccaatttgaccatgaatcttaagcactggggtggctggaaaagacagccgattgacatccatacagaggtcatcttgaccacttgattagtataagcactgaaggcttttaactgagcattcacataggacacaaatattctgattctttgggcccattccaagaactctgggcatacttttcctccagacctcatacccagttgtgttctttccaaatttctggtcatctggttatgttattagccactatctgtgaatcagcatagatttttatatcagacatctctacctcctgacagaatggaggagatatgttacttaacaattctgttcccttggaagatttcctgtctccactgtttgtaagggctactccctcaatgtagcagtaatgctttcactctgatgggaagtcacagtggaattctgggtctccaagaattagtgttagtgcatacacagtgtctgataatccccagagtgtctggtgcccttggatcctgtgaagaaggcttggagaaaagaagattcatggcaagaacttgtgatgtgatgacagggccttttctctggctcttcattcttagtctgacctaggtgtgagaattaggtcaggggccatgactatattgtggtgactcaaaccaggcctttgtttactaactgggagatttttacattgtaagaatcaagtaggatctttgcccatgtattttggtcttaagaacacaaatgatatggctccaatgactggaggaacaccagggtccttggtctcacgctgatttagataaaacgactgtcaggcctctgagcccaagctaagccatcctcccctgtgacctgcacgtatacatccagatggcctgaagtaaccaaagaatcacaaaagcagtgaaaatggcctgttcctgccttaactgatgacattccaccattgtgatttgttcctgccccatcttaactgagcgattaaccttgtgaaattccttctcctggctcaaaacctcccccactgagcaccttgtgacccccgcccctgcccctaa
